United States Patent 11,098,302 (IDENTIFICATION OF POLYNUCLEOTIDES ASSOCIATED WITH A SAMPLE) - sequence listing, part 48

SEQ ID NO: 163183 - DNA, 850 bp, Homo sapiens
  misc_feature: GYAE6OF01BOH7S.39.27.C05.1.454.CMB.1.raw
  modified_base (190)..(190): a, c, t, g, unknown or other
  misc_feature (190)..(190): n is a, c, g, or t
  modified_base (205)..(205): a, c, t, g, unknown or other
  misc_feature (205)..(205): n is a, c, g, or t
tcagtcgcactagtcacgaccggtgctcgatttagacgcgatcgaagggtttgggggagtcagactcagtcaggacacagcatggacatggagggtccccgctcagctccgtgggctcctgctgctctggctccaggtcgaccaaagtgtagacatccgagatcgacccagttcctccttccacctgtcngcatcgtggtagganacgagacgtccaactactcgtacgttcggcccggactacggtacgaaggtaagttaagtttaacggtacggtcggttcgggttacggccggtttaggtactacggaacgtaaccggaaaacggaaaacccgggaaacggggtaacccctaaccccgtaaaggttcctaaccgtagtaagttaggtaacttacggtacgttaccgtaccccgttaacgttaaggtttaaaccgggtaaaccgggtaccggggtacctaacggttaacggtaaccggttccggacgggttaccgtaggacggtccgtagggtacggtaacgtaagtaaaccttctaacccgtacgtaccctaacgtactaccgacggacttcgaccgttcgacgtacgtactacggtagttagttacgttaactaacctttaaggtaacctttacggaaaccctaaacggttaactaacgtttaagtttaaaccgtttacgtttaaacgtttaccggttaaccgtttacccgggttaaaccgggtaccgggttaaacggaaacccgttaaagggtaaccgggtacgtaaaggaaccggttaaaccgtaaccggtacgggttcgtaaaccgggtaccttaggaacccgttaaccgtttcggtaacccg

SEQ ID NO: 163184 - DNA, 379 bp, Homo sapiens
  misc_feature: GYAE6OF01C7PKA.39.27.C05.1.454.CMB.1.raw
  modified_base (346)..(346): a, c, t, g, unknown or other
  misc_feature (346)..(346): n is a, c, g, or t
  modified_base (365)..(365): a, c, t, g, unknown or other
  misc_feature (365)..(365): n is a, c, g, or t
  modified_base (371)..(379): a, c, t, g, unknown or other
  misc_feature (371)..(379): n is a, c, g, or t
tcagtcgcactagtcacgaccggtgctcgatttagacgcgatcgaagggtttgggtgcccaagctgctggagggcacggtcaccacgctgctgagggagtagcctgaaggcctcggacacctccatgtattactgtgcgagacatggtgatattagtggttattcctccgtgggccagggaccctggtcaccgtctcctcacgcctccaccgaacgggccccagtccggtccttcccccctggcccacccctccctaccaagacgcctaccgtcggtgggggccacgagccggccctgggctcgccgttggtacgaaggacctactcctactacgtgccgacgtgnggaccgggctggacaggcncaatgnnnnnnnnn

SEQ ID NO: 163185 - DNA, 868 bp, Homo sapiens
  misc_feature: GYAE6OF01ETSHS.39.27.C05.1.454.CMB.1.raw
tcagtcgcactagtcacgaccggtgctcgatttagacgcgatcgaagggtttgggggagtcagactcagtcaggacacagcatggacatgagggtccccgctcagctcctggggctcctgctgctctggcctcccgaggtcgaccaaattgtagacatccagatcgaccctagtcctccttccaccctgtcgtgctacttcgttgttaggagacagtactccacctagtcctacgttcgggcccgggacctaggtactaaggtaacgttacgttaggtacgtcgttgggttcggtccgttagggtaactcggaacgaacgaaaacggaaaacccggtaacggggaaacccgtccccgttaaacgtcccgtaccgttagtacgtttcgtaacgtgtacgtcgtacccttacgttaaggttaaccgggtaaaacgggtccgggtacccaacgttcggtaaaccgggttccgacggacggtaggtacgggtacgttaccgggtaagggaacttaacggtaacctttaccgtaacccttaccgtaccaacccgtagtacccgaaccgtaccggaaccgtccccggtagacccggttactccgttaagggttaacctttcgggtttaacttttacccggaaccttttaaaccgtttacgttaacctaccgttaaaccgaaacgtttaaagtttaaactttaaacgggtttacgttttttaaacgttacccggttttaaacgttaccggtttaccggggaacccggtaaaggggtaaccctaggtacgtaacggtaaaggtacccttaaaaaccggaacggttacggttacgggtaccgtacggtaccctacccggtaaccgttgtttaaccgg

SEQ ID NO: 163186 - DNA, 731 bp, Homo sapiens
  misc_feature: GYAE6OF01EMV7J.39.27.C05.1.454.CMB.1.raw
tcagtcgcactagtcacgaccggtgctcgatttagacgcgatcgaagggtttgggggagtcagactcagtcaggacacagcatggacatgagggtccccgctcagctcctggggcctcctgctgctctggcctcccaggtgccaaatgtgacatccagatgacccagtcctcctcccaccctgtctagcatctggttcggaagacagtacgtccaacccatccgtacttcgggcccgggaccagtcaaggtagttacgttaggtagtcgttgggtcggtccgttggtatcgacgacaagaaaccggaacggaaaccgccccttaagcctccgtaggtaagtgtaactgtacgtcgtcccttacgtaaggtttacggaaaaggttccggggtaccctaagtaccggtaaaccggttccggacgggtacgaggttacggacgttacggtacggaacgtaacggaacttttccgaacttccctaacctaacccgactacgtaaacgcccgaacggtccctacggaccgtacgtccgtacgtattacgtttacgtttacgtaacttaaccttaagtttacccacgtaactaaacgtaataacgttaagtttacgttacttttacgtaccttacggtttaccggaccggtaacgggaaccgtagtcggtaacggacgtaagtaaccgaaaccgttacgtaggttaccggtacgtaccgtaccggactcgttacccg

SEQ ID NO: 163187 - DNA, 804 bp, Homo sapiens
  misc_feature: GYAE6OF01EMCN5.39.27.C05.1.454.CMB.1.raw
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgaccctagtctcccttccaccctgtctgcatctgttggagacagagtcaccatcacttcgccgggccagtcagtagttattagtagcgttggttggcctggtatcgaagcaagaaaccgaagggaaacgccccctaaggcctccgtgacgtgtagtgactcgccttaccgtaaggtttaggaaaacggtcggggtaccctagtaccgtaacggttccgcgggacgtaggtcggtacgttcggtacgggaacgtaacgtaacgttaccgaccttacctaaccgtaaccctaacgttacgaaccggtaccgtaacggtaccccttggacccgtaacggtcccgtttaaggtacgttttacggtttaacgtttttacgtaacctttaaaccgttttaactttaacccggtaacgtaacccttaaacgttaacggtttaaactttaaacggtttaacggttttaaccgttttaacccggtttaaccgtttaaccggtttttaaccggggaaacccgggttaacgggggtaaaccccgtaaagggtccggttaaacgggtaaccgtaaaccggttaaaccgtaaaaacccgggttaggttaccgggttacggtaccgttaacggtaccctaacccgttacgtttaacccgg

SEQ ID NO: 163188 - DNA, 429 bp, Homo sapiens
  misc_feature: GYAE6OF01E06FC.39.27.C05.1.454.CMB.1.raw
  modified_base (395)..(429): a, c, t, g, unknown or other
  misc_feature (395)..(429): n is a, c, g, or t
tcagtcgcactagtcacgaccggtgctcgatttagacgcgatcgaagggtttgggtgcccaagctgctggagggcacggtcaccacgctgctgagggagtagcctgaaggcctcggacaccgccatgtattactgtgcgagacatggtgatattagtggttattcctccgtggggccagggaaccctggtcaccgtctcctcacgcctccaccgaacgggcccatccggtccttccccctggccaccccttccctaccaagacgccaccgtcgtgggggcacgacggccggcccgtgggcctgcccgtggtaccaaagggaccttaccttccaacttagtcgaccggacttgggacggccggggtacgtcggacgaaacggtcgaccaagtagcnnnnnnnnnnnnnnnnnnnnnnnnnnnnnnnnnnn

SEQ ID NO: 163189 - DNA, 854 bp, Homo sapiens
  misc_feature: GYAE6OF01E0ATV.39.27.C05.1.454.CMB.1.raw
  modified_base (102)..(102): a, c, t, g, unknown or other
  misc_feature (102)..(102): n is a, c, g, or t
tcagtcgcactagtcacgaccggtgctcgatttagacgcgatcgaagggtttgggggagtcagactcagtcaggacacagcatggacatggacgggtccccntcagctcgtgggctcctgctgctcgtcgcctccgaggtcaactaatgtacactactacgagtactccgacctacgtcccttacctccctaccttggtactacgtctagttcgttaggtacggacgtaaccgtacggtacctacaccgttactaccgtacggtccgggaccgtacgtacgtggtaaagttacgtttaacggtacggtcggttcgggttacgggtttccgtaacgttacggtaaccgtaacggaaccggtaaaaccggtaaaaccggtaaacccggtaaccggtaacccgttaccgtaacgttccggttacgttaagtacgttacgtacggttaccgtacggttcccgggttaaacggtttacgggtttaaacggggttaaccggtaccgggtttaccggtaacctaccggggtttaccggacgggtccggtagtagggtaaccggttacgttacggtacggtaacgtaactaccgtacctttaccgacttaaccacccggtatacgaccgtacgtaccggtcgttaccgacgttacgtacgtagttcttaacgtttacttaacgttaacctacggtttaacctaacgttaccgttaacgtaagttacgtttaagttacgtttaaccgttacgttacgttaccgttacgggtagtaaccgtacggtagtacgtacggtaacgttcgaaagttaccggtactacggttactaccggtcaacgttacctcgttacgttcccgtacg

SEQ ID NO: 163190 - DNA, 494 bp, Homo sapiens
  misc_feature: GYAE6OF02IVAPT.39.27.C05.1.454.CMB.1.raw
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcaccatcacttgcccgggccagtcagagtattagtagctggttggcctggtatcagcagaaaccagggaaagcccctaagctcctgatgtatgatgcctccagtttgaaaagtggggtcccatcaaggttccgcggcagtggatcgtgggacagaattcactctcaccatcagcagcctgcagcctgatgtattttgctaacttattactgccaacagtataatagttattcgtactacttttggcctaggggaccagcgtggagatacaacgactgtggctgcaccatcg

SEQ ID NO: 163191 - DNA, 487 bp, Homo sapiens
  misc_feature: GYAE6OF02JCUII.39.27.C05.1.454.CMB.1.raw
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcaccatcacttgccgggccagtcagagtattagtagctggttggcctggtatcagcagaaaccagggaaagcccctaagctcctgatgtatgatgcctccagtttgaaaagtggggtcccatcaaggttccgcggcagtggatctgggacagaattcactctcaccatcagcagcctgcagcctgatgattttgcaacttattactgccaacagtataatagttattcgtactacttttgcctagggaccaagctggagatcaacgaactgtggctgcaccatc

SEQ ID NO: 163192 - DNA, 342 bp, Homo sapiens
  misc_feature: GYAE6OF02JFC37.39.27.C05.1.454.CMB.1.raw
  modified_base (337)..(342): a, c, t, g, unknown or other
  misc_feature (337)..(342): n is a, c, g, or t
tcagtcgcactagtcacgaccggtgctcgatttagacgcgatcgaagggtttgggtgcccaagctgctggagggcacggtcaccacgctgctgagggagtagcctgaaggcctcggacaccgccatgtattactgtgcgagacatggtgatattagtggttattcctcctggggccagggaaccctggtcaccgtctcctcagcctccaccaagggcccatcggtcttcccctggcaccctcctccaagagcacctctgggggcacagcggccctgggctgcctggtcaaggactacttccactagtgcgactgagcgggctggcaaggcgcatagnnnnnn

SEQ ID NO: 163193 - DNA, 419 bp, Homo sapiens
  misc_feature: GYAE6OF02G04R5.39.27.C05.1.454.CMB.1.raw
  modified_base (270)..(270): a, c, t, g, unknown or other
  misc_feature (270)..(270): n is a, c, g, or t
  modified_base (367)..(368): a, c, t, g, unknown or other
  misc_feature (367)..(368): n is a, c, g, or t
  modified_base (370)..(419): a, c, t, g, unknown or other
  misc_feature (370)..(419): n is a, c, g, or t
tcagtcgcactagtcacgaccggtgctcgatttagacgcgatcgaaggggtttaggggtgcccaagctggctcggagggccacgggtctacccacggcttgcttggagggagtaggccctgaaggcctcggacaccgccactgtattacttggtgcgagacatggttgatattagtggtttaattcctcctggggccagggaaccctggtcaccgtctcctcagcctcgaccaagggcccatcggtcttccccgtgcaccctctccaagngcacctctcggggcacgagccggcccctgggctggcctggtccaaggactacgttccactaggtcgccgactgacgcgggctggcaaggcgcatagnngnnnnnnnnnnnnnnnnnnnnnnnnnnnnnnnnnnnnnnnnnnnnnnnnnn

SEQ ID NO: 163194 - DNA, 490 bp, Homo sapiens
  misc_feature: GYAE6OF02IST5L.39.27.C05.1.454.CMB.1.raw
  modified_base (462)..(462): a, c, t, g, unknown or other
  misc_feature (462)..(462): n is a, c, g, or t
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcaccatcacttgccgggccagtcagagtattagtagctggttggcctggtatcagcagaaaccagggaaagcccctaagctcctgatgtatgatgcctccagtttgaaaagtgggggtcccatcaaggttccgcggcagtggatctgggacagaattcactctcacatcagcagcctgcagcctgatgattttgcaacttattactgccaacagtataatagttattcgttacacttttggccagggacaagcgtgganatacaacgaactgtggctgctaccatcg

SEQ ID NO: 163195 - DNA, 533 bp, Homo sapiens
  misc_feature: GYAE6OF02I8FRN.39.27.C05.1.454.CMB.1.raw
  modified_base (367)..(367): a, c, t, g, unknown or other
  misc_feature (367)..(367): n is a, c, g, or t
tcagtcgcactagtcacgaccggtgctcgatttagacgcgatcgaagggtttgggggagtcagacgtcagtcaggacacagcatggacatgagggtccccgctcagctcctgggctcctgctgctctggctcccaggtgccaaatgtgactatccagatgacccagtctccttcaccctgtctgcattctgttgggagacagagtcaccatcacttgccgggccagtcagagtattagtagctggttggcctggtatcagcagaaccagggaaagcccctaaggctcctgatgtatgatgcctcagtttgaaagtggggtccatcaaggttccgcggcagtggatcgtgggacagatcactctcacntcagcagcctgcagcctgatgtatttgctaacttattactcgaccaactacgtaattaattagtttattacgttaactacttttcggaccgtacggggtacctaagtcgtagggaacgagtacgaaacgtaacgttaggtacggtcctaggacctaccgtattccg

SEQ ID NO: 163196 - DNA, 509 bp, Homo sapiens
  misc_feature: GYAE6OF02H62WA.39.27.C05.1.454.CMB.1.raw
  modified_base (272)..(272): a, c, t, g, unknown or other
  misc_feature (272)..(272): n is a, c, g, or t
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcaccatcacttgccgggccagtcagagtatagtagctggttggcctggtatcagcagaaaccagggaancccctaagctcctgatgtatgatgcctccagttgaaagtggggtcccatcaaggttccgcggcagtggatctgggacagaattcactctcaccatcagcagcctgcagcctgatgattttgctaacttattactgccaacagttaataatagttacttcgttaactacttttggacctaggggacctaaggctggagactacgaaacgtacgtgtggctacggactaccgtattccg

SEQ ID NO: 163197 - DNA, 341 bp, Homo sapiens
  misc_feature: GYAE6OF02FZL0U.39.27.C05.1.454.CMB.1.raw
  modified_base (338)..(341): a, c, t, g, unknown or other
  misc_feature (338)..(341): n is a, c, g, or t
tcagtcgcactagtcacgaccggtgctcgatttagacgcgatcgaagggtttgggtgcccaagctgctggagggcacggtcaccacgctgctgagggagtagcctgaaggcctcggacaccgccatgtattactgtgcgagacatggtgatattagtggttattcctcctggggccagggaaccctggtcaccgtctcctcagcctccaccaagggcccatcggtcttccccctggcaccctcctccaagagcacctctgggggcacagcggccctgggctgcctggtcaaggactacttccactagtgcgactgagcgggctggcaaggcgcatagnnnn

SEQ ID NO: 163198 - DNA, 509 bp, Homo sapiens
  misc_feature: GYAE6OF02H30US.39.27.C05.1.454.CMB.1.raw
  modified_base (335)..(335): a, c, t, g, unknown or other
  misc_feature (335)..(335): n is a, c, g, or t
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcaccatcacttgcgggccagtcagagtattagtagctggttggcctggtatcagcagaaaccagggaaagcccctaaagctcctgatgtatgatgcctccagtttgaaaagtggggtccatcaaggttccgnggcagtggatcgtgggacagaattcactctcaccatcagcagcctgcagcctgatgattttgactaactttattactagccaactagtataatagttaattacgttactactttggcctaggggaccaagcgtggagtatacaaacgtaacgtgtacggctagctaccattccg

SEQ ID NO: 163199 - DNA, 567 bp, Homo sapiens
  misc_feature: GYAE6OF02H0MIH.39.27.C05.1.454.CMB.1.raw
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcaccatcacttgccgggccagtcagagtattagtagctggttggcctggtatcagcagaaaccagggaaagccctaagctcctgatgtatgatgctcagtttgaaagtgggtccatcaaggtccgcggcagtggatctgggacagaattcactctcaccatcagcagcctgcagcctgatgtattttagactaaacgtttacttactacgacctaaacgtaagtaataaattaagtttaagtttaccgttaactaacgtttttacgggaccgtaacggggtacccaaaggtacgttaaggaacgtaataaccgaaaacggtaacgttacggtagggtaccttacggacctaacccgtattaccg

SEQ ID NO: 163200 - DNA, 572 bp, Homo sapiens
  misc_feature: GYAE6OF02JFR5A.39.27.C05.1.454.CMB.1.raw
  modified_base (422)..(422): a, c, t, g, unknown or other
  misc_feature (422)..(422): n is a, c, g, or t
tcagtcgcactagtcacgaccggtgctcgatttagacgcgatcgaagggtttggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcaccatcacttgccgggccagtcagagtattagtagctggttggcctggtatcagcagaaaccagggaaagcccctaagctcctgatgtatgatgcctccagtttagaaaaggtcggggtaccagtcaaggttccgcggacagtggatcgtgggacaagaattcgactctcaccatcagcagcctgcagcctgactgtattttcgacttaacttattacngacctaacgtagttaactaagttaagtttacttaccgttaacttacgttttacgggaccctaagggggtacctaaaggtccgtaacggaagtaacttaaccgaaaacgtacgttacggtacgtaccgtaggtacctaaccgtattaccgg

SEQ ID NO: 163201 - DNA, 497 bp, Homo sapiens
  misc_feature: GYAE6OF02F689Z.39.27.C05.1.454.CMB.1.raw
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcaccatcacttgccgggccagtcagagtattagtagctggttggcctggtatcagcagaaaccagggaaagcccctaagctcctgatgtatgatgcctccagtttgaaaagtggggtcccatcaaggttccgcggcagtggatctgggacagaattcactctcaccatcagcagcctgcagcctgatgattttgctaacttattactgccaacagtataattagttattcgtactacttttggacctagggaccaagtctggagatacaaacgaactgtggctgacaccatacg

SEQ ID NO: 163202 - DNA, 570 bp, Homo sapiens
  misc_feature: GYAE6OF02FWZ5A.39.27.C05.1.454.CMB.1.raw
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcaccatcacttgccgggccagtcagagtattagtagctggttggcctggtatcagcagaaaccagggaaacgcccctaagctcctgatgtatgatgcctccagtttgaaaagtggggtcccatcaaggttccgcggcagtggatcgtgggacagaattcactctcaccatcagcagcctgcagcctgatgtattttgactaacttattactcgactaacacgtaataaattaagtttactttacgttaacttacgtttttacggaccgtaacggggtaccctaaggtaccgttagggaacgtaacgtaaccgtaaaaccgtaacgttacggttacggtaccgttacggacctaaccgtatttacccg

SEQ ID NO: 163203 - DNA, 559 bp, Homo sapiens
  misc_feature: GYAE6OF02IOXEK.39.27.C05.1.454.CMB.1.raw
  modified_base (378)..(378): a, c, t, g, unknown or other
  misc_feature (378)..(378): n is a, c, g, or t
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcaccatcacttgccgggccagtcagagtattagtagctggttggcctggtatcagcagaaaccagggaaagcccctaagctcctgatgtatgatgcctccagtttagaaaagtggggtaccatcaacggttccgcggcgagtggatcgtgggacagtaattcactctcacatcancagctgcagcctgatgtattttgactaactttattactcgaccaaactaagttaataaattaagtttaatttaccgttacttacgttttcgggaccgtaacggggaccctaaggtcgtaggaagtaacgtaaccgtaaaacgtaacgttggtacggtacttacggacctaccgtattaccg

SEQ ID NO: 163204 - DNA, 555 bp, Homo sapiens
  misc_feature: GYAE6OF02JY92G.39.27.C05.1.454.CMB.1.raw
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcaccatcacttgccgggccagtcagagtattagtagctggttggcctggtatcagcagaaaccagggaacgcccctaagcctcctgactgtatgatgcctcagtttagaaagtggggtaccatcgaaggttccgcgcagtggatcgtggacagtatcactctcaccatcagctagcctgcagcctgatgtattttacgactaacttatacctacgtaccaactagtaattaattaggtttacttacgttaactacgttttcggaccgtacggggtactaaggtcgtaggtaacgtaactaaccggtaaacgtacgttacggttacggacttacggacctaccgtaacttccg

SEQ ID NO: 163205 - DNA, 533 bp, Homo sapiens
  misc_feature: GYAE6OF02H0ML2.39.27.C05.1.454.CMB.1.raw
  modified_base (417)..(417): a, c, t, g, unknown or other
  misc_feature (417)..(417): n is a, c, g, or t
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcaccatcacttgccgggccagtcagagtattagtagctggttggcctggtatcagcagaaaccagggaaagcccctaagctcctgatgtatgatgcctcagtttgaaagtggggtccatcaaggttccgcggcagtggatcgtgggacagaatcgactctcaccatcagcagcctgcagcctgatgtattttgactaacttattactgaccaanagtataagttagttaattacgttactacgttttcggaccgtaaggggtaccaaggtcgtagggaacgtagtaccaaaacggtaacgtaggtacggtactaggacctaccattaccg

SEQ ID NO: 163206 - DNA, 557 bp, Homo sapiens
  misc_feature: GYAE6OF02IRA9T.39.27.C05.1.454.CMB.1.raw
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcaccatcacttgccgggccagtcagagtattagtagctggttggcctggtatcagcagaaaccagggaaagcccctaagctcctgatgtatgatgctccagtttgaaaagtggggtcccatcaaggttccgcggcagtggatctgggacagaattcactctcaccatcagcagcctgcacgcctgatgtatttttgactaactttattactcgacctaacattaataattacgttaattacgttaacttacgttttacggaccgtaggggtaaccaaggtaccgtaagggtaacgtaacgtaccgtaaaacgtaacgttacggtacggtccgttacggacctaccgtattaccg

SEQ ID NO: 163207 - DNA, 486 bp, Homo sapiens
  misc_feature: GYAE6OF02IBFSR.39.27.C05.1.454.CMB.1.raw
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcaccatcacttgccgggccagtcagagtattagtagctggttggcctggtatcagcagaaaccaggaaagcccctaagctcctgatgtatgatgctccagtttgaaaagtggggtcccatcaaggttccgcggcagtggatctgggacagaattcactctcacatcagcagcctgcagcctgatgattttgctaacttattactgcaacagttataatagttaattcgtacactttgcctagggaccaagctggagatcaaacgactgtggctggcaccatcg

SEQ ID NO: 163208 - DNA, 824 bp, Homo sapiens
  misc_feature: GYAE6OF02HMGUJ.39.27.C05.1.454.CMB.1.raw
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaaatgtgacatccagatgacccagtctccttccaccctgtctgcatctgttggagacagagtcaccatcacttgccgggccagtcagagtattagtagctggttggcctggtatcagcagaaaccaggaaacgcccctaaagcctacctgagtacgtagtgatcgacctccgtaaggttttacgaaaaagggttcggggtacccgaagttaccgtaaaacgggtttcccggacgggtacgtaacgggttacggtaacgttcggtacggggaacgtaaagggtaaacgttttaccgaaacccgtttaccgtttacccgaaacccgtaaacttccccgtaaagggaacccgtaacgggtccccttagggacccttaaacgggtccccgttaagggtaacgtttaccggttaaagtttttttaccgggaaaccgtttaaaaacccgtttttaattttaaaccgtaaccggttaacccttaaaaaccgttaaagggtttaaactttaaaacgtttaacggttttaaacgttttaccggtttaaacctttaaacggttttttacgggaacccgtaacgggggtaacccctaaagggtccgttaagggaaccgtaagttaaccgtaaaaccggtaacgttacgggttaacggtccgttaacggtaccctaacccgtacgtttacccgg

SEQ ID NO: 163209 - DNA, 519 bp, Homo sapiens
  misc_feature: GYAE6OF02JCQFX.39.27.C05.1.454.CMB.1.raw
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcaccatcacttgccgggccagtcagagtattagagctggttggcctggtatcagcagaaaccagggaaagcccctaagctcctgatgtatgatgcctccagtttgaaagtggggtcccatcaaggttccgcggcagtggatcgtgggacagaattcactctcaccatcagcagcctgcacgcctgatgtattttcgactaacttattactgacctaacagttataatagttacttcgttaactacttttggaccgtagggaccaaggtcgtaggagtactacgaaacgaacgtgtacggtcgtagctaccagttcg

SEQ ID NO: 163210 - DNA, 543 bp, Homo sapiens
  misc_feature: GYAE6OF02G6VKV.39.27.C05.1.454.CMB.1.raw
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcaccatcacttgccgggccagtcagagtattagtagctggttggcctggtatcagcagaaaccagggaaacgcccctaagctcctgatgtatgatgcctccagtttagaaagtggggtccatcaaggttccgcggcagtggatcgtgggacagaattcactctacaccatcagcacgcctgcacgcctagatgtattttcgactaacttattacctgaccctaataagttattaaattacgtttattacgttactacgttttcggaccgtaggggacccaaggtcgtagggagtaacgtaccgaaaacgtacgtaggtacggtctcggacaccgtattcg

SEQ ID NO: 163211 - DNA, 675 bp, Homo sapiens
  misc_feature: GYAE6OF02JX842.39.27.C05.1.454.CMB.1.raw
  modified_base (239)..(239): a, c, t, g, unknown or other
  misc_feature (239)..(239): n is a, c, g, or t
  modified_base (389)..(389): a, c, t, g, unknown or other
  misc_feature (389)..(389): n is a, c, g, or t
  modified_base (391)..(391): a, c, t, g, unknown or other
  misc_feature (391)..(391): n is a, c, g, or t
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatcgtgttggagacagagtcaccatcacttggccgggccagtcagagtattagngctggttggcctggtatcgagcagaaaccgagggaaacgcccctaagctcctgatgtatgtatgcctcgtagtttagaaaggtcggggtacccattcgaacggttccgcggacaggtgactcgtcgggacagaattccgactctcgaacntnacgcacgtctcggacacggtccctaggaacttcgttaacgttttcgaccgtaaaccttttagttaaccgtacggtaccctaaacgttaacggttaaactttaaacgtttacgttttaaacgtttacgtttaaacccgtttacgttttaccgggtaaccggaacggggttaaccctaagggtccggttaagggtaaaccttacgtaaacccggttaaaacgtacccggttacgggttaacgggtaccgtttaccggtcccgtaaacccgttaggttttaaccccg

SEQ ID NO: 163212 - DNA, 576 bp, Homo sapiens
  misc_feature: GYAE6OF02JDDPC.39.27.C05.1.454.CMB.1.raw
  modified_base (196)..(196): a, c, t, g, unknown or other
  misc_feature (196)..(196): n is a, c, g, or t
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatctgttgganacagagtcaccatcacttgccgggccagtcagagtattagagctggttggcctggtatcagcagaaaccagggaaacgccctaagctcctgatgtatgatgcctcagtttagaaagtgggtcccatccaaggttccgcggcagtggatcgtaggacagtattcactctcacatacagcagcctgcacgcctgattgtatttgacctaacttacttactacgacctaaacgtaagttaataagttagtttaacgtttaccgttaacgttacgttttcggacccgtaaggggtacctaaggtaccggtaggtaacgtaactaaccgtaaaaccgttaacgttcggtacggtaccgttaccggacctaacccgtattacccgg

SEQ ID NO: 163213 - DNA, 552 bp, Homo sapiens
  misc_feature: GYAE6OF02I425C.39.27.C05.1.454.CMB.1.raw
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcaccatcacttgccgggccagtcagagtattagtagctggttggcctggtatcagcagaaaccagggaaacgcccctaagctcctgatgtatgatgcctcagtttgaaagtggggtccatcaaggttccgcggcagtgatctgggacagaattcactctcacatcagcagcctgcagcctgatgtattttcgactaacttacttactcgacctaaactagttactaaattagtttacttaccgttaactacgtttttacggaccgtaaggggtaccctaaggtcgttagggaagtaacgttacgaaaacggtaacttaggtacggtaccgtagacctaccctattaccg

SEQ ID NO: 163214 - DNA, 635 bp, Homo sapiens
  misc_feature: GYAE6OF02JBG0O.39.27.C05.1.454.CMB.1.raw
  modified_base (196)..(196): a, c, t, g, unknown or other
  misc_feature (196)..(196): n is a, c, g, or t
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacacagtctccttccaccctgtctgcatctgttgganacagagtcaccatccacttggccgggccagtcagagtattagtagcgtggttggccttggtatcgagacaagaaaccgtagggaaacgcccctaagcctcctagactgtatgatcgtacctactagtttaggaaaaggtcgggtacctaatcgaacggttccgacggacgtaggtacggactcggtagggactaagtaacgtccaacttccgtactaaccgtatacgagtcacgtcctagacgacgtccgtagtagtgttactttacgaacttaactttacgaccttcgaaccgtaagtaacgttaattaaacgttacggtttaacttaccgttaacttacggtttacgacggtacgggttaaccaacggttcgtaacggtactaaaccgttacgtaaaaccgtacgttacggtccggttataccggtacctacgtacg

SEQ ID NO: 163215 - DNA, 601 bp, Homo sapiens
  misc_feature: GYAE6OF02H0N04.39.27.C05.1.454.CMB.1.raw
  modified_base (408)..(408): a, c, t, g, unknown or other
  misc_feature (408)..(408): n is a, c, g, or t
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcaccatcacttggccgggccagtcagagtattagtagctggttggcctggtatcagcgaagaaaccgagggaacgaccccgtaagcctcctgagtgtatgatcgcctacgtaagtttaggaaaacggttcggggtacccagtacgtaacgggttcccggcggtcgaggtggagtcgtgggaactagtaactcactcctacaaccntacacgctacgcctgcacgtcctgattgtatttcgacttaacttattacgtacgaccaattaacgtaataagttaagtttacgtttacttaacgttacgttttaccggacgtacgggtaccctaaggtacgtacgggtaagtaacgtaacgaaacgtaacgttacggtggtcctaggacctaccgtagttccg

SEQ ID NO: 163216 - DNA, 377 bp, Homo sapiens
  misc_feature: GYAE6OF02G155X.39.27.C05.1.454.CMB.1.raw
  modified_base (267)..(267): a, c, t, g, unknown or other
  misc_feature (267)..(267): n is a, c, g, or t
  modified_base (322)..(322): a, c, t, g, unknown or other
  misc_feature (322)..(322): n is a, c, g, or t
  modified_base (351)..(351): a, c, t, g, unknown or other
  misc_feature (351)..(351): n is a, c, g, or t
  modified_base (356)..(356): a, c, t, g, unknown or other
  misc_feature (356)..(356): n is a, c, g, or t
  modified_base (358)..(377): a, c, t, g, unknown or other
  misc_feature (358)..(377): n is a, c, g, or t
tcagtcgcactagtcacgaccggtgctcgatttagacgcgatcgaagggtttgggtgcccaagctgctggagggcacggtcaccacgctgctgagggagtagcctgaaggcctcggacaccgccatgtattactgtgcgagacatggtgatattagtggttattcctccgtgggccagggaaccctggtcaccgtctcctcagcctccaccaagggccctatcggtccttccccctggcaccccctcctaccgaagagccacctcgngggggccacacgcggcccgtgggcctgacctgggataggactacttccactagtncgactgagcggctggcaacgggcacgtanaacgngnnnnnnnnnnnnnnnnnnnn

SEQ ID NO: 163217 - DNA, 570 bp, Homo sapiens
  misc_feature: GYAE6OF02FX8YO.39.27.C05.1.454.CMB.1.raw
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcaccatcacttgccgggccagtcagagtattagtagctggttggcctggtatcagcagaaaccagggaaagcccctaagctcctgatgtatgatgcctccagtttgaaaagtgggggtcccatcaaggttccgcggcagtggatcgtgggacagaattcactctcaccatcagcagcctgccagcctgatgtattttgactaactttattactcgacctaacgagttataaattaggtttaatttaccgttaacttacgtttttaggacccgtaaggggtacccaaggtccgtagggtaacgtaacgttaaccaaaacggtaacgttcggttacgggtaccgtacggaccgtacccgtatttacccg

SEQ ID NO: 163218 - DNA, 633 bp, Homo sapiens
  misc_feature: GYAE6OF02FWIOE.39.27.C05.1.454.CMB.1.raw
tcagtcgcactagtcacgaccggtgctcgatttagacgcgatcgaagggtttgggggaggtcagactcagtcacggacacagcatggacatgagggtccccgctcagctcctggggctcctgctgctctggctcccaggtgccgaaatgtgacatccagatgacccagtctccttccaccctgtctgcatctgttggagacagagtcaccatcacttggccgggccagtcagagtattagagctggttcggctggtatcagcaagaaaccgagggaacgcccctaagctcctgatgtatgatcgcctcctaggttttagaaaacggttcggggtacccaagtccgtaacgggttcccgcggccgtaggtagggtattcgtagggaactaagtaacttccacgttcctaccaacctataccagcctaacgtccctggaccgtacgtaccctaggattacgttagttttacgacttaaacgttaactttaccgtacgtaccctaaactagttaattaaatttagtttaactttaccgttaaacttacggttttacgggaccgtaacggggacctaaggtcgtacggaagtactaacgaaacgtagtacggttaggtacgtcgactaccgagttcg

SEQ ID NO: 163219 - DNA, 541 bp, Homo sapiens
  misc_feature: GYAE6OF02GMCCV.39.27.C05.1.454.CMB.1.raw
  modified_base (381)..(381): a, c, t, g, unknown or other
  misc_feature (381)..(381): n is a, c, g, or t
  modified_base (427)..(427): a, c, t, g, unknown or other
  misc_feature (427)..(427): n is a, c, g, or t
  modified_base (537)..(537): a, c, t, g, unknown or other
  misc_feature (537)..(537): n is a, c, g, or t
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagtatgacccagtctccttccaccctgtctgcatctgttggagacagagtcaccatcacttgccgggccagtcagagtatagtagctggttggcctggtatcagcagaaaccagggaaacgcccctaagcctcctgatgtatgatgccctctagtttaggaaaaggttcggggtacccagtccgaaggttcccgacggcaggtggatcgtgggacagtattcactcncacatcagcagcctgcacgcctagattgtattttcgacttaacttnttactcgaccaacgtattaataattagtttacttacgttaactcgtttagccgtagggtaccaaggcgtaggaatacgtaacgaaacgtagtgtacggctagcctacgtntccg

SEQ ID NO: 163220 - DNA, 728 bp, Homo sapiens
  misc_feature: GYAE6OF02H01U2.39.27.C05.1.454.CMB.1.raw
  modified_base (196)..(196): a, c, t, g, unknown or other
  misc_feature (196)..(196): n is a, c, g, or t
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatctgttgganacagagtcacatcacttgccgggccagtcagagttattagtagcttggttggcctggtatcagcaagaaaccgagggaaacgcccctaagctccgtggtagtatgatcgcctacgtagtttaggaaaggttcggggtaccctagtacgtaacgggttcccgcggtacgtaggtggtacgttacgtaggggaactaacggtaactttacccgtaaccttccgtacctaacctataccgagaccaacggtccctacgcctacggtccttaggacgtttgttaacgttttacggtaaccttaacttttaacttaaccgtacgtaaccctaaaagtaacgttaaacgtttaaagtttaacgttttaactttaacccggtttaactttaccggtttttaccggggaacccggttaaacgggggtaacccttaagggtccggttaagggaaacgtaaccgttaaaccggtaaaaccggttaacggttcgggttacgggtaccgttaacggacccgtaacgtacgttcccgttaaccgg

SEQ ID NO: 163221 - DNA, 600 bp, Homo sapiens
  misc_feature: GYAE6OF02I6HPC.39.27.C05.1.454.CMB.1.raw
  modified_base (196)..(196): a, c, t, g, unknown or other
  misc_feature (196)..(196): n is a, c, g, or t
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatctgttgganacagatcaccatcacttgccgggccagtcagagtattagagcgtggtggcctggtatcagcaagaaaccgagggaaacgcccctaagctccgtgatgtatgatcgcctctagtttaggaaacggttcgggtacctagtaccgaaggttccgcggataggtgacgtcgtagggactaagtaacttctactcctacgacctatcgacgcgacgtcctgaccacgtcctagtattagttacttttagaaccttaaacgttacttacgtcgaacctaaagtaacgttaataagtttacgttacgttacgttaacttacgtttacgggaccgtaacggggtacctaggtacgtaaggagtaaccgtaacgtaaaccgtacgtcggtacgtcgtacaccgtactacttcg

SEQ ID NO: 163222 - DNA, 493 bp, Homo sapiens
  misc_feature: GYAE6OF02FHK6B.39.27.C05.1.454.CMB.1.raw
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcaccatcacttgccgggcagtcagagtattagtagctggttggcctggtatcagcagaaaccagggaagcccctaagctcctgatgtatgatgcctccagtttgaaaagtggggtccatcaaggttccgcggcagtggatctgggacagaattcactctcaccatcagcagcctgcagcctgatgtattttgactaacttattactgaccaacagtataatagttattacgtactacttttgccgaggggaccaaggctaggagatacaaacgaatgtggctgcacatcg

SEQ ID NO: 163223 - DNA, 721 bp, Homo sapiens
  misc_feature: GYAE6OF02JSIAT.39.27.C05.1.454.CMB.1.raw
  modified_base (272)..(272): a, c, t, g, unknown or other
  misc_feature (272)..(272): n is a, c, g, or t
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcacatcacttgccggcagtcagagtatagtagcgtggttgcctggtatcagcaagaaaccgagggaacnccctaagctccgtgatgtatgatcgcctctagtttagaaaaggttcggggtacccagttccgaaacggttccggacggtactaggtcggtaagtcggtagggaactaaggtaaactttccgaaccgttcctaccgtaaccctaagttaccgaacgtcgtaacggtccccttaggacctacggtacccttaggtaaacttggttaactttttacgggacctttaaaccgttttaaacgttacccgtacgaaaccgttaaacgtaacggttaaatttaaaacgtttagttttaacgtttaccgtttaaaccgttacccggttttagggaacccggtaacgggggtacccttaacgggtacggttaaggggaaacttaacggttaaacccggtaaaacggttaacggttacggtacgggaccttacggaaccccgtaaccgtaacgtttccg

SEQ ID NO: 163224 - DNA, 551 bp, Homo sapiens
  misc_feature: GYAE6OF02GYL55.39.27.C05.1.454.CMB.1.raw
  modified_base (355)..(355): a, c, t, g, unknown or other
  misc_feature (355)..(355): n is a, c, g, or t
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcaccatcacttgccgggccagtcagagtattagtagctggttggcctggtatcagcagaaaccagggaaacgcccctaagctctgactgtatgatcgcctcctagtttagaaaaggtggggtacccatcgtaaggttcgcggcagtgatcgnggacagtactcactctcacatcagcacgtcctgacagcctagtatgtattttcgacttaacttacttactcgactaaacgtagtaataaattagtttattacgttaactacgttttcggaccgtaacgggacctaagtcggtaggaacacgtaacgaaacgtacgttggtacggtacgtcgacctaccgtgtaccg

SEQ ID NO: 163225 - DNA, 539 bp, Homo sapiens
  misc_feature: GYAE6OF02FZDRZ.39.27.C05.1.454.CMB.1.raw
  modified_base (354)..(354): a, c, t, g, unknown or other
  misc_feature (354)..(354): n is a, c, g, or t
  modified_base (369)..(369): a, c, t, g, unknown or other
  misc_feature (369)..(369): n is a, c, g, or t
  modified_base (375)..(375): a, c, t, g, unknown or other
  misc_feature (375)..(375): n is a, c, g, or t
  modified_base (377)..(377): a, c, t, g, unknown or other
  misc_feature (377)..(377): n is a, c, g, or t
  modified_base (391)..(392): a, c, t, g, unknown or other
  misc_feature (391)..(392): n is a, c, g, or t
  modified_base (409)..(409): a, c, t, g, unknown or other
  misc_feature (409)..(409): n is a, c, g, or t
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcaccatcacttgccgggccagtcagagtattagtagctggtggcctggtatcagcagaaaccagggaaacgcccctaagcctccgtgatgtatgatgcctccagtttagaaaacgtcggggtccagtcaaggttccgcggcaggtgatcgnggacagattcactcncacatnancagcctgcagcctnntgtatttgactaacttnttactcgacaataagtataagttagtttacttcttaactacttttaggccgtaacgggaccaaggtcgtgggtaagtaactaaccgaaacgtaacgtcggttacgggtacctacggtaccactacttccg

SEQ ID NO: 163226 - DNA, 639 bp, Homo sapiens
  misc_feature: GYAE6OF02GRUZB.39.27.C05.1.454.CMB.1.raw
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcaccatcacttgccgggccagtcagagtattagtagctggttggcctggtatcagcagaaaccgagggaaacgcccctaagcctcctgatcgtatgatcgcctccaggtttagaaaggtcggggtacccagtcgaaggttccgcggctaggtggactcggtagggactaagtaacttcacgtcctaccaacctataccgacgactacgcccgtagccgacgtccgtagacttggttaattttcgacttaacgtttataccgtgaacctaacgtaattaacgttaattacggtttaactttaccgttaacgtttaccggttttacggaccccgtaaggggtaacccgtaacggtacggtaagggtaaccgtaacgtaaaccgtaaaacgttaacgtcggttaacgggtaccttacggacctaaccgtagtttacccg

SEQ ID NO: 163227 - DNA, 755 bp, Homo sapiens
  misc_feature: GYAE6OF02H0VLX.39.27.C05.1.454.CMB.1.raw
  modified_base (194)..(194): a, c, t, g, unknown or other
  misc_feature (194)..(194): n is a, c, g, or t
  modified_base (197)..(197): a, c, t, g, unknown or other
  misc_feature (197)..(197): n is a, c, g, or t
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatcgaccagtctccttccacctgtctgcatctgtgganacngagtcacatcacgttcgccggccagtcaggtagttattagtagtcgttggttcggcctggtatcgagcaaggtaaaccgagggaaacgccccgtaagccttaccgtaggtattagtatcgatccgacctacgtaggttaggtaaacggtcgggtacccaagttccgaacggttccggcggtacgaggtcggtacgtacggtaggggaactaagtaacgtttacccgaccttacgtacctaacccgtaactaccgaacggacctacggtcccgtgtacccgtacgtacccgttagttaacgttaggtttaacgttttaccggtaacctttaaaccttttagtaacctaccggttaacctaaaccgttaaacgttttaagttaaacggttttaacgttttaaccttttaacccggttaccgtttaacgggtttaccggaacccggggtaacggggttaaccgtaacgggttccggtaaaagggaccgttaaacggtaaaccgaaacgttaccgggttacgtcgggtaccgttcccgaaaccgttccgtacttttacccgg

SEQ ID NO: 163228 - DNA, 631 bp, Homo sapiens
  misc_feature: GYAE6OF02FST9J.39.27.C05.1.454.CMB.1.raw
  modified_base (624)..(624): a, c, t, g, unknown or other
  misc_feature (624)..(624): n is a, c, g, or t
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtcctccttccaccctgtctgcatctgttggagacagagtcaccatcacttcgccgggccagtcagagtatagtagtcgtggttggcctgggtatcagcaagaaaccgagggaaacgcccctaagctcctgatgtatgatcgccctacctaaggtttagaaaaggttcggggtaccctagtacgaacggttccgacggtcgagtggatcgtaggacagtaattcactctctacatcagcacgtccctgcctacgtctagtacgttagttatttacgtaccttaactttactaccgtacgtaacctaaacgtaacgttaattaaacgtttacgtttaacgtttaacccgttaacgtttaccggttttaccgggaaccggtaacggggtacctaaggtacggtagggaacgtaacgtacgtaaaaccggtagttacggtacggtccttaacggcctaccgtnttacccg

SEQ ID NO: 163229 - DNA, 667 bp, Homo sapiens
  misc_feature: GYAE6OF02JTNI1.39.27.C05.1.454.CMB.1.raw
tcagtcgcactagtcacgaccggtgctcgatttagacgcgatcgaagggtttgggggagtcagactcagtcaggacacagcatggacatgacgggtccccgctcagctcctggggctcctgctgctctggctcccaggtgccaaatgtgacatccagatgacccagtcctccttccaccctgtctgcatctgtggagacagagtcaccatcgtacttcgccggccagtcagtagtattagtagcgtggtcgcctggtactcagacaagaaaccgagggaaacgcccctaaggcctccgtgtacgtagtagtgagtcgacctcgtaggtttagaaacggtcggggtacctagtacgaacggttccggacggacgtaggtaggtatacggtaggaactaaggtaacttaccgacgttacctacacctaactaccgacgtaccacgtccctagccgtacgtctacgtagtgttactttcgaacttaaccttacttacgtacgaacctaataacgttaaagttaacgtttacgtttacgtttaccgttaacctttacggttaaccggaccggtaaaccgggtactaacggtaccggtaaggtaaccgtaacgtaaccgtaaacggtacgttacggtaccggtaccttaacggtaccctacgtagtttaccg

SEQ ID NO: 163230 - DNA, 651 bp, Homo sapiens
  misc_feature: GYAE6OF02HQTY8.39.27.C05.1.454.CMB.1.raw
  modified_base (202)..(202): a, c, t, g, unknown or other
  misc_feature (202)..(202): n is a, c, g, or t
tcagtcgcactagtcacgaccggtgctcgatttagacgcgatcgaagggtttgggggagtcagactcagtcaggacacagcatggacatgagggtccccgctcagctcctggggcctcctgctgctctggctcccaggtgaccaaatgtgacatccagatgacccagtctcccttccaccctgtctgcatctgtgagacagntcacatcactgccggccagtcagagtattagagctggttggcctggtatcagacaagaaaccgagggaaacgaccccaagtcctccgtagatgtatgtactcgccctaccgtaggtttagaaaacggtcggggtacccaagtcgtaacggttccgcggacgtaggtggtaacgtcggtagggaactagtaattccactctaccacctagtaccgagacgacgcctagacgacgtctagtagttacgttagttttacgacttaacgtttattaaccgtcgtaaccgtaaattagttaaacgttaattaacgttaactttacgttaaccttacgttttaccgggaccggtaacggggtacctaacggtacgtacgggtaaagtaaccgtaacgaaaaccggtacgttacgggtacggtaccgttaccggtacctacccgttacgttacccg

SEQ ID NO: 163231 - DNA, 586 bp, Homo sapiens
  misc_feature: GYAE6OF02H2AOB.39.27.C05.1.454.CMB.1.raw
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcaccatcacttcgccgggccagtcagagtattagtagcttggttggcctggtatcagcaagaaaccagggaaacgccccgtaagccttcctgatgtatgatgcctcgtagtttagaaaggtcgggtacccatcgaacggttccgcgggacgtaggtgacgtcgtagggactaagaacttccgactcgtccaaccgtataccagccgacgtcgcgctacgcctgattgttactttgacttaacttattacgctaacctaataacgttaataagtttaagttactttacgtacctttaagtttcggacccgtaggggaacccaaggtcggtaggaactaactaacgaaacgtacgttaggtcggacttcgacctaccatttcccg

SEQ ID NO: 163232 - DNA, 629 bp, Homo sapiens
  misc_feature: GYAE6OF02IX6GB.39.27.C05.1.454.CMB.1.raw
  modified_base (197)..(197): a, c, t, g, unknown or other
  misc_feature (197)..(197): n is a, c, g, or t
  modified_base (623)..(623): a, c, t, g, unknown or other
  misc_feature (623)..(623): n is a, c, g, or t
tcagtcgcactagtcacgaccggtgctcgatttagacgcgatcgaagggtttgggggagtcagactcagtcaggacacagcatggacatgagggtccccgctcagctcctggggcctcctgctgctctggctcccaggtgccaaatgtgacatccagatgacccagtctccttccaccctgtctgcatctgttgganacagactcaccatccacttgaccgggccagtcagacgtatagtagctggttggctggtatcagcaagaaaccgagggaacgccctaagcctacctgtactgtatgtatcgcctacgtagtttagaaaacggtggggtaccctaagtcgtaacggttccgacggtacgagtaggagttcgtagggacaagtacttcgacttccacactactacagctacgtctacgacgtacgacctagacttaggtattttacgacttaacttcttacctagtacccaaagtaagttataaagttagtttacgtttaccgttaacgttaccgttttagggacccgtaagggtacccgtaaggtaccggtacggtaacggtaacgtaaccctaaaccggtacgttacggtacggtcgtaccgggtaccctaccggtnttaccg

SEQ ID NO: 163233 - DNA, 645 bp, Homo sapiens
  misc_feature: GYAE6OF02I4JYM.39.27.C05.1.454.CMB.1.raw
  modified_base (280)..(280): a, c, t, g, unknown or other
  misc_feature (280)..(280): n is a, c, g, or t
  modified_base (455)..(455): a, c, t, g, unknown or other
  misc_feature (455)..(455): n is a, c, g, or t
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcaccatcacttcgccgggccagtcagagtattagtagctggttacgccgtggtactcagcaagaaaccgagggaacncccgtaagcctaccgtggtagtactgaagtcgtcctacctaggtttaagaagttcggggtacctagtaccgtacggttaccggcggacgtagtcgtagtcgtaggacgaagtataccactctaccactactccgagacgaccgtcgtcgacaccgtcgagtcgtagttcgtttanacttaaccgttacttaacgtccgtaacctaacgttaacgttaaattaacgtttaatttaacgtttaaccttacgttttaacccgtttacgggtaccgtaaggggtaacccctagggtacgttaggaacgttacgtaaccgtaaaggtacgtaacggtggaccgtacgaccctaacgtacttacgttaccg

SEQ ID NO: 163234 - DNA, 736 bp, Homo sapiens
  misc_feature: GYAE6OF02F4LIB.39.27.C05.1.454.CMB.1.raw
  modified_base (198)..(198): a, c, t, g, unknown or other
  misc_feature (198)..(198): n is a, c, g, or t
  modified_base (285)..(285): a, c, t, g, unknown or other
  misc_feature (285)..(285): n is a, c, g, or t
tcagtcgcactagtcacgaccggtgctcgatttagacgcgatcgaagggtttgggggagtcagactcagtcaggacacagcatggacatgagggtccccgctcagctcctggggctcctgctgctctggcctcccaggtgccaaatgtgacatccagatgacccagtcctccttccaccctgtctgcatctgttgganacagagtccacatcacgttcggccggccagtcagagtattagtgctggttggccgtaggtatcgagacaagaaaccgagggaaaccncccgtaagtcctaccgtgtagtgtatgacttcggtacctcgtagttaggaaaggtcggggtaccacgtcgtaaacggttccgacggtacgtagtaggtacgtcggtacgggaactaagtaacttaccacttaccctacgtaacctacgtacgaaccggctaaccggtccttaacggcctaaccgtccgtttaggtactttagggttaacctttttcgaaccgtttaacctttaacgtttacgacccgtaaccgttaaaccgtaaggtttaaattaaaccgtttaaacggtttaacgttttaccgttaaccggttacgtttttaaccgggaccgggtaacgggtaccgtaacgggttaccggtacggggtaaacgttaacgtaaaccggtaaaaccgttaccgggttacgggtacggtaccgttaaccggacccttaaccgtacgttcccgg

SEQ ID NO: 163235 - DNA, 633 bp, Homo sapiens
  misc_feature: GYAE6OF02FS13A.39.27.C05.1.454.CMB.1.raw
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatcgacccagtcctccttcccaccctgtctgcatctggttggagacagagtccacctatcacgttcgcccgggcagtcagagtattagtagctggtggccgtggtatcagcaagaaaccgaagggaaccgcccctaagcctcgtgatgatgatcgcctcgtagtttagaaaggttcgggtccagtccgtaacggttccgcggtacgaggtggactcggtaggaacgtaagtaacttcacctcctacacctacgtacgagccgacgtcctcgaccgacgtccgtagagttagttacgtttacgaactttaacgttacttactaccggaacctaaacgtaagttaaagttaagtttaacgttaacgtttaccgttaactttaccggtttcggaaccggtacggggtaacctaggtcggtaggaacgttacgtaaacgtaaacgtagtcggtacggtacgtacgaccgtaccgtcttacg

SEQ ID NO: 163236 - DNA, 580 bp, Homo sapiens
  misc_feature: GYAE6OF02JAMDH.39.27.C05.1.454.CMB.1.raw
  modified_base (196)..(196): a, c, t, g, unknown or other
  misc_feature (196)..(196): n is a, c, g, or t
  modified_base (288)..(288): a, c, t, g, unknown or other
  misc_feature (288)..(288): n is a, c, g, or t
  modified_base (336)..(336): a, c, t, g, unknown or other
  misc_feature (336)..(336): n is a, c, g, or t
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatctgttgganacagagtcaccatcacttgccgggccagtcagagtattagagctggttggcctggtatcagcagaaaccgagggaaacgcccctaagctccngatgtatgatgcctcgagttagaaagtcgggtccatcgtaaggtccgngacgagtgagtcgtagggacagtaacttcgactcctacgactactcacgcgacgcctagccgacgcctgattgtactttacgactaactttacttacgtcgactaactagttaattaaagttagtttacgttaccttacgttacgttttacgggaccgtaacgggtactaacggtacggtaacggtaacgttaacgtaaccgtaaacggacgttaggtacggcctacgaccgtaccgtattccg

SEQ ID NO: 163237 - DNA, 349 bp, Homo sapiens
  misc_feature: GYAE6OF02GJHUW.39.27.C05.1.454.CMB.1.raw
  modified_base (333)..(333): a, c, t, g, unknown or other
  misc_feature (333)..(333): n is a, c, g, or t
  modified_base (339)..(349): a, c, t, g, unknown or other
  misc_feature (339)..(349): n is a, c, g, or t
tcagtcgcactagtcacgaccggtgctcgatttagacgcgatcgaagggtttgggtgcccaagctgctggagggcacggtcaccacgctgctgagggagtagcctgaaggcctcggacaccgccatgtattactgtgcgagacatggtgatattagtggttattcctcctggggccagggaaccctggtcaccgtctcctcagcctccaccaagggcccatcggtcttcccctggccaccctcctccaagagcacctcgtggggcacgagcggcccctgggctgcctggtcaaggactacttccatagtgcgactgagcgggctggcaaggcncatgannnnnnnnnnn

SEQ ID NO: 163238 - DNA, 794 bp, Homo sapiens
  misc_feature: GYAE6OF02H369N.39.27.C05.1.454.CMB.1.raw
tcagtcgcactagtcacgaccggtgctcgatttagacgcgatcgaagggtttgggggagtcagactcagtcaggacacagcatggacatgagggtccccgctcagctcctggggctctgctgctctggctcccgagtgacctaaatgtgacatccagactcgaccctacgtcctcccttcccaccctgtctgctagtcgttggttaggaggacagtacgtccaacctactccgtacgttccggaccgggacccagtaccgtaagtaaggttaagtttacggtacgtcggtttggggttacgtcccggttaggttactacgaacgacgaaacgtaaaacccggagggaaaacctccccgtaagcccttacgtagtagttagaacttagaaccttccgtaccctttacgttaaagggtttaacgggtaaaacgggttcccgggtaacctaaggttacccgggttaaacgggttccccgtacggggtaacggtaacggttacgggtacgtaccgggtaaagggaaccgttaaagttaaccgtttccgtaaacctcccgttaaaccaaccgtaacgaccgtacggtaccgtaccggtacgtacggacctacgtaccgtgtaacgttgttacgtttacgaattaccgttaattaccaacgtaactaacgtaagttaacgttaacttaacgttacgttaccgttcgtaacgttaccggtaccggaacggtacctaaggtacgtagtaacgtaaccgtacgtaaaccgtgtcgtacggtcgtacgtacgtacgtagttccg

SEQ ID NO: 163239 - DNA, 793 bp, Homo sapiens
  misc_feature: GYAE6OF02H4L82.39.27.C05.1.454.CMB.1.raw
  modified_base (199)..(199): a, c, t, g, unknown or other
  misc_feature (199)..(199): n is a, c, g, or t
tcagtcgcactagtcacgaccggtgctcgatttagacgcgatcgaagggtttgggggagtcagactcagtcaggacacagcatggacatgagggtccccgctcagctcctggggcctcctgctgctctggctccccaggtcgccaaatcgtgacatccagatgacccagtctccttccacctgtctgcatctgtagganacagagtcaccatcacgttcgccgggccagtcagatattagtacgtctggtacggtctggtatcaggcaacgaaacgtaacgggaaacgcccctaacgcctcctggtatagtactcgaacgtctaccgtccgtaaggtttacggtaaaacggttcggggtacccctaagtacccggtaaacggttcccggacggtcgtaacgggttacggactttaccgggtacgggtaaaccgtaacgtaaaccgttttaccaaccgttacccgttaaccctaacccgtaactcccggtaaacgccctacgggtaccctacgggacctaccgtacccgttagtaacgttcggtttacgttttacgaacccttaacttaaccgtttcgtaaccgtccgtaaaaccgttaacggtttaaatttaaagttttaacgtttaaccgttaaccgtttaaaccgttaccggtttttaacgggaaccgggttaaccgggttaaccggtaaggttaccgggttaacggtaaaccggtaaacttaaccgggtaaacccttaaccggtagggttaccggtacccgtacggtaaccctaccggtttacgttaccg

SEQ ID NO: 163240 - DNA, 762 bp, Homo sapiens
  misc_feature: GYAE6OF02I6V5Y.39.27.C05.1.454.CMB.1.raw
tcagtcgcactagtcacgaccggtgctcgatttagacgcgatcgaagggtttgggggagtcagactcagtcaggacacagcatggacatgagggtccccgctcagctcctgggctcctgctgctctggctcccaggtgccaaatgtagacatccagatgacccagtctccttccacctgtctgtcatctgttgagacagagtcactagtcacgttacgccgggcctaggtccagacgtattagagtcgtgtggtccgtacgggtattacagactacgtaaaccgaacggaaacggacccctaaacgtcctccgtgtacgtagttacgtagtacgttcgaccctaccgtagtttaggaaagttacggggggtaccctataccgtaacggttccggaccggacgtacggtacggtaagttaccggttaccgggaaacgtaacggttaacgttaaccctaccgttacccgtttaccgaaccctaacgtacccgaacgttaacccgtacccggaccttaccggaaccgtacggaccgttaacggtacgtaggtttaacttttacggtaacccttaaacctttaacgttaacgtccggtaacctaacctaaaggtaaacgttaaagtttaagttaacgtttaccgttaaaccgtttacggtttacccgggtaccgaacgggttaaccgaacggtccgtagggtaacgtataaccggtaaacgaaccggttaggtaccgggtctacgtaacccttacgaccttaccgg

SEQ ID NO: 163241 - DNA, 574 bp, Homo sapiens
  misc_feature: GYAE6OF02FI8YU.39.27.C05.1.454.CMB.1.raw
  modified_base (101)..(101): a, c, t, g, unknown or other
  misc_feature (101)..(101): n is a, c, g, or t
  modified_base (196)..(196): a, c, t, g, unknown or other
  misc_feature (196)..(196): n is a, c, g, or t
tcagtcgcactagtcacgaccggtgctcgatttagacgcgatcgaagggtttgggggagtcagactcagtcaggacacagcatggacatgagggtccccgntcagctcctggggctcctgctgctctggctcccaggtgccaaatgtgacatccagatgacccagtctccttccaccctgtctgcatctgttgganacagagtcaccatcacttgccgggcagtcagtagtattagagctggttggcctggtatcgagaccaagaaaccgagggaaacgcccctaagctcctggatgtatgatcgcctcagtttagaaacggtcgggtaccatacgaaggttccgacggcaggtggatcgtagggacagtactcactctcaccatcagcagcctgcacgccgtagagttgttatttagacttaacttattaccgtacggaccctaaagtacgttaattaaattagtttactttacgttaacgtacgttttcgggaccgtaacgggaccaaggtcgtaaggacgtaactaccgtaaacgtagtacggtacggtactacggacctacgtagttccg

SEQ ID NO: 163242 - DNA, 669 bp, Homo sapiens
  misc_feature: GYAE6OF02GLQA9.39.27.C05.1.454.CMB.1.raw
  modified_base (198)..(198): a, c, t, g, unknown or other
  misc_feature (198)..(198): n is a, c, g, or t
  modified_base (286)..(286): a, c, t, g, unknown or other
  misc_feature (286)..(286): n is a, c, g, or t
  modified_base (640)..(640): a, c, t, g, unknown or other
  misc_feature (640)..(640): n is a, c, g, or t
  modified_base (664)..(664): a, c, t, g, unknown or other
  misc_feature (664)..(664): n is a, c, g, or t
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatcgacccagtcctccttccaccctgtctgcatctgttgganacagagtcaccatcacttcggccggcagtcagtagtacttagagtcgtgggttcggccttggtatcgagcaaggaaaccgagggaacncccctaagcctccgtgatgtatgactcgtacctaccgtaggttaacggaaacggttcgggtaaccctagttaccgtaacggttcccgacgggtacgtaggtacggtacgtacggtacggggtaaactaagttaacttaccgtacgttacctaaccgacctagttaccgagacccgtaacgccgttacgcgtacgtacccgtgtacgttaggttactttacgtacttaaccgtttattaccgtacgtaacctaaagttagttaactttaaagttactttaacgttaccgtttacgttacgttaccgggacgtaacgggtacctaggcgtaacggactacgtaaccggaactcggngtacggtactaacgacctaccgtntaccg

SEQ ID NO: 163243 - DNA, 750 bp, Homo sapiens
  misc_feature: GYAE6OF02HMYAE.39.27.C05.1.454.CMB.1.raw
  modified_base (308)..(308): a, c, t, g, unknown or other
  misc_feature (308)..(308): n is a, c, g, or t
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtcctccttccaccctgtctgcatctgtggagacagagtcacatcacttcggccgggccagtcagagtattagagctggttggccttggtatcagacaacgaaaccgagggaaacgccccgtaagcctacctagtatagtatgntcgccttcgtaagtttaggaaacggtcggggtaccctagtacgtaacggttccgacggtacgtaggtcggtagttccggtaacgggaactaagttaacttaccgtaccttaccgtaccaaccgtagtaccgacgaccgtaacgcccttacgacgtaccggtaccgttacgtaagttcggttaactttttacggaaccgtttaaactttaactttacccgtacgtaacccgtaaagttaaacgtttaaacgttaaacgtttaaggttttaacgtttacccggtttaaacgttttaccggtttaaccgggtaaccgggtaaccgggggttaacccttaagggttaccgggtaagggtaaaccttaaacggttaaaccgaaaaccgggtttaacgttacgggtacggtccgttaacggacccgttaacccgttactttacccggg

SEQ ID NO: 163244 - DNA, 596 bp, Homo sapiens
  misc_feature: GYAE6OF02F857H.39.27.C05.1.454.CMB.1.raw
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtctccttccaccctgtctgcatctgttggagacagagtcaccatcacttgcccgggcagtcagagtattagtagctggttggcctggtatcagcagaaaccgagggaaacgcccctaagctccgtgatgtatgatgcctctagtttagaaaggtcggggtacccagtccgaacggttccgcggacaggtggactcgtgggactagtaattccgactctcacgatcagcacgcctgcacgtcctgattgtatttgactaacgttacttactcgtaacctaatagttaattaaagttacgtttacttacgttaaccttacgttttacggaccgtaacggggtacctaacggtacgttaacgggaacgtacgtaaccgtaaaaccggtaacgttacgggttacggtccgttacggtacctaccgtagttacccg

SEQ ID NO: 163245 - DNA, 694 bp, Homo sapiens
  misc_feature: GYAE6OF02HEIR8.39.27.C05.1.454.CMB.1.raw
  modified_base (236)..(236): a, c, t, g, unknown or other
  misc_feature (236)..(236): n is a, c, g, or t
  modified_base (278)..(278): a, c, t, g, unknown or other
  misc_feature (278)..(278): n is a, c, g, or t
  modified_base (306)..(306): a, c, t, g, unknown or other
  misc_feature (306)..(306): n is a, c, g, or t
tcagtcgcactagtcacgaccggtgctcgatttagacgcgatcgaagggtttgggggagtcagactcagtcaggacacagcatggacatgagggtccccgctcagctcctggggctcctgctgctctggctcccgaggtgccaaatgtgacatccagatgacccagtctccttccaccctgtctgcatctgttgagacagagtcaccatcacttggccggcagtcagagtatagtncgtggttggccgtggtatcagtacgagaaaccgagggaaacnccccgtaagcctccgtagtagtagtacngatcgccctacgtagttaggaaacggttcggtaccagtacgaacggttccgcggacgtaggtcggtactcggttagggactaacgtaacttccgtacctcctaccaccgtattaccacggaccaaccgtccgttacgacgacggttcccgtagtaccgttaggttacgttttacgaacctttaacgtttaccttacgtaccgtaacctaaacggttaacgttaaacttttaacgttttaacctttaccccggttaacgtttaaccgtttccggaacccgggttaacgggaaccgttacggtacggttcggaacggttcccaaaccggttaaaccgtaccggttaggtacggttaccctacgtaccgtaaccgttgttaccgtttaccg

SEQ ID NO: 163246 - DNA, 703 bp, Homo sapiens
  misc_feature: GYAE6OF02JF1EP.39.27.C05.1.454.CMB.1.raw
  modified_base (101)..(101): a, c, t, g, unknown or other
  misc_feature (101)..(101): n is a, c, g, or t
tcagtcgcactagtcacgaccggtgctcgatttagacgcgatcgaagggtttgggggagtcagactcagtcaggacacagcatggacatgagggtccccgntcagctcctgggctcctgctgctctgctccaggtcgaccaaatgtgacatccagactgaccctagtccttcctccacctgtcctgcattctgtgagacaggatcaacatccgacgttcggaccggctagtacagtacgtagttagacgcgttggtcggtcgtaggtactcgacgtcaaacgaaaccgaacgggaaaccgaccgtaacgtccgtacgtgtagtacgtagtatacgtacgtaccctagtacgttaaggtaaacggtcggggtacctagtaaccgtaacggttccgacggtacgtaagttacggtaacgtaccggaagggtaacgtaacggttaacttacgtaccgtaccgttaccaacgtacgtaccgaacgtaccgaccgtaccgtgtacccgacggttctacggttacttgttaactttacgtaacttacgtttaactacgaacctaacgtaaggtaaattcgtaaacgtttagttaaccttccgtaaacgtttcggttaaccggacgttaaacggacctagggtaccgaggtaaactacgtaaacgtaaccgtacgttcggaacgtcgtaaccgacttaccgtattaccgg

SEQ ID NO: 163247 - DNA, 748 bp, Homo sapiens
  misc_feature: GYAE6OF02IDDFI.39.27.C05.1.454.CMB.1.raw
  modified_base (559)..(559): a, c, t, g, unknown or other
  misc_feature (559)..(559): n is a, c, g, or t
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgaccaaatgtagacatccagactcgacccagtctccttccacctgtctgcatctgtggagacagagtcaccatcacttcgccgggccagtcagagtattagtacgtcgtggttcggtccgtggtacgttcgacggcaacggaaaccgtaagggaaaccgtacccccgtaaagtccccgtaccttaggtaaccgttaggttaacgtcgtaacggttcggaccccgttaccgtttacggtttaacggtaaaacgggttccggggtaccctaaagtaccggtaaaccgggttccggcgggtactacgggtcggtaacgtcggtacggggtaacgtaacgtaacgttccgtaactcctaaccgtaacctaagtacgaacgtcctaaacgtcccgtaggaccgtacgtaccgtacggttaacggtntttaacgtttacgttaacgttaaactttacgttaccgaaacgtacctaaacgtaaccgttaataacgtttacgtttaacgttaccgttaactttacggtttccgaacggtacgggtaacctacgggtactacgggaagttacgaaccgtaaacgtacgtcgttacgccgtacgactacccgtattaccg

SEQ ID NO: 163248 - DNA, 708 bp, Homo sapiens
  misc_feature: GYAE6OF02G4GX0.39.27.C05.1.454.CMB.1.raw
tcagtcgcactagtcacgaccggtgctcgatttagacgcgatcgaagggtttgggggagtcagactcagtcaggacacagcatggacatgagggtccccgctcagctcctggggctcctgctgctctggctcccaggtgccaaatgtgacatccagatgacccagtcctccttccaccctgtctgcatctgttggagacagagtcaccatcacttgccggcagtcagagtattagagtcgtggttcggcctggtatcagcaagaaaccgagggaaaccaccccgtaaagcctacccgtaggacttagtactagacgtcgtacctaccgtagtttaacggaaaaggttcggggtaccctagtaccgtaaacggttcccgacggacgtacggtcggtagtaccgtagggtaacaagtaacttaccgacttccgtaccacctactaccaagacccgtaaggcccttgaccgtaacgtcccgtaggtattacggttacgtttttacggaaccttaacgtttaacgtttaacccgttaccgtaaaccctaaaggttaaaccggtttaaactttaaagtttaaccttttaaggttacccgtttaacgttacggttttaacgacccggttaacgggtaacccgtaggtacgtaacggtacgaaaccgtaacgtaaaccgtagttacggtacggcgtaccacgtacccgtataccg

SEQ ID NO: 163249 - DNA, 679 bp, Homo sapiens
  misc_feature: GYAE6OF02FRLOL.39.27.C05.1.454.CMB.1.raw
  modified_base (195)..(195): a, c, t, g, unknown or other
  misc_feature (195)..(195): n is a, c, g, or t
  modified_base (199)..(199): a, c, t, g, unknown or other
  misc_feature (199)..(199): n is a, c, g, or t
tcagtcgcactagtcacgaccggtgctcgatttagacgcgatcgaaggggtttgggggagtcagactcagtcaggacacagcatggacatgagggtccccgctcagctcctggggctcctgctgctctggctcccaggtgccaaatgtgacatccagatgacccagtctccttccaccctgtctgcatctgttgngacngatcacatcactcgccggccagtcagatatagtagtcgtggtcggccgtggtatcagcaagaaaccgagggaacgccctaagctcgtagtagtgtatagactgtccttacgtaagtttaacggaaaggttcggggtccacgttaccgtaacggttccggtacggcgtaagttcggtagtcggtacgggaactaaggtaactttaccacgtcctaccgtaccgtactacacgctacggcctacgacgtacgcctacggtagtttacgttaacgtttacgtaacgttaaatttacttaaccgttaccgaaccctaaagttaccgtttaaagtaacgtttaacgtttacgtttaaccgttaactttaaccggttttacggaacccgggtaacggtaacccgtaggtcggtaagggaacgtaaccgttaacgtaaaccgtaacggtacggttcggtacgtaccgtaccgtaccgtactttacgg

SEQ ID NO: 163250 - DNA, 669 bp, Homo sapiens
  misc_feature: GYAE6OF02F3A77.39.27.C05.1.454.CMB.1.raw
  modified_base (406)..(406): a, c, t, g, unknown or other
  misc_feature (406)..(406): n is a, c, g, or t
  modified_base (461)..(461): a, c, t, g, unknown or other
  misc_feature (461)..(461): n is a, c, g, or t
tcagtcgcactagtcacgaccggtgctcgatttagacgcgatcgaagggtttggggggagtcagactcagtcaggacacagcatgggacatgagggtccccgctcagctcctggggctcctgctgctctggctccaggtcacaaatgtgacatccagactcgacccagtccttcccttccaccctgtctgcactcttggttggagactaggacgtaccaacctatccgtacgttcggcccgggcaggtcagtaaggttattacggtagtcgtagggttcggtcgtaggtatcaggacaaggaaaccgaagggaaacctaccccgtaagtcctacctgattgtatgattcgcctacgtaggtttagaaagggtccggggtacctaatacggaacggttccggacggnaggtgacgtggtaggacagtaactctactcctacacacagacgtacgacgtcgtncgacgtccgtgtagttcgtttagtttactaccttaaactttacgttactcgtaaacctaacgttaagttaaacgttaattaacgtttactttaacgttaactttacgtttacgggacccgtaacggggtaccagggtacggtagggaactaaccgtaaccgtaaaccgtagtaacgggtccgtacgtaccggtactacctagttaccg

SEQ ID NO: 163251 - DNA, 658 bp, Homo sapiens
  misc_feature: GYAE6OF02JYD4V.39.27.C05.1.454.CMB.1.raw
  modified_base (151)..(151): a, c, t, g, unknown or other
  misc_feature (151)..(151): n is a, c, g, or t
  modified_base (165)..(165): a, c, t, g, unknown or other
  misc_feature (165)..(165): n is a, c, g, or t
  modified_base (202)..(202): a, c, t, g, unknown or other
  misc_feature (202)..(202): n is a, c, g, or t
  modified_base (205)..(205): a, c, t, g, unknown or other
  misc_feature (205)..(205): n is a, c, g, or t
  modified_base (421)..(421): a, c, t, g, unknown or other
  misc_feature (421)..(421): n is a, c, g, or t
  modified_base (453)..(453): a, c, t, g, unknown or other
  misc_feature (453)..(453): n is a, c, g, or t
  modified_base (634)..(634): a, c, t, g, unknown or other
  misc_feature (634)..(634): n is a, c, g, or t
tcagtcgcactagtcacgaccggtgctcgatttagacgcgatcgaagggtttgggggagtcagactcagtcaggacacagcatggacatgagggtcaccgctcagctcctggggctcctgctgctctggctcccaggtgaccaaatgtganatccagatcgaccngtcctccttccgacctgtctgcatctggtaggacganagngtacactctactacgtcggccggtaccaggttacgaaggtagttaagttaggtacgtcgttggttcggtcgttgtactcgaggacaaggaaccgaacgggaacacccgtagaccgtactagatgtatgactcgtacctacgtaagttacggaaagggtcggacctagtaccggtacggtccggacgtcgacggtaggtacgtacgggtacggtaanacggttatccgacttacctacaccagtcgacncggacctcgtacgcgtacgtctaggtgttacgttattacggtaacttaacttactacgtacgtacctaaaggtattaacgttaagtttacgtttaactttccgttaacgttccggttaacgggacgtacgggtaccacgggttcgacggtaactaacgtacggtaagttaccgtacgggtntacccggtatacccgtacgttacg

SEQ ID NO: 163252 - DNA, 739 bp, Homo sapiens
  misc_feature: GYAE6OF02H0ZPG.39.27.C05.1.454.CMB.1.raw
  modified_base (240)..(240): a, c, t, g, unknown or other
  misc_feature (240)..(240): n is a, c, g, or t
tcagtcgcactagtcacgaccggtgctcgatttagacgcgatcgaagggtttgggggagtcagactcagtcaggacacagcatggacatgagggtccccgctcagctcctggggctcctgctgctctggcctcccgaggtcgaccaaatgtgacatccagatcgacccagtcctcccttccaccctgtctgctatctggtaggagacgagacgtcaccgtatctacgtcggccggcagtnagtagtagttagtagtcgttggtcgcctaggtactcgagacgaagaaaccgagggaacctcccgtaagccttaccgtagtacgtagtagtacgtactcccgtaccgttacgttaaggtttaacggtaacgggtccgggtacctaacgtaccggtaacggttcccggacggtacgtaggtcgaacgttcggaacggtactaagtacttacctaccgtacctacctaaccgtacgtacgtacgaccgtacgtccgtacgacgtacgtcgtagtacgttagttaaccgtttacgtaaaccgtttaacgtttaacgtaccgtaccgtaaactaaacgttaagttaaactttaaacgttttacgttaaccgtttaacgtttaacccgttacggtttaccgggaaccgggtaacgggtaccgtaaggtcggtaaaggtaaccgtaacgtaaccggtaaaccgtaggttcggtacggttacctacgtcccgttagtaccgttaccg

SEQ ID NO: 163253 - DNA, 421 bp, Homo sapiens
  misc_feature: GYAE6OF02IK9JW.25.77.G11.1.454.CMB.1.raw
  modified_base (419)..(421): a, c, t, g, unknown or other
  misc_feature (419)..(421): n is a, c, g, or t
tcagactgtacagtcacgaccggtgctcgatttagctagtcactcaagggaaagggactggagtggattgggagtgtttattatacagggccacttggcgttacccgccctcaggagtcgcgtttcgatgtccgttgacacggccacgaatcacttcaccctgaccctaacgtctgtgaccgccgcagacgcggccatatactattgtggggcgagtctgccgtcatacagtagtggccagttcgacctgtggggcccgggaaccctggtcgccgtctcatcggcctccaccaagggcccatcggtcttccccctggcaccctcctccaagagcacctctgggggcacagcggccctgggttgcctggtcaaggactacttccactgtacagtctgagcgggctggcaaggcgcatagnnn

SEQ ID NO: 163254 - DNA, 424 bp, Homo sapiens
  misc_feature: GYAE6OF02HRBHF.25.77.G11.1.454.CMB.1.raw
  modified_base (421)..(424): a, c, t, g, unknown or other
  misc_feature (421)..(424): n is a, c, g, or t
tcagactgtacagtcacgaccggtgctcgatttagctagtcactcaagggaaagggactggagtggattgggagtgtttattatacaggggccacttggcgttacccgcccctcaggagtcgcgtttcgatgtccgttgacacggccacgaatcacttcaccctgaccctaacgtctgtgaccgccgcagacgcggccatatactattgtggggcgagtctgccgtcatacagtagtggccagttcgacctgtggggcccgggaaccctggtcgccgtctcatcggcctccaccaagggcccatcggtcttcccccctggcaccctcctccaagagcacctctgggggcacagcggccctgggctgcctggtcaaggactacttccactgtacagtctgagcgggctggcaggcgcatagnnnn

SEQ ID NO: 163255 - DNA, 520 bp, Homo sapiens
  misc_feature: GYAE6OF01BZVUX.23.42.D09.1.454.CMB.1.raw
  modified_base (296)..(296): a, c, t, g, unknown or other
  misc_feature (296)..(296): n is a, c, g, or t
  modified_base (427)..(427): a, c, t, g, unknown or other
  misc_feature (427)..(427): n is a, c, g, or t
tcagacgcgagtatcacgaccggtgctcgatttagacacatacgcgggaaagggagctgtgggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaaggagacagcctcagaagctattatgcaagttggtaccagcagaagccaggacaggccccagcacttgtcatttangataaaaatagtcggccctcagggatcccagaccgattctctggctccagttcaggagacacagcttccttgaccatcactggggctcgaggcgaagatgaggctgacttatttctgtaactcccgggaanaacgagtggtagacgatactaagtttgggtatttcgggaggtagggaccaagcgtgacccgtctaaggtcaggacccaaggcctcgtcccccg

SEQ ID NO: 163256 - DNA, 707 bp, Homo sapiens
  misc_feature: GYAE6OF01BKAJ5.23.42.D09.1.454.CMB.1.raw
  modified_base (499)..(499): a, c, t, g, unknown or other
  misc_feature (499)..(499): n is a, c, g, or t
tcagacgcgagtatcacgaccggtgctcgatttagacacatacgcgggaaaggggagctgtgggctcagaagcagagttctggggtgtctccaccatggcctggacccctctctggctcactctcctcactctttgcataggttctgtggtttctctgagctgactcaggaccctgctgtgtctgtggccttgggacagacagtcaggatcacagtcgaccaagggacacacgcctacgaagaagtctaattatgactaaggttggtaaccagacaaggaacgcgaggacacgggcccctagcctaacgttgtactagttttaacgtagtaaattaaaaacgtcggtcccgggtaccctacgaacgggtacctacccgaagtaccgtacttcgtcgtcggtacctactacggttacgaaggacgtaacacgtaccgtctttaccgtacgacctacgttaccgacggttcggggtactacgggaagggaccggtaaaggngtacggaacggtcgttacgtactttacgttttaccgtaacggttaaacccggttccgggaaaccttaacggtagggtacggtacggtaacgttacgtaacgtttaggtttcgggtagtcccggggtaaggaccgggtaactaggtccggtaacgtacccggttacaacggtcccaaggaccccgaaggtccccgttccggtacccccg

SEQ ID NO: 163257 - DNA, 783 bp, Homo sapiens
  misc_feature: GYAE6OF01C1JTA.23.42.D09.1.454.CMB.1.raw
tcagacgcgagtatcacgaccggtgctcgatttagacacatacgcgggaaaggggagctgtgggctcagaagcagagttctggggtgtctccaccatggcctggacccctctctggctcactctcctcactcttgcataggttctgtggtttcttctgagctgactcacggaccctgctgtgtctggtcggccttgggacagacagtcaggatcacatgaccgaaaggacgacagcctacaagaacgctaattatgtacgtaaggttacggtaaccagacaaggaacgaccgaggaaccacggccccagactacttgtactaatttagtaagtaaaataaaaagtcggtaccggtaccctacggaacgggtactacccgaacgtacccgtaactttccgtacgttacgggtacccttaccggtaacggtttacggaacgggtaacgtaaccgtaaccgtaaccggttcccttttaccgttaccgaaccctacgttaccgtaacggtcgggggaccttacggacggggaacggtaagtacggtaggtaacggtcgtagttaaccgttttacgtttccggtaaccggttaacccggtacccggtaactaacggttacgggttacgggtaacgtaaccgttaacggttacgtttaacgggtttaggggtacggttaccggggacgggtaacgggtaaccgtaagggtacggttaaccgggtaacccgttacgtaacgtacccggaaccggtacccggtaaccggttcccgtaccccggtaccccgg

SEQ ID NO: 163258 - DNA, 744 bp, Homo sapiens
  misc_feature: GYAE6OF01DXW0X.23.42.D09.1.454.CMB.1.raw
tcagacgcgagtatcacgaccggtgctcgatttagacacatacgcgggaaaggggagctgtgggctcagaagcagagttctggggtgtctccaccatggcctggacccctctctggctcactctcctcactctttgcataggttctgtggtttcttctgagctgactcaggaccctgctgtgtctggtcggccttgggacagacagtcaggatcacatcgaccgaaagggagacacgcctacgaagaagtcttaattatgacgtaaggtttcggtaaccaggacaagaacgccgaggacgacggcccccagcctacgtttgtactatttagacaattaaaaagtcgtaccggtccctagaacgggtactacccgaagacctattcctacgtcggtcctccgtaggttcgaaggacaactacgacgttcctttaccgtacgaccctagtccgacggtcggggtactaccggaagggaccggaaagtacgtaggtacggctttacggtaacctttacgtttaccgtaacggttaacccggtacccgggaataaccggaggggtttacggtacgtaaccgttaacgtttacggtttaagggttttcggggtaaccggtttacggggaacggggtaaaccgggtaaccggtaacggttcccggttaaccgggtaaccccggttaaccggttaacggtaccccgacgggtaaccccgtaacgggtccccgtacccggttacccccccgg

SEQ ID NO: 163259 - DNA, 724 bp, Homo sapiens
  misc_feature: GYAE6OF01ARZ45.23.42.D09.1.454.CMB.1.raw
  modified_base (298)..(298): a, c, t, g, unknown or other
  misc_feature (298)..(298): n is a, c, g, or t
tcagacgcgagtatcacgaccggtgctcgatttagacacatacgcgggaaaggggagctgtgggctcagaagcagagttctggggtgtctccaccatggcctggacccctctctggctcactctcctcactcttgcataggttctgtggtttcttctgagctgactcaggaccctgctgtgtctggtggccttgggacagacagtcaggactcacatgaccaaaggacgacagcctcaagaacgtctattatgactaagttcggtaccagccaagaaacgccgaggacacggcccgancctacttcgtctatttaatagaaataaaatacgtaccggaccctacgtacgggacctaccgaacgaccgtacttcgtcgtcggccttccgtagttcgaaggtacgaacctacgacgtccttaccgttacgacctaacgtctaaccggtcgggtacctaccggaacgggtaacgggaaacggtaacggttacgggtacggtaccgttacggttaaccttaacgttttaccgttaaccgttaacccggtaccccggaaacgtaacggtacgggttaggtaacgtacggttaacgttagtttaaacggtttcgggtacggttaccggggtaaccgggaagggtaaccgtaaggtacccggttcgtaaacccggtacgttaaccgtaccggtaccggaacccgtacggtcccgtacccggttacccccgg

SEQ ID NO: 163260 - DNA, 1009 bp, Homo sapiens
  misc_feature: GYAE6OF01CJ93J.23.42.D09.1.454.CMB.1.raw
  modified_base (230)..(230): a, c, t, g, unknown or other
  misc_feature (230)..(230): n is a, c, g, or t
  modified_base (252)..(252): a, c, t, g, unknown or other
  misc_feature (252)..(252): n is a, c, g, or t
tcagacgcgagtatcacgaccggtgctcgatttagacacatacgcgggaaaggggagctgtgggctcagaagcagagttctggggtgtctccaccatggcctggacccctctctggctcactctcctcactcttgcataggttctgtgtttcttctgagctgactcaggaccctgctgtgtctgtcggccttgggacagacagtcgagatcacatgaccaaaggacgacncgccctacagaacgtctattanagactaagttcggtaccagcagaacgccgaggacgacggcccccagcctacttcgtactaattttagtagtaaattaaaaacgttacggtaccccggtacccctaggaaccggggtacctaccccggtaacggtaaccccgttaacgtttcccgtacccggttacggtacccttacccggttaacggtttacccggaaacgggtaaccgtaaccccgtaaccggttacggttcccccgttttacccgtttaaccggtaacccccctaagtttacccccggaacccgggtttccgggggggtacccttaaccgggtaacgggggtaaaccggggtaaacggtacgggttaaccgggggtaccgtaccgggtttaacggttaaaccgttttacgttttttaccccggttaaaccgggtttaaacccccggggttaacccccggggttaaacccgtaaccgggttaaaccggggttccggggtttaaacgggtaacccggtttaaacgtttaccgggtttttaaaacggggttttacgggggtttaacccgggttttaaacccgggggtacgggggggttaaaaccccgggggtaaaccccgtttaaaccccggggtacccgggtttaccccgggttaaaccccccggggtttaacccgttttaaacccgggggaaccccggttaaacccccggggtaaaccccccgtaaccgggggttaaccccccgttccccccggggtttaaaccccccccccgggg

SEQ ID NO: 163261 - DNA, 715 bp, Homo sapiens
  misc_feature: GYAE6OF01AKJ55.23.42.D09.1.454.CMB.1.raw
  modified_base (662)..(662): a, c, t, g, unknown or other
  misc_feature (662)..(662): n is a, c, g, or t
tcagacgcgagtatcacgaccggtgctcgatttagacacatacgcgggaaaggggagctgtgggctcagaagcagagttcgtgggtgtctccaccatggcctcggacccctctctgctcactctcctcactctttgcataggttcgttgttgttttcttctgagtctgactcgaggtccctgtctgtcgtctgtcggtcctagggacagaactagtcgaggactacacaagtcgacgaaaggacgacgacgctaacgaagtaagtacttaagttatagtacgtaacgtttaggaacaacgacgaaggtaaacgccggaaggaaccgtaccgccccgaagtcctaagttccgtatatttaagtaagaaaacgttaaaaactcgtaccggaccttacggacgtaccgtaaccggacggttaaccgtacgttacgtcgtacgtccctacgtagtaccggaagacggaactacgagtcctttaccgtacaacctgtaccggttacgcggggtacctaggaagggtaccgtaaggactacgggtaactcgttaagtaactttacgtttacgtaaccgtaaaccggtacccggaactaagggtggaaccgttaagtaccgttaagtacgtttaagttgtaaacgggtccggaaaggcggttaaaccgngtaccgttacgacccggttacacgtacacccgggacacggtctcccgacccgg

SEQ ID NO: 163262 - DNA, 735 bp, Homo sapiens
  misc_feature: GYAE6OF01BS7BF.23.42.D09.1.454.CMB.1.raw
tcagacgcgagtatcacgaccggtgctcgatttagacacatacgcagggaaagggacagggtctccgaaggcttcaccagtcctgggcccgactcctgcagctgcaggagtcgggcccaggactggtgaagccttcggagaccctgtccctcacctgcactgtctctggtgctccatcaggactactagtcactactggctggatccgccacgcccccgtaggggaacgggctggtacgtggtacttcgggcagtacatagtacagttacgtgggactaaccgttctaaccaaccccgtccctacgaacgagttccgagttccaacctatactacaagttcgacgtacgtacccgaaagtacgtaccgtacgttcgtccgtagaacgtctggaacgcctcgtcgtacgacccggtccggaccggtaacgaccgggtcccgttacgttacgtttcgttcgttacggaagtaacgtaacggttaaacggaacgaccgtacgtagacggttacggaccttacgaacggtttcccgggttaccgggggttttgtaaccggttaccgggtcgggtaccggaacgggtaccgtcccgtaacggtcccgtaacgttcccgttcttcgtacgccccgtaccgaaccgtaccgggtacccctcggttacccggtcccttcccccggcggtaccccgtcccgtcctcccggttaccaccggtacggaccctccggacccgtacgg

SEQ ID NO: 163263 - DNA, 858 bp, Homo sapiens
  misc_feature: GYAE6OF01CWRE9.23.42.D09.1.454.CMB.1.raw
  modified_base (846)..(846): a, c, t, g, unknown or other
  misc_feature (846)..(846): n is a, c, g, or t
tcagacgcgagtatcacgaccggtgctcgatttagacacatacgcggggaaagggggagctggtgggctcagaagcagagttcgtggggtgtcctccaccatcggcctcggacccctctctggctcactcctcctcctacttctttgactagttacggttcttggttggtttttcttcgtggacgtctacgacctcgaacggtaccccgttgcgttggttcgttcgttggtacggtccgttagggacagacgtagtcgaaggactacacgtacgacgaaccggaaaggacgacgtaccgaccgtaacgaaggtaacgtactttaagttacggtacgtaaccgttaaagggttaccggaaccgtaacggaacgtaaacggaaccgaccgggaacggaacccggacccgtacccgacgttaaccttacgttacgtaacttaagttagtaaaacgtaaacgtaaaacgttccggacccgtcgtaacggaaccgtaccgacctagtacctcgttcgacgttcgtaccgtacctaggtcgaaacgaccgtaccgtaacgtccggttaccttacgtaaccgtacgtaacgtccgtaacgggtccggtaaccgtacgggtaacgggaaaccggtaagtacggtacggtaacgggtacctttaacgttaccgtttaccgtttacggtaacccgtaaacccgggtaccgtaacggaagggttaccggtacgaacggtactttacggttaagtttacgggtcggttaaacggcggggtaaaccgggtccggtaaccgtaaggtcccggtaaggtaaccccttaggaaccgtccggaacgtacccgacggttccccnccgggtttcccg

SEQ ID NO: 163264 - DNA, 880 bp, Homo sapiens
  misc_feature: GYAE6OF01BGDM4.23.42.D09.1.454.CMB.1.raw
  modified_base (112)..(112): a, c, t, g, unknown or other
  misc_feature (112)..(112): n is a, c, g, or t
tcagacgcgagtatcacgaccggtgctcgatttagacacatacgcgggaaaggggagctgtgggctcagaagcagagttctggggtgtctccaccatggcctcggacccctntctggctcactctcctcacttctttgctattaggttctgttggttttccttctgagtctgactcgaggacgtcctgtcttagtcgttcgtgggtcgggtccggtgggaacagaccgagtccgaggactccgaccgtcggaccgggaaggacacgacgcccgtacggacggtaccctacgttcccgaccctaccggttacggacccacggaccaaggaaccgggcccggtaaccgacccggtccccttacgttacttcgtaccttcgtttacggtttacggaaaccgaacccggtaccccgtcccgtacggaacgggtaccccgtaccccggtaacgttcgtttaccgtcggtaccggtccctaaccccgtaccgtaacgggaaaccgggaaccacccggttcgttaccgtttaccggtacgaacccgttcgtaccggtaccgggtcgggtaccgttacgggaacggggtaaccgtaaggtaacggtacgggacggttagtaacggtttaaagttacggtttacgtaccggtaccggaaccggtacccgggacccgggtaagttaggtttaaccgtttaacgtttcccgttttaaccgtacccggaccccggtaaccccggtacgtcggttccccggtaacccgttcccgtttaacgtccggacccgaaccccggtaccccggaacccgtaccccaacccggttcctacccgttacctaccccgttccgtaccccccggttcccctacccgttccgttacccgtacccg

SEQ ID NO: 163265 - DNA, 818 bp, Homo sapiens
  misc_feature: GYAE6OF02IIEBE.23.42.D09.1.454.CMB.1.raw
tcagacgcgagtatcacgaccggtgctcgatttagacacatacgcgggaaagggggaagggctgtgggctcagaagcagagttcgtggggtgtctccaccatgggcctggacccctctctggctcactctccctcactctttgcataggttctgtggtttccttctgagctgactcaggccctgctgtgtctgtcggccttgggacagacagtcagatcacatcgaccaagggacgacacgccgtacgaaggtaaggtcttagttatagacgtaagttcggtaccaagacgaagaacgccgaggacgacggaccccacggaccctaacttgtacctaattttagtagtaaagttaaaaagttacggtaccggtacccttacggacgggtactacccggtaacgtaaccgtactttccgtaccgttcgggtaccttaccgtacggttacgaaggtacgaaccgtaaccgacggttaccctttcccgtaggacccctagttacccgtacggttacgggggccttaccggaacggggtaccgggtaacggtacggtacgggtaacgggtccttaagggttaaccttttacggttttaccgtaaccggttaacccggtaccccgggtaaaccgtaaccgtacggggtttaccgggtaggtaaccgtttagttaccggtttaaaggtttacgggggttaactttccgggggaacgggttaccgggtaaccggttaacgggtaccgttaaccggtacccggttaaccgttaacgggtacccgtaaccggacccgtaccggggtaccctcccggtaaccccccgg

SEQ ID NO: 163266 - DNA, 767 bp, Homo sapiens
  misc_feature: GYAE6OF02FWYOL.23.42.D09.1.454.CMB.1.raw
tcagacgcgagtatcacgaccggtgctcgatttagacacatacgcgggaaaggggagctgtgggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatcgaccaaggagacagccctacaagaagtcttattagtgacgtaaggttcggtaccagacgaagaacgccgaggaaccaccggaccccagcctacgttcgtactaatttagtaagtaaataaaaaacgttcggtaccggacccttacggaacgggtacctacccggaagtaacccggttactttccgttacgtcgggtacccttaccgtaaggttaccgaacgggaacgtaaccgaacgtacgtacctttaccgtacgaacctacgtccgtaacggttcggggtacctacggaacgggtacggtaacgtacgttacgggaacggtacgttacgtaacgtttacgttttaccggtaaccggttaacccggttacccgggaaacgttaacggtacgggttaacgggtaccggtaacgttaacgtttaacgtttaaaggtttacgggttaacgttccggggaacgggtaacggaaccgtaacggtccgtaaccggtacccgttaacgtacggtaccgaaccggtacccggtaacggtcccgtcccgtacccccgg

SEQ ID NO: 163267 - DNA, 882 bp, Homo sapiens
  misc_feature: GYAE6OF02HHB5I.23.42.D09.1.454.CMB.1.raw
tcagacgcgagtatcacgaccggtgctcgatttagacacatacgcgggaaaggggagctgtgggctcagaagcagagttctggggtgtctccaccatggcctggacccctctctggctcactctcctcactctttgcataggttctgtggtttcttctgagctgactcaggaccctgctgtgtctgtcggccttgggacagacagtcaggatcacagtcgaccgaaagggacgacacgccctacaaggtaacgtccttattaagtagacctaaaggtttcggtaacccaagacgaaacggaaacggacccgaagggaaccgaaccgggaccccccgaaggacccttaaccgtttaggtaccttaaagtttttaacgtaacggtaaaaatttaaaaaaacggtacggttacccgggaccccttacggaacggggtacctaacccgaacggaacccgtaactttccgtaccgttacggtacccgttaccgtaacggtttaaccgaagggtaacgaaccctacgtacgtttaccctttacccgttacggtaacccttacgtaccggttaaaccgggtccggggtaaccttaccgggaacgggtaacgggtaaacggtagtacgggtaacgtaccgttaacgtaacgttttaaccgtttaccggttaaccgttaaccccggttacccgggtaaacaaaccggtagggttacgggaccgttaaacggttacgttaacggtttaaacggtttcggggttaaccgtttaccggggaaccgggtaacggggtaaccgtaacggtaccgttaaccggtaacccgttaaccggttaacgttacccggaccggtaaccccggtaacgggttcccctaccccggttacccccgg

SEQ ID NO: 163268 - DNA, 711 bp, Homo sapiens
  misc_feature: GYAE6OF02JI79W.23.42.D09.1.454.CMB.1.raw
tcagacgcgagtatcacgaccggtgctcgatttagacacatacgcgggaaaggggagctgtgggctcagaagcagagttctggggtgtctccaccatggcctcggacccctctctggctcactctcctcactctttgcataggttctgttggtttcttctgagctgactcgacggaccctgctgtgtctggtcggtccgttgggacagacgagtcgaggatcacagtcgaccgaagggacgacacgccctacaaggaagtctaattatagtacgtaaggttaccccccccccccccccccccccccccccccggtaagacgacgaagaacgaccgacggaccgacggaccccgacgacgtacgttacgtactatttagtagtaaataaaagtaacggtaccggacccgtacggtacggaccgtaccgacgaccgtacttcgtcgtacgtccgtacgtacgtacgacggacgacacgtacgtccgttaccgttacgtactactacgtacggtcggtcgtacgacggacggaagagtacggacggtacgtacgtacgttacttacgtacgtaccgtaccggtaacgtaacgtaggtaggtacgtacgtaacgttacgttaagtttacggttacggttacgggtacggacggtaacgtacgtacgtaccgtaccgtacgtacgtacgaccgaccgtacggtaccgtccgtcccg

SEQ ID NO: 163269 - DNA, 780 bp, Homo sapiens
  misc_feature: GYAE6OF02G762K.23.42.D09.1.454.CMB.1.raw
  modified_base (598)..(598): a, c, t, g, unknown or other
  misc_feature (598)..(598): n is a, c, g, or t
tcagacgcgagtatcacgaccggtgctcgatttagacacatacgcgggaaaggggagctgtgggctcagaagcagagttctgggggtgtctccaccatggcctggacccctctctggctcactctcctcactctttgcataggttctgtggtttcttctgatctgactcgaggaccctgctgtgtctggtcggtccttaggactagacgaggtacaggacttacactagtccgaccgaagggacgacacgtccctaacgaacggaactaccttaagtttaagtacggtaacgtaacggttttaccggggtaaacccaggaaaccgaagggaaacggacccgaaacggggaacccgacccgggacccccgacggtaccttaccgttttcggtaacttaacctttagttaaaagaaaactttaaaaaaggtccggtacccggtaccccgtcgggtaaccggacctaacccgacggtaccgtacgtttcgtccgtacggtcctacgtacgtacggaacggtacgacctacgtaccgttcccttaccgttcaacccgtactaccggtacggttagggaccctagggaccggtaaggtaacgngttacggaacggtaccttacgtactttcgttacggttaccggaccgttacccgggaatacggtagttcggtagaaccttaggttagttaaggttaggtaccggtacggacgggacgttaacgagtaccgtacgtaccgttacgacgtaccgaccgtacgtaccggccgtaccccggtcccgg

SEQ ID NO: 163270 - DNA, 785 bp, Homo sapiens
  misc_feature: GYAE6OF02J1HLY.23.42.D09.1.454.CMB.1.raw
  modified_base (222)..(222): a, c, t, g, unknown or other
  misc_feature (222)..(222): n is a, c, g, or t
tcagacgcgagtatcacgaccggtgctcgatttagacacatacgcgggaaaggggagctgtgggctcagaagcagagttctggggtgtctccaccatggcctggacccctctctggctcactctcctcactctttgcataggttctgttggtttcttctgagctgactcgaggaccctgcttgtgttctggtcggtccttagggacagacagtcaggatcanatcgacgaaggagaccagcctacgaagaagtcttaattagtacgacgtaagttacggtaccagacaacgacgaccgaacggaccgacccggaccccaggtaccgtacgttacggtacttaatttaacgtaagtaaaactaaaacgtacggtcccggtacctacggtaacggactacccgacgtaccgtacgttctccgtagtcctacgtacggttacgaacggtactaaccgtacgtacggtacccttaccgttaacgaaccgtacgttaaccgtcgggttacgggtaccgtaacggtaacgggaacggtaagtacggtacggtaacggttcctaacggttaaccgttaccgtttacggttaacccggtaaaccggttcccgggaaaccgtaacggtacgtacggtaccgttaaacgtaactttacggttaacggttttacgggtacggttaccgggacgggtaaccgggtaaccggacgttaccggtaaccggttacccgttaaccggaaccgttaccggaaccggtaccccggtacggtcccccgttacccggtaccccgg

SEQ ID NO: 163271 - DNA, 152 bp, Homo sapiens
  misc_feature: GYAE6OF01B1LPN.30.57.F02.1.454.CMB.1.raw
  modified_base (151)..(152): a, c, t, g, unknown or other
  misc_feature (151)..(152): n is a, c, g, or t
tcagcacgctacgtcacgaccggtgctcgatttagctcgatatagttgggtttgggaaggtggaaatcaaacgaactgtggctgcaccatctgtcttcatcttcccgccatctgactacagtgctctgagcgggctggcaaggcgcatagnn

SEQ ID NO: 163272 - DNA, 464 bp, Homo sapiens
  misc_feature: GYAE6OF01BRAMD.30.57.F02.1.454.CMB.1.raw
  modified_base (181)..(181): a, c, t, g, unknown or other
  misc_feature (181)..(181): n is a, c, g, or t
  modified_base (305)..(305): a, c, t, g, unknown or other
  misc_feature (305)..(305): n is a, c, g, or t
  modified_base (354)..(354): a, c, t, g, unknown or other
  misc_feature (354)..(354): n is a, c, g, or t
  modified_base (400)..(400): a, c, t, g, unknown or other
  misc_feature (400)..(400): n is a, c, g, or t
  modified_base (409)..(409): a, c, t, g, unknown or other
  misc_feature (409)..(409): n is a, c, g, or t
  modified_base (416)..(417): a, c, t, g, unknown or other
  misc_feature (416)..(417): n is a, c, g, or t
  modified_base (419)..(420): a, c, t, g, unknown or other
  misc_feature (419)..(420): n is a, c, g, or t
  modified_base (425)..(464): a, c, t, g, unknown or other
  misc_feature (425)..(464): n is a, c, g, or t
tcagcacgctacgtcacgaccggtgctcgatttagctcgatatagttgggtttggggtacgatttgatgttacctgatgcttagaggcttttcctggaagcagggcatttgttgcttcagcaccgtagtgcctcgtcatcacgctcagccttgtattttccggatttgcctaggaaaaccngcctacacgaccgttaaaaccgggactaacccggtccgccccggaccaaacgtatacgtccctttcctccccgtccccccttggcctaagtaaccaccaagtacaaggtaacttacttaacctntttacccatcgactacgtcctttccggcctcgtccgttagggtcactcnccctgccctatacgtgactcggaccttggtcctcggcgagcggcgngagaggcanacgtagnncnncgatnnnnnnnnnnnnnnnnnnnnnnnnnnnnnnnnnnnnnnnn

SEQ ID NO: 163273 - DNA, 150 bp, Homo sapiens
  misc_feature: GYAE6OF02FX5ZV.30.57.F02.1.454.CMB.1.raw
  modified_base (150)..(150): a, c, t, g, unknown or other
  misc_feature (150)..(150): n is a, c, g, or t
tcagcacgctacgtcacgaccggtgctcgatttagctcgatatagttgggtttgggaaggtggaatcaaacgaactgtggctgcaccatctgtcttcatcttcccgccatctgactacagtgctctgagcgggctggcaaggcgcatagn

SEQ ID NO: 163274 - DNA, 390 bp, Homo sapiens
  misc_feature: GYAE6OF02G1P2G.30.57.F02.1.454.CMB.1.raw
  modified_base (362)..(362): a, c, t, g, unknown or other
  misc_feature (362)..(362): n is a, c, g, or t
  modified_base (386)..(390): a, c, t, g, unknown or other
  misc_feature (386)..(390): n is a, c, g, or t
tcagcacgctacgtcacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtacaccaagtacaggaatataacctgtttcccatcgactacgcctttcggcctcgccttaggggtcgactcaccctgccccgattaacgttgacaggaacccttggtcttccggngagcgggctggcaaggcgcatagnnnnn

SEQ ID NO: 163275 - DNA, 395 bp, Homo sapiens
  misc_feature: GYAE6OF02FGP6J.30.57.F02.1.454.CMB.1.raw
  modified_base (326)..(326): a, c, t, g, unknown or other
  misc_feature (326)..(326): n is a, c, g, or t
  modified_base (385)..(395): a, c, t, g, unknown or other
  misc_feature (385)..(395): n is a, c, g, or t
tcagcacgctacgtcacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatacgccttctccgtccccccttgcagtaacaccaagtacaggaatattaacctgtttcccatcgactacgcctttcggcctcgccttaggggtcgactcaccctnccccgattaacgtgacaggacccttggcttccggcgagcgggctggcaaggcgcatagnnnnnnnnnnn

SEQ ID NO: 163276 - DNA, 394 bp, Homo sapiens
  misc_feature: GYAE6OF02HXY34.30.57.F02.1.454.CMB.1.raw
  modified_base (360)..(360): a, c, t, g, unknown or other
  misc_feature (360)..(360): n is a, c, g, or t
  modified_base (378)..(378): a, c, t, g, unknown or other
  misc_feature (378)..(378): n is a, c, g, or t
  modified_base (384)..(394): a, c, t, g, unknown or other
  misc_feature (384)..(394): n is a, c, g, or t
tcagcacgctacgtcacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttgcagtaacaccaagtacaggaatattaacctgttccatcgactacgcctttcggcctcgccttagggtcgactcaccctgccccgattaacgttggacaggaacccttggtcttccggngagcgggctggcaaggcncatagnnnnnnnnnnn

SEQ ID NO: 163277 - DNA, 406 bp, Homo sapiens
  misc_feature: GYAE6OF02IZEXO.30.57.F02.1.454.CMB.1.raw
  modified_base (384)..(384): a, c, t, g, unknown or other
  misc_feature (384)..(384): n is a, c, g, or t
  modified_base (390)..(406): a, c, t, g, unknown or other
  misc_feature (390)..(406): n is a, c, g, or t
tcagcacgctacgtcacgaccggtgctcgatttagctcgatatagttgggtttggggtacgatttgatgttacctgatgcttagaggcttttcctggaagcagggcattttgttgcttcagcaccgtagtgcctcgtcatcacgcctcagccttgattttccggatttgcctaggaaaaccagccctacacgaccttaaaaccgggacaacccgtcgcccggccaacatagccttctccgtcccccttcgcagtaacaccaagtacagaatattaacctgttcccatcgactacgcctttccgcctcgccttaggggcactcaccctgccccgattacgttggaccaggaacccttggcttccggcgacgcgggctggcaggcncatagnnnnnnnnnnnnnnnnn

SEQ ID NO: 163278 - DNA, 444 bp, Homo sapiens
  misc_feature: GYAE6OF02JSFEX.30.57.F02.1.454.CMB.1.raw
  modified_base (409)..(410): a, c, t, g, unknown or other
  misc_feature (409)..(410): n is a, c, g, or t
  modified_base (412)..(444): a, c, t, g, unknown or other
  misc_feature (412)..(444): n is a, c, g, or t
tcagcacgctacgtcacgaccggtgctcgatttagctcgatatagttgggtttgggggtacgatttgatgttacctgatgcttagaggcttttcctggaagcagggcatttgttgcttcagcaccgtagtgcctcgtcatcacgcctcagccttgatttttccggatttgcctggaaaaccagcctacacgcttaaaccgggacaaccgtcgcccggccaacatacgccttcctcccgtccccccttcgcacgtaacaccaagtacagaactattaacctcgttccatcgactacgcctttcgcctcgccgttagggtcgactccaccctcgacccccgattaacgttcggaacacggaaccccttggtccttccgggcgacggcgggctggcaacgggcgacatagcnncnnnnnnnnnnnnnnnnnnnnnnnnnnnnnnnnn

SEQ ID NO: 163279 - DNA, 189 bp, Homo sapiens
  misc_feature: GYAE6OF02F5582.30.57.F02.1.454.CMB.1.raw
  modified_base (156)..(189): a, c, t, g, unknown or other
  misc_feature (156)..(189): n is a, c, g, or t
tcagcacgctacgtcacgaccggtgctcgatttagctcgatataggttagggtttcgggaaggtggaaatcaaacgaactgtggctcgcaccatctgtcttcatcttcccgccatctgactacagttgctctgagcgggctggcaaggcgcatagnnnnnnnnnnnnnnnnnnnnnnnnnnnnnnnnnn

SEQ ID NO: 163280 - DNA, 171 bp, Homo sapiens
  misc_feature: GYAE6OF02JQRKB.30.57.F02.1.454.CMB.1.raw
  modified_base (150)..(171): a, c, t, g, unknown or other
  misc_feature (150)..(171): n is a, c, g, or t
tcagcacgctacgtcacgaccggtgctcgatttagctcgatatagttgggtttgggaaggtggaaatcaaacgaactgtggctgcaccatctgtcttcatcttcccgccatctgctacagtgctctgagcggctggacaaggcgcatagnnnnnnnnnnnnnnnnnnnnnn

SEQ ID NO: 163281 - DNA, 877 bp, Homo sapiens
  misc_feature: GYAE6OF02IBRSR.30.57.F02.1.454.CMB.1.raw
tcagcacgctacgtcacgaccggtgctcgatttagctcgatatagttgggtttggggtacgatttgatgttacctgatgcttagaggtcttttcctggaagtcagggtcatttgttgacttcagcacgtagtgcctcgtcatcacgtcctcagtccttgtacttttccggtattttcgaccgtaggaaaaacctagtcctaacaccggtacgttaaaaccggggacaaccgtccggacccggaccaaacgtagttacgccctttccgtccccgttcccccctttggacctaacggttaaaccaaccggtaaacgttaaccgaaagggtaaactttaaccgtttaaaccctttcggttttaccccaacgttccgaacccttacggtcccgtttttaccgggccccttacggtacccgtttaggggggtaccctaaccgttaccgacccccgtttaccggacccccgttaagtttttaaaacccggggttcgggtaaaaccccgtaaccggggtttaaaacccccggtttttaccgggttcccggttttaaccccggggggacgggtaaaccggggtcccgggggtaccgttaacggggttacccgtaaaacgggggtcccgaacctaaaaacgggtttcggacgttaaggaccgttagcggtactaacgtgtaacgttaccacgtacgacgtacgtagacgtacgaccgtagacgtacgtacgacgactacgtactacgtacgtacgtaacactacgtacgtactacgacgtagtacgtacgacgacgtacgtacgactacgtacgacgtagtacgtacgtacgtacgtacgtacgtacgtacgtacgtacgtacgtacgacgtacgtacgtagtacg

SEQ ID NO: 163282 - DNA, 176 bp, Homo sapiens
  misc_feature: GYAE6OF01EBQIO.47.55.E11.1.454.CMB.1.raw
  modified_base (175)..(176): a, c, t, g, unknown or other
  misc_feature (175)..(176): n is a, c, g, or t
tcagagctcacgtacacgaccggtgctcgatttagcactcgcacgttgggtttggggaaggaggaagactgacggccctgctccaggagcacctccgagagcacagcggccctgggctgcctggtcaaggactacttcctacgtgagctctgagcgggctggcaaggcgcatagnn

SEQ ID NO: 163283 - DNA, 573 bp, Homo sapiens
  misc_feature: GYAE6OF01EPB77.47.55.E11.1.454.CMB.1.raw
  modified_base (213)..(215): a, c, t, g, unknown or other
  misc_feature (213)..(215): n is a, c, g, or t
  modified_base (217)..(217): a, c, t, g, unknown or other
  misc_feature (217)..(217): n is a, c, g, or t
  modified_base (219)..(220): a, c, t, g, unknown or other
  misc_feature (219)..(220): n is a, c, g, or t
  modified_base (222)..(222): a, c, t, g, unknown or other
  misc_feature (222)..(222): n is a, c, g, or t
  modified_base (225)..(225): a, c, t, g, unknown or other
  misc_feature (225)..(225): n is a, c, g, or t
  modified_base (227)..(227): a, c, t, g, unknown or other
  misc_feature (227)..(227): n is a, c, g, or t
  modified_base (231)..(231): a, c, t, g, unknown or other
  misc_feature (231)..(231): n is a, c, g, or t
  modified_base (241)..(241): a, c, t, g, unknown or other
  misc_feature (241)..(241): n is a, c, g, or t
  modified_base (243)..(243): a, c, t, g, unknown or other
  misc_feature (243)..(243): n is a, c, g, or t
  modified_base (251)..(251): a, c, t, g, unknown or other
  misc_feature (251)..(251): n is a, c, g, or t
  modified_base (253)..(254): a, c, t, g, unknown or other
  misc_feature (253)..(254): n is a, c, g, or t
  modified_base (260)..(260): a, c, t, g, unknown or other
  misc_feature (260)..(260): n is a, c, g, or t
  modified_base (273)..(273): a, c, t, g, unknown or other
  misc_feature (273)..(273): n is a, c, g, or t
  modified_base (275)..(276): a, c, t, g, unknown or other
  misc_feature (275)..(276): n is a, c, g, or t
  modified_base (278)..(279): a, c, t, g, unknown or other
  misc_feature (278)..(279): n is a, c, g, or t
  modified_base (281)..(281): a, c, t, g, unknown or other
  misc_feature (281)..(281): n is a, c, g, or t
  modified_base (293)..(293): a, c, t, g, unknown or other
  misc_feature (293)..(293): n is a, c, g, or t
  modified_base (296)..(296): a, c, t, g, unknown or other
  misc_feature (296)..(296): n is a, c, g, or t
  modified_base (356)..(356): a, c, t, g, unknown or other
  misc_feature (356)..(356): n is a, c, g, or t
tcagagctcacgtacacgaccggtgctcgatttagcactcgcacgttgggatcggcaggcctccgacctggtccttacggtcttcggagcttggggaccaaggtcaccgtcctaggtcagcccaaggccaaaccccactgtcactcgtgtttcccggccctcctctacgtggtacgtcttctgtagttacggggctggctaaggcgcgatagnnngngnngnggngntgcngcgtgggtcngnctctctgncnnctctgntctctctatattntnntnncncgtcggtcgcgngcncgaggaggagtagatatgtctgtagtagtagtaagtagtagacgaataatatatatatanactaactacgtagtagaggagtagtactactacctactacgtacgtacgaactaactaacaacgaacacgtactacgtactactacgtaacgtacgacgacgtacgtacgagtacgtacgtacgacgacgacgtcgtacgtagttagttacgtggtagggaggtaggaggtaggtaaggtaggtaacggttagggttcgggtcgggtcgggtacggg

SEQ ID NO: 163284 - DNA, 475 bp, Homo sapiens
  misc_feature: GYAE6OF01BWP5T.47.55.E11.1.454.CMB.1.raw
  modified_base (468)..(475): a, c, t, g, unknown or other
  misc_feature (468)..(475): n is a, c, g, or t
tcagagctcacgtacacgaccggtgctcgatttagcactcgcacgttgggtcttgggcccagtctgtgctgactcagccaccctcagcgtctgggaccccgggcagacggtcaccatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccaaactgaccgtcctaggtcagccaaggctgcccctggtcactctgttcccgccctcctctacgtgagctctgagcgggctggcaaggcgcatagnnnnnnnn

SEQ ID NO: 163285 - DNA, 194 bp, Homo sapiens
  misc_feature: GYAE6OF01AYPVV.47.55.E11.1.454.CMB.1.raw
  modified_base (189)..(194): a, c, t, g, unknown or other
  misc_feature (189)..(194): n is a, c, g, or t
tcagagctcacgtacacgaccggtgctcgatttagcactcgcacgttgggatcgcagcctgactgcttacgtcttcggagctgggaccaaggtcaccgtcctaggtcacgcccaaggcccaaccccactgtcactctcgttcccgccctcctctacgtgagctctgagcgggctggcaaggcgcatagnnnnnn

SEQ ID NO: 163286 - DNA, 187 bp, Homo sapiens
  misc_feature: GYAE6OF01AYQ7Y.47.55.E11.1.454.CMB.1.raw
  modified_base (185)..(187): a, c, t, g, unknown or other
  misc_feature (185)..(187): n is a, c, g, or t
tcagagctcacgtacacgaccggtgctcgatttagcactcgcacgttgggatcgcagcctgactgcttacgtcttcggagctgggaccaaggtcaccgtcctaggtcagcccaaggccaacccactgtcactctgttcccaccctcctctacgtgagctctgagcgggctggcaaggcgcatagnnn

SEQ ID NO: 163287 - DNA, 127 bp, Homo sapiens
  misc_feature: GYAE6OF01CJ08A.47.55.E11.1.454.CMB.1.raw
  modified_base (125)..(127): a, c, t, g, unknown or other
  misc_feature (125)..(127): n is a, c, g, or t
tcagagctcacgtacacgaccggtgctcgatttagcactcgcacgttgggtttggtgccgaagttgctgcctggtcaaggactacttcctacgtgagctctgagcgggctggcaaggcgcatagnnn

SEQ ID NO: 163288 - DNA, 189 bp, Homo sapiens
  misc_feature: GYAE6OF01BBJP5.47.55.E11.1.454.CMB.1.raw
  modified_base (186)..(189): a, c, t, g, unknown or other
  misc_feature (186)..(189): n is a, c, g, or t
tcagagctcacgtacacgaccggtgctcgatttagcactcgcacgttgggatcgcagcctgactgcttacgtcttcggagctgggaccaaggtcaccgtcctaggtcagcccaaggccaaccccactgtcactctgttcccaccctcctctacgtgagctctgagcgggctggcaaggcgcatagnnnn

SEQ ID NO: 163289 - DNA, 126 bp, Homo sapiens
  misc_feature: GYAE6OF01A74IH.47.55.E11.1.454.CMB.1.raw
  modified_base (126)..(126): a, c, t, g, unknown or other
  misc_feature (126)..(126): n is a, c, g, or t
tcagagctcacgtacacgaccggtgctcgatttagcactcgcacgttgggtttgggtgccgaagttactgcctggtcaaggactacttcctacgtgagctctgagcgggctggcaaggcgcatagn

SEQ ID NO: 163290 - DNA, 431 bp, Homo sapiens
  misc_feature: GYAE6OF01BMM6R.47.55.E11.1.454.CMB.1.raw
  modified_base (425)..(431): a, c, t, g, unknown or other
  misc_feature (425)..(431): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccagcctccaccaagggcccatcggtcttccccctggcgccctgctccaggagcacctccgagagcacagcggccctgggctgcctggtcaaggctactcctgagcgggctggcaaggcgcatagnnnnnnn

SEQ ID NO: 163291 - DNA, 183 bp, Homo sapiens
  misc_feature: GYAE6OF01EMWS4.47.55.E11.1.454.CMB.1.raw
  modified_base (175)..(183): a, c, t, g, unknown or other
  misc_feature (175)..(183): n is a, c, g, or t
tcagagctcacgtacacgaccggtgctcgatttagcactcgcacgttgggtttgggggaagaggaagactgacggccctgctccaggagcacctccgagagcacagcggccctgggctgcctggtcaaggactacttcctacgtgagctctgagcgggctggcaaggcgcatagnnnnnnnnn

SEQ ID NO: 163292 - DNA, 518 bp, Homo sapiens
  misc_feature: GYAE6OF01E37YM.47.55.E11.1.454.CMB.1.raw
  modified_base (205)..(205): a, c, t, g, unknown or other
  misc_feature (205)..(205): n is a, c, g, or t
  modified_base (347)..(347): a, c, t, g, unknown or other
  misc_feature (347)..(347): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccggnagacggtcaccatctcttgttctggaagcagctccaatatcggaaatgataatgtatactggtaccagcaagtcccacgaacggccccaaactcctcatctataacaatgatcagcggccctcagggtccctggccgattcnctggctccaagtctggcgcctcagccaccctggccatcagtgggctccggcccgaggatgagctgattattactgtgtaggttgggatcgcagcctgactgcttacgtcttcggagtcgtcgggaccaaggtccaccgtcctaggtcagacccaaggcccaaccccgtacg

SEQ ID NO: 163293 - DNA, 125 bp, Homo sapiens
  misc_feature: GYAE6OF01A8FDF.47.55.E11.1.454.CMB.1.raw
tcagagctcacgtacacgaccggtgctcgatttagcactcgcacgttgggtttgggtgccgaagttgctgcctggtcaaggactacttcctacgtgagctctgagcgggctggcaaggcgcatag

SEQ ID NO: 163294 - DNA, 175 bp, Homo sapiens
  misc_feature: GYAE6OF01BLBNW.47.55.E11.1.454.CMB.1.raw
  modified_base (175)..(175): a, c, t, g, unknown or other
  misc_feature (175)..(175): n is a, c, g, or t
tcagagctcacgtacacgaccggtgctcgatttagcactcgcacgttgggtttgggggaagaggaagactgacggccctgctccaggagcacctccgagagcacagcggccctgggctgcctggtcaaggactacttcctacgtgagctctgagcgggctggcaaggcgcatagn

SEQ ID NO: 163295 - DNA, 500 bp, Homo sapiens
  misc_feature: GYAE6OF01EAJCS.47.55.E11.1.454.CMB.1.raw
  modified_base (364)..(364): a, c, t, g, unknown or other
  misc_feature (364)..(364): n is a, c, g, or t
  modified_base (484)..(485): a, c, t, g, unknown or other
  misc_feature (484)..(485): n is a, c, g, or t
  modified_base (487)..(500): a, c, t, g, unknown or other
  misc_feature (487)..(500): n is a, c, g, or t
tcagagctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggccccaaactcctcatctataacaatgatcagcggccctcaggggtccctggccgattctctggctccaagtctggcgcctcagccaccctggccatcagtgggctccggcccgaggatgaggctgattattactgtgtaggttggatcgcagcctgactgcttacgtcttcgganctgggaccaaggtcaccgtctaggtcagcccaaggcccaacccatgtccactctcgttccccgccctcctctacgtgacgtcctcgtggacgccgggtctgggccaagggccgacatagnngnnnnnnnnnnnnnn

SEQ ID NO: 163296 - DNA, 520 bp, Homo sapiens
  misc_feature: GYAE6OF01CPVQ2.47.55.E11.1.454.CMB.1.raw
  modified_base (425)..(425): a, c, t, g, unknown or other
  misc_feature (425)..(425): n is a, c, g, or t
  modified_base (505)..(520): a, c, t, g, unknown or other
  misc_feature (505)..(520): n is a, c, g, or t
tcagagctcacgtacacgaccggtgctcgatttagcactcgcacgttgggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagccggccctcgacggggtccctggccgattctctggctccaagtctggccgcctcacgcccaccctggccatcagtgggcctccggcccgaggatggaggctgatttattactgtgtaggttggatcgcagcctgactgctttacgtcttcggagcgtgggaccaaggtccaccgtcctaggtccacgcccaaggccccaacccnctgtccactctcgttcccccgcccttcctctacgtgacgtcctcgtggacgccgggtctgggaccaagggccgcagtagnnnnnnnnnnnnnnnn

SEQ ID NO: 163297 - DNA, 149 bp, Homo sapiens
  misc_feature: GYAE6OF01D6SNH.47.55.E11.1.454.CMB.1.raw
  modified_base (132)..(149): a, c, t, g, unknown or other
  misc_feature (132)..(149): n is a, c, g, or t
tcagagctcacgtacacgaccggtgctcgatttagcactcgcacgttgggtttagggtgccgaagttagacctgcctgggtcaaggactacttcctacgtgagctctgagcgggcctggcaaggcgcatagnnnnnnnnnnnnnnnnnn

SEQ ID NO: 163298 - DNA, 509 bp, Homo sapiens
  misc_feature: GYAE6OF01DDLG9.47.55.E11.1.454.CMB.1.raw
  modified_base (267)..(267): a, c, t, g, unknown or other
  misc_feature (267)..(267): n is a, c, g, or t
  modified_base (494)..(495): a, c, t, g, unknown or other
  misc_feature (494)..(495): n is a, c, g, or t
  modified_base (497)..(509): a, c, t, g, unknown or other
  misc_feature (497)..(509): n is a, c, g, or t
tcagagctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcncctcagccacctggccatcagtgggctccggccgaggatggaggctgattattactgtgtaggttgggatcgcagcctgactgctttacgtcttcgggagtcgtgggaccaagggtccaccgtcctaggtcacgcccaaggcccaaccccactcgtccactctcgttccccacccttcctctacgtgacgcctctggacggcgggctggccaagggccgacagtagnngnnnnnnnnnnnnn

SEQ ID NO: 163299 - DNA, 484 bp, Homo sapiens
  misc_feature: GYAE6OF01CDH66.47.55.E11.1.454.CMB.1.raw
  modified_base (409)..(409): a, c, t, g, unknown or other
  misc_feature (409)..(409): n is a, c, g, or t
  modified_base (468)..(468): a, c, t, g, unknown or other
  misc_feature (468)..(468): n is a, c, g, or t
  modified_base (473)..(484): a, c, t, g, unknown or other
  misc_feature (473)..(484): n is a, c, g, or t
tcagagctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccacctggccatcagtgggctccggcccgaggatgaggctgattattactgtgtaggttgggatcgcagcctgactgcttacgcttcggagctgggaccaaggtcaccgtctaggtcacgcccaaggcccaacccnctcgtcactctcgttccccgccctcctctacgtgacgctctgacgcgggctggcaggcncatgnnnnnnnnnnnn

SEQ ID NO: 163300 - DNA, 515 bp, Homo sapiens
  misc_feature: GYAE6OF01BD3SQ.47.55.E11.1.454.CMB.1.raw
  modified_base (205)..(205): a, c, t, g, unknown or other
  misc_feature (205)..(205): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccggnagacggtcaccatctcttgttctggaagcagctccaatatcggaaatgataatgtatactggtaccagcaagtcccacgaacggcccccaaactcctcatctataacaatgatcagcggccctcacggggtccctggccgattctctggctccaagtctggcgcctcagcccaccctggccatcagtcgggctccggcccgaggatggaggctgattattactgtgtaggttggatcgcagcctgactgcttacgtcttcggagcgtgggaccaggtcaccgtccaggtcagcccaaggcccaaccctac

SEQ ID NO: 163301 - DNA, 175 bp, Homo sapiens; identical to SEQ ID NO: 163294
  misc_feature: GYAE6OF01EXRUQ.47.55.E11.1.454.CMB.1.raw
  modified_base (175)..(175): a, c, t, g, unknown or other
  misc_feature (175)..(175): n is a, c, g, or t

SEQ ID NO: 163302 - DNA, 643 bp, Homo sapiens
  misc_feature: GYAE6OF01BO9RH.47.55.E11.1.454.CMB.1.raw
  modified_base (210)..(210): a, c, t, g, unknown or other
  misc_feature (210)..(210): n is a, c, g, or t
  modified_base (236)..(236): a, c, t, g, unknown or other
  misc_feature (236)..(236): n is a, c, g, or t
  modified_base (247)..(247): a, c, t, g, unknown or other
  misc_feature (247)..(247): n is a, c, g, or t
  modified_base (343)..(343): a, c, t, g, unknown or other
  misc_feature (343)..(343): n is a, c, g, or t
  modified_base (353)..(353): a, c, t, g, unknown or other
  misc_feature (353)..(353): n is a, c, g, or t
  modified_base (377)..(377): a, c, t, g, unknown or other
  misc_feature (377)..(377): n is a, c, g, or t
tcagagctcacgtacacgaccggtgctcgatttagcactcgcacgttgggttggggaggctgtggttagagaagacaggattcaggacaatctccagcaataggccggcttccctctcctcctcaccctcctcactcactgtgccagggtcttgggcccagtcctgtgctgactcagcccaccctcaggccgtcgtcgggacccccgggnagaccggtcaccatctcttgtctgancagctccaatntcgaaatgataatgtatactggtaccagcaagtcccacgaccgcccccaaactcctcagtcgtataacaatgatcgagccgtccctgagggtcccnggccacttcnctcggcctaccgaagtctcggccnccctcacgccccacccgtcggacccactaccgacggtcgggtccctccccgggacccgaaggactcggaacgggccttaggtaactttacgttacccgtggtggttaacgggtttacgggacttccgcgtacgtcccgtagtacgttcgtacgttaccggtccgttcgggacgtccggtagggtaaccctagggttccaacccggttcgttacggtcaacggtaccccgaagggtacccccaaaccccgtagttccgtccgtaccg

SEQ ID NO: 163303 - DNA, 550 bp, Homo sapiens
  misc_feature: GYAE6OF01C4IU2.47.55.E11.1.454.CMB.1.raw
  modified_base (403)..(403): a, c, t, g, unknown or other
  misc_feature (403)..(403): n is a, c, g, or t
  modified_base (534)..(535): a, c, t, g, unknown or other
  misc_feature (534)..(535): n is a, c, g, or t
  modified_base (537)..(543): a, c, t, g, unknown or other
  misc_feature (537)..(543): n is a, c, g, or t
  modified_base (545)..(550): a, c, t, g, unknown or other
  misc_feature (545)..(550): n is a, c, g, or t
tcagagctcacgtacacgaccggtgctcgatttagcactcgcacggtagggtcttgggcccagtctgtgctgactcagccacccttcgagcgtctgggacccccgggctagacggtcaccattactcttgttctggaagcagctccaatatcggaaatggataatgtatactggtaccgagcaagtcccacgaacggccccaaatcctcatctataacaatgatcagcggccctcaggggtccctggcccgagtttcctctggcctccgaaaggtccgtggcgccttcgagcccaccctggaccaatcgaggtgggccttcccggcccgaggatggacggctggagtttacttactgtgtaggttgggatcgacacgcctggactgacttacgtcttcgggancgtgggaacctaagggtccaccgtccgtacggtcaacggcccgaaggccccaaaccccacgtcgtctacttctcgttccccgcccttcctctacgtcgacgctctgagtcgggctggtcaggtcgcagagnngnnnnnnncnnnnnn

SEQ ID NO: 163304 - DNA, 441 bp, Homo sapiens
  misc_feature: GYAE6OF01ASF4C.47.55.E11.1.454.CMB.1.raw
  modified_base (433)..(441): a, c, t, g, unknown or other
  misc_feature (433)..(441): n is a, c, g, or t
tcagagctcacgtacacgaccggtgctcgatttagcactcgcacgttgggtttggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccagcctccaccaagggcccatcggtctcccctggcgccctgctccaggagcacctccgagagcacagcggccctggctgcctggtcaaggctacttcctacgtgagctctgagcgggctggcaaggcgcatagnnnnnnnnn

SEQ ID NO: 163305 - DNA, 127 bp, Homo sapiens
  misc_feature: GYAE6OF01DQJV3.47.55.E11.1.454.CMB.1.raw
  modified_base (126)..(127): a, c, t, g, unknown or other
  misc_feature (126)..(127): n is a, c, g, or t
tcagagctcacgtacacgaccggtgctcgatttagcactcgcacgttgggtttgggtgccgaagttgctgcctggtcaaggactacttcctatgtatactctgagcgggctggcaaggcgcatagnn

SEQ ID NO: 163306 - DNA, 175 bp, Homo sapiens; identical to SEQ ID NO: 163294
  misc_feature: GYAE6OF01EUDJZ.47.55.E11.1.454.CMB.1.raw
  modified_base (175)..(175): a, c, t, g, unknown or other
  misc_feature (175)..(175): n is a, c, g, or t

SEQ ID NO: 163307 - DNA, 523 bp, Homo sapiens
  misc_feature: GYAE6OF01CFR2T.47.55.E11.1.454.CMB.1.raw
  modified_base (192)..(192): a, c, t, g, unknown or other
  misc_feature (192)..(192): n is a, c, g, or t
  modified_base (498)..(498): a, c, t, g, unknown or other
  misc_feature (498)..(498): n is a, c, g, or t
tcagagctcacgtacacgaccggtgctcgatttagcactcgcacgttgggtttggggagagaagacaggattcaggacaatctccagcatggccggcttccctctcctcctcaccctcctcactcactgtgcagggtcttgggcccagtctgtgctgactcagccaccctcagcgtctggggacccccgggnagacggtcaccatctcttgttctggaagcagctccaatatcggaaatgataatgtatactggtaccagcaagtcccacgaacggccccaaatcctcatctataacaatgatcagcggccctcaggggtccctggccgattctctggctccaagtctggcgcctcacgccaccctggccatcaggtggctccggccgaggatgaggctgattatacgtgtgtaggtggatcgcagcctgactgcttacgtcttcggatcgtggaccaggtccaccggtcctaggtcacgcccaaggcccaaaccccnctcgtccactcctgttcccctaccc

SEQ ID NO: 163308 - DNA, 513 bp, Homo sapiens
  misc_feature: GYAE6OF01BB9OQ.47.55.E11.1.454.CMB.1.raw
  modified_base (215)..(215): a, c, t, g, unknown or other
  misc_feature (215)..(215): n is a, c, g, or t
  modified_base (503)..(503): a, c, t, g, unknown or other
  misc_feature (503)..(503): n is a, c, g, or t
tcagagctcacgtacacgaccggtgctcgatttagcactcgcacgttgggtttgggggggaagctcagcttcagctatggtagagaagacaggattcaggacaatctccagcatggccggcttccctctcctcctcaccctcctcactcactgtgcagggtcttgggcccagtctgtgctgactcagccaccctcagcgtctgggacccccgggnagacggtcaccatctcttgttctggaagcagctccaatatcggaaatgataatgtatactggtaccagcaagtcccacgaacggccccaaactcctcatctataacaatgatcagcggcctcaggggtccctggccgatctctggctccaagtctggcgcctcacgccaccctggcccatcagtgggctccggcccgaggatgaggctgattattactgtgtaggttgggatcgcagcctgactgcttacgtcttcggagcgtgggaccaaggtcaccgtcctaggcngcccgaacgg

SEQ ID NO: 163309 - DNA, 202 bp, Homo sapiens
  misc_feature: GYAE6OF01EPZCA.47.55.E11.1.454.CMB.1.raw
  modified_base (176)..(202): a, c, t, g, unknown or other
  misc_feature (176)..(202): n is a, c, g, or t
tcagagctcacgtacacgaccggtgctcgatttagcactcgcacgttgggttggggggaagaggaagactgacggccctgcgtccaggagcacctccgagagcacagcggccctgggctgcctggtcaaggactacttcctacgtgagctctgagcgggctggcaaggcgcatagnnnnnnnnnnnnnnnnnnnnnnnnnnn

SEQ ID NO: 163310 - DNA, 749 bp, Homo sapiens
  misc_feature: GYAE6OF01CKQAO.47.55.E11.1.454.CMB.1.raw
tcagagctcacgtacacgaccggtgctcgatttagcactcgcacgttgggtttggggccgcagccctgggattcccagctgtttctgcttgctgatcaggactgcacacagagagctcaccatggagtctgggctgagcggtgtttcgtgtaggctctttaaagtgcagtgtgagtgcaggtgtggagtcggggagcttagtcagccgtgggatccgtgagctctcctgtagtcgtctcgtaggaacttcgtaagttttccgaagttaccttgtggattccgtaacgacgttcggggccctaaccctaaaagtccgtaagggtaagggcgtggtggtgggtcgttccgacgtaatcaatccttaggtagtcgtagtagttaagttaagttaagttagtacggtacggtacggtaccggtacgggtacgggtacggtacgtacgtacgtacgtacgtaccgtaccgtaacggtaacgaaaccgaacggaacgtaaacgtaacgtaacgttaacgttaacgttaacgttaacgtaagtaaagtaacgtaacgtaacgtacgtaacggtaacggtaacggtaaccggtaacggtaacgttaacggtacgttacgttacgttaacgttacgttacgtttacggtttacggtttacgttacgttaccggttcccggttacccggttacccgggttaccgggttaccggttaccgggttaccgggtacccgggtaacccgggtacccggtaccgg

SEQ ID NO: 163311 - DNA, 542 bp, Homo sapiens
  misc_feature: GYAE6OF01C827Z.47.55.E11.1.454.CMB.1.raw
  modified_base (191)..(191): a, c, t, g, unknown or other
  misc_feature (191)..(191): n is a, c, g, or t
tcagagctcacgtacacgaccggtgctcgatttagcactcgcacgttgggtttggggagagaagacaggattcaggacaatctccagcatggccggcttccctctcctcctcaccctcctcactcactgtgcagggtcttgggcccagtctgtgctgactcagccaccctcagcgtctcgggacccccggnagacggtcaccatctcttgttctggaagcagctccaatatcggaaatgataatgtatactggtaccagcaagtcccacgaacggccccaaactcctcatctataacaatgatcagcggccctcaggggtccctggccgattctctggctccaagtctggcgcctcacgcccaccctggccatcagtgggctccggcccgaggatgaggctgattatactgtgtaggttggatcgcagcctgactgtcctttacgtcttcggagtcgtgggaccaaggtcacccggtccgtaggtccagcccaaacgggccccaacccccacgtcgtaccaccttctcgttcccccgtcccc

SEQ ID NO: 163312 - DNA, 547 bp, Homo sapiens
  misc_feature: GYAE6OF01AJUB8.47.55.E11.1.454.CMB.1.raw
  modified_base (206)..(206): a, c, t, g, unknown or other
  misc_feature (206)..(206): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccgggnagacggtcaccatctcttgttctggaagcagctccaatatcggaaatgataatgtatactggtaccagcaagtcccacgaacggcccccaaactcctcatctataacaatgatcagcggccctcacggggtccctggccgattctctggctccaagtctggcgcctcagcccaccctggccatccgagtcgggcctccggcccgaggatgaggctgattattactgtgtaggttgggatcggcagcctgactgctttacgtcgttcgggagcgtcgggacccaaggttcccgaacccgttcccgtaggtccacggaccccaacgggccccaaccccgtacg

SEQ ID NO: 163313 - DNA, 345 bp, Homo sapiens
  misc_feature: GYAE6OF01CJWXY.47.55.E11.1.454.CMB.1.raw
  modified_base (342)..(345): a, c, t, g, unknown or other
  misc_feature (342)..(345): n is a, c, g, or t
tcagagctcacgtacacgaccggtgctcgatttagcactcgcacgttgggttttccttgttgctcttttaaaaggtgtccagtgtgaggtgcaggtagtggagtccggggaggcttagttcagcctggggagtccctgagactctcctgtgtagtctctggaatcagtttcagtaccttctggatgcactgggtccgccaaactccagcctccaccaagggcccatcggtcttcccctggcgccctgctccaggagcacctccgagagcacagcggccctgggctgcctggtcaaggactacttcctacgtgagctctgagcgggctggcaaggcgcatagnnnn

SEQ ID NO: 163314 - DNA, 570 bp, Homo sapiens
  misc_feature: GYAE6OF01B4W7J.47.55.E11.1.454.CMB.1.raw
  modified_base (191)..(191): a, c, t, g, unknown or other
  misc_feature (191)..(191): n is a, c, g, or t
  modified_base (482)..(482): a, c, t, g, unknown or other
  misc_feature (482)..(482): n is a, c, g, or t
  modified_base (534)..(534): a, c, t, g, unknown or other
  misc_feature (534)..(534): n is a, c, g, or t
tcagagctcacgtacacgaccggtgctcgatttagcactcgcacgttgggtttggggagagaagacaggattcaggacaatctccagcatggccggcttccctctcctcctcaccctcctcactcactgtgcagggtcttgggcccagtctgtgctgactcagccaccctcagcgtctcgggacccccggnagacggtcaccatctcttgtctggaagcagctcaatatcggaaatgataatgtatactggtaccagcaagtcccaacgaaccggccccaaactcctcatctaataaacaatgatcagccggcctcgacggggtccctggccgattctcgtggcctccaagtctggccgcctcacgcccaccctggccatcaggtcgggcctcccggccgaggatcggaggtctagtattacttacgtggtgttagggttgggatcgcgagccgtgactgtcctttacgtccgttacgggancgtagggaaccaaggtccaccgtctaggtccaaggcccaaggccccaacccncgtcgtacctaccgttcctccggttcccccgtcccc

SEQ ID NO: 163315 - DNA, 574 bp, Homo sapiens
  misc_feature: GYAE6OF01DBCA0.47.55.E11.1.454.CMB.1.raw
  modified_base (269)..(269): a, c, t, g, unknown or other
  misc_feature (269)..(269): n is a, c, g, or t
  modified_base (520)..(520): a, c, t, g, unknown or other
  misc_feature (520)..(520): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagcgtggtttctgtgctctttaaagtgtcagtgtgaggtgcaggtagtggagtccgggggaggcttagttcagccgtggggatccctgagactctcctgtgtagtctctggaatctagtttcagttaccttntggatgcacgtgggtccaccaaaacgtccgaagggtaacggggctggtggtgggtctcgtacgtatcaatccgtgagtggactaggtagtttaataaaattgtggccggtaactcggtaggacggggtccattcgagctatctacgagagacaacggacaagtagtatactgtaatcgtagaaatagaaactaatgtagaagtacgtacgaacgtaagtacggtctagtactaagtctagttcgtttacgntcgtccgttcggcgacggttcttcgggacggaccgacgggtacccgtggtaccg

SEQ ID NO: 163316 - DNA, 509 bp, Homo sapiens
  misc_feature: GYAE6OF01E55B4.47.55.E11.1.454.CMB.1.raw
  modified_base (206)..(206): a, c, t, g, unknown or other
  misc_feature (206)..(206): n is a, c, g, or t
  modified_base (364)..(364): a, c, t, g, unknown or other
  misc_feature (364)..(364): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccgggnagacggtcaccatctcttgttctggaagcagctccaatatcggaaatgataatgtatactggtaccagcaagtccacgaacggcccccaaactcctcatctataacaatgatcagcgccctcagggtccctggccgattctctggctcaagtctggcncctcagccaccctggccatcagtgggctccggcccgaggatgaggctgattattactgtgtaggttggatcgcagcctgactgcttacgtcttcggagcgtgggacaaggtcaccgtcctacggtcagcccaaggccaaccctcg

SEQ ID NO: 163317 - DNA, 547 bp, Homo sapiens
  misc_feature: GYAE6OF01ECCMT.47.55.E11.1.454.CMB.1.raw
tcagagctcacgtacacgaccggtgctcgatttagcactcgcacgttgggtttgggggagccgcagccctgggattcccagctgtttctgcttgctgatcaggactgcacacagagagctcaccatggagtctgggctgagctgggttttcctgttgctctttaaaggtgtccagtgtgaggtgcaggtagtggagtccgggggaggcttagttcagcctggggagtccctgagactctcctgtgtagtctctggaatcagtttcagtaccttctggatgcactgggtccgccaaactccgagggtaaggggctggtgtgggtctcacgtatcaatcctgatggcagtgttataaattatgcggactccgtgaggggccattcagcatctccagagacaacggcaaagagtatactgtatcgtaggaaatgaacaatctgaagagtcgaacgatacggcttgtactatctatttgttcgttttcgagttcgtcccgtttcgggtcccggtcgggtaacctttcggcgggggcccaggggtaaccccg

SEQ ID NO: 163318 - DNA, 524 bp, Homo sapiens
  misc_feature: GYAE6OF01BY0WQ.47.55.E11.1.454.CMB.1.raw
tcagagctcacgtacacgaccggtgctcgatttagcactcgcacgttgggtttgggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactcgtgaggggccattcagcatctccagagacaacggcaagagtatactgtatctaggaaatgaacaatctagagagtacgacgatacggctgtctatctattgtgttttcgattgccttcgggtccgcgggtacttgtggggcccgagggtaacccg

SEQ ID NO: 163319 - DNA, 126 bp, Homo sapiens
  misc_feature: GYAE6OF01DEVRD.47.55.E11.1.454.CMB.1.raw
  modified_base (126)..(126): a, c, t, g, unknown or other
  misc_feature (126)..(126): n is a, c, g, or t
tcagagctcacgtacacgaccggtgctcgatttagcactcgcacgttgggtttgggtgccgaagttgctgcctggtcaaggactacttcctacgtgagctctgagcgggctggcaaggcgcatagn

SEQ ID NO: 163320 - DNA, 548 bp, Homo sapiens
  misc_feature: GYAE6OF01A176H.47.55.E11.1.454.CMB.1.raw
  modified_base (206)..(206): a, c, t, g, unknown or other
  misc_feature (206)..(206): n is a, c, g, or t
  modified_base (312)..(312): a, c, t, g, unknown or other
  misc_feature (312)..(312): n is a, c, g, or t
  modified_base (455)..(455): a, c, t, g, unknown or other
  misc_feature (455)..(455): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctcgggacccccggnagacggtcaccatctcttgttctggaagcagctccaatatcggaaatgataatgtatactggtaccagcaagtccccacgaaccggcccccaaactcctcatctanaacatgatcagcgcctcgacgggtccctggccgattctctggcctccaagtctggccgcctcacgcccacccgtggcccatcaggtcgggcctccgggcccgaggactggacggctgatttatactgtgtaggttgggatcgntagcctgactcgcttaccgtcttcggagtccgtcgggaccaggtccacccggtcctacgggtccacggaccccaacggccccaaccccgtacg

SEQ ID NO: 163321 - DNA, 501 bp, Homo sapiens
  misc_feature: GYAE6OF01EVBGX.47.55.E11.1.454.CMB.1.raw
  modified_base (488)..(488): a, c, t, g, unknown or other
  misc_feature (488)..(488): n is a, c, g, or t
  modified_base (493)..(501): a, c, t, g, unknown or other
  misc_feature (493)..(501): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggccagggaaccctggtcagcgtctcctcacgcctccaccaacgggcccagtccggtccttccccctggccgccctgcctcccaggacgccacctccgagacgcacaggccggcccctgggcctgccctgggtccaagggacctacttcctactgagctctgagcgggctggcaaggcncatgnnnnnnnnn

SEQ ID NO: 163322 - DNA, 589 bp, Homo sapiens
  misc_feature: GYAE6OF01CG8CY.47.55.E11.1.454.CMB.1.raw
  modified_base (206)..(206): a, c, t, g, unknown or other
  misc_feature (206)..(206): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctcgggacccccggnagacgtcaccatctcttgttctggaagcagctccaatatacggaaatgataatgtatactggtaccagacaacgtcccaacgaaccggacccccaaactcctcatctataacaatgatcagccgcctcgagggtccctggccgtattctctggctccgaagtctagccgcctcacgccacccgtcggacccatccgaggtcgggcccgtcccgggacccgaggagtggacggtccttagtaatttactttacgttggttaggttagggtttgggaacttcggactacggccttagactcgtacgtttaccgtcgttcggacgtcgtcgggacctaacggtccaccggtcctaggtccacggacccacggcccaaccccgtacg

SEQ ID NO: 163323 - DNA, 575 bp, Homo sapiens
  misc_feature: GYAE6OF01BGCFG.47.55.E11.1.454.CMB.1.raw
  modified_base (555)..(555): a, c, t, g, unknown or other
  misc_feature (555)..(555): n is a, c, g, or t
  modified_base (557)..(557): a, c, t, g, unknown or other
  misc_feature (557)..(557): n is a, c, g, or t
  modified_base (561)..(565): a, c, t, g, unknown or other
  misc_feature (561)..(565): n is a, c, g, or t
  modified_base (567)..(575): a, c, t, g, unknown or other
  misc_feature (567)..(575): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggagcttagttcagcctggggagtccctgagactctcctgtgtagtctctggaatcagtttcagtaccttctggatgcacgtgggtccgaccaaactccgaggtaagggccacgggaaccctggtcagcgtctcctcacgcctccaccaaacgggcccaagtccggtccttcccccgtggccgccctgcctccgaggacgccaccgtccgagacgccacgacggccggccccgtgggcctcggcccgtcgggtaccgtaaacgggacccttaccgtttcccgtaacggtcgacccttcgtcggaacgggtcccgggacgttcggggaccaaagggcccgacgaacgtagcgngngcgnnnnngnnnnnnnnn

SEQ ID NO: 163324 - DNA, 656 bp, Homo sapiens
  misc_feature: GYAE6OF01DDYWK.47.55.E11.1.454.CMB.1.raw
  modified_base (269)..(269): a, c, t, g, unknown or other
  misc_feature (269)..(269): n is a, c, g, or t
  modified_base (354)..(354): a, c, t, g, unknown or other
  misc_feature (354)..(354): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcacctcctcactcactgtgcagggtcttgggcccagtctgtgctgactcagccaccctcagcgtctcgggaccccggcagacggtcaccatctcttgttctggagcagctccaatatcggaatgataatgtatactggtaccngacaacgtcccaacgaaccggacccccaaactcctacactactaataacaatgatcagccgcctcgacgggtcctggcctattcncgtggcctaccaagtcgtggccgcctcgacgcccacccgtcggaccatcgacggtcgggccctcccgggcccgaggtagtcggacggtctgtaactttagttacgttgttagggttagggtttcgggacgttccggcgtaacggtcccttaggtaaccgttcggtaccgttttacggtccgtttacgggacggtaccggttacggggtaacccgtaaacgggttcccgaaccccggttccgttaaccggggtacctaacccggaacccccgaaaccgggtaccccccaaacccccgttacgg

SEQ ID NO: 163325 - DNA, 126 bp, Homo sapiens
  misc_feature: GYAE6OF01C5ATQ.47.55.E11.1.454.CMB.1.raw
  modified_base (126)..(126): a, c, t, g, unknown or other
  misc_feature (126)..(126): n is a, c, g, or t
tcagagctcacgtacacgaccggtgctcgatttagcactcgcacgttgggtttgggtgccgaagttgctgcctggtcaaggactacttcctatgtatactctgagcgggctggcaaggcgcatagn

SEQ ID NO: 163326 - DNA, 607 bp, Homo sapiens
  misc_feature: GYAE6OF01CD8ZU.47.55.E11.1.454.CMB.1.raw
  modified_base (208)..(208): a, c, t, g, unknown or other
  misc_feature (208)..(208): n is a, c, g, or t
  modified_base (248)..(248): a, c, t, g, unknown or other
  misc_feature (248)..(248): n is a, c, g, or t
  modified_base (356)..(356): a, c, t, g, unknown or other
  misc_feature (356)..(356): n is a, c, g, or t
  modified_base (374)..(374): a, c, t, g, unknown or other
  misc_feature (374)..(374): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagcccaccctcagcgtctcgggacccccgggnagacggtcaccatctcttgttctggaagcagctccaatancggaaatgaataatgtatactggtaccagcaacgtccccacgaaccgacccccaaactcctcatctaataaacatgatcagcggccctgacgggtcctggcctattcnctggctccaagtctggcncctcacgcccaccgtcggccatcgacggtcgggcctcccgggacccgaggacgtcgacggctagtatttacgttacgtggttacgttagggttgggactcggcgtagtccgtagacgttcgtacctttacggttccgttcgggacgtccggttacggggaaccctaacgggttcccgaacccggttccgtacggtaccgaaccggaccccgaaacggccccaaaccccgtacg

SEQ ID NO: 163327 - DNA, 537 bp, Homo sapiens
  misc_feature: GYAE6OF01D327G.47.55.E11.1.454.CMB.1.raw
tcagagctcacgtacacgaccggtgctcgatttagcactcgcacgttgggtttgggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttaataaattatgcggactccgtgaggggccattcagcatctccagagacaacggacaagagtatactgtatctaggaaatgaacaatctagagagtcgaacgatacggctgtctatctattggttgttttcgattcgtcccttcgggtcccgtcgggtacttcgtcggggcccgagggtaaccccg

SEQ ID NO: 163328 - DNA, 558 bp, Homo sapiens
  misc_feature: GYAE6OF01AKK4Y.47.55.E11.1.454.CMB.1.raw
  modified_base (205)..(205): a, c, t, g, unknown or other
  misc_feature (205)..(205): n is a, c, g, or t
  modified_base (302)..(302): a, c, t, g, unknown or other
  misc_feature (302)..(302): n is a, c, g, or t
  modified_base (369)..(369): a, c, t, g, unknown or other
  misc_feature (369)..(369): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccggnagacggtcaccatctcttgttctggaagcagctccaatatcggaaatgataatgtatactggtaccagcaagtcccacgaacggcccccaaactccncatctataacaatgatcagcggccctcgacgggtccctggccgattctctggctccaagtctggccncctcacgcccaccctggccatcaggtgggccctccgggcccgagggatcggacggtctgtattagttacgtggtggtaggttgggattcgcgtagtcctgactgtccttacgtcttcgggacgtcgtacgggaccctaagggtcccaaccgttccgtaggtccacgacccgaacgcccaaacccgtacg

SEQ ID NO: 163329 - DNA, 534 bp, Homo sapiens
  misc_feature: GYAE6OF01EKV05.47.55.E11.1.454.CMB.1.raw
  modified_base (357)..(357): a, c, t, g, unknown or other
  misc_feature (357)..(357): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtacttctggatgcactgggtccgccaaactccagggtaagggctggtgtgggtctcacgtatcaatcctgatggcagtgttataaattntgcggactcgtgagggcattcagcatctccagagacaacggcaagagtatactgtaatcgtaggaaatgaacaatctagagagtcgaagatacggctgtactatctagttgttgttttcgattcggtcccttgggtcccgcggggtacttcggtggggcctaaggggacccttcggg

SEQ ID NO: 163330 - DNA, 581 bp, Homo sapiens
  misc_feature: GYAE6OF01BPN0C.47.55.E11.1.454.CMB.1.raw
tcagagctcacgtacacgaccggtgctcgatttagcactcgcacgttgggttttccttgttgctcttttaaaaggtgtccagtgtgaggtgcaggtagtggagtccggggaggcttagttcagcctggggagtccctgagactctcctgtgtagtctctggaatcagtttcagtaccttctggatgcactgggtccgccaaactccaggtaagggctggtgtgggtctcacgtatcaatcctgatggcagtgttataaattatgcggactccgtgaggggccattcagcatctccagagacaacggcaagagtatactgtatctaggaaatgaacatctgagagtcgagatacggctgtctatcatttcgtttcgatgtccttcggtccgcgggtacttcggtcggggccagggaaccccgtggtcacgcgtctcccgtcacgtcctcccgaccgaacggccctacgtcccggtacctccccccgtggcccgccctcgccctccgacggacgccacccgtcccgagaccgacaccgacgcccggtacccgtgggcctcgccgtcggtccgacgggtaaccc

SEQ ID NO: 163331 - DNA, 578 bp, Homo sapiens
  misc_feature: GYAE6OF01CSMQJ.47.55.E11.1.454.CMB.1.raw
  modified_base (518)..(518): a, c, t, g, unknown or other
  misc_feature (518)..(518): n is a, c, g, or t
tcagagctcacgtacacgaccggtgctcgatttagcactcgcacgttgggttttccttgttgctcttttaaaaggtgtccagtgtgaggtgcaggtagtggagtccggggaggcttagttcagcctggggagtccctgagactctcctgtgtagtctctggaatcagtttcagtaccttctggatgcactgggtccgccaaactccaggtaagggctggtgtgggtctcacgtattaatcctgatggcagtgttaataaattatgcggactccgtggagggccgattcagcatctccagagacaacggcaagagtatactgtatctaggaaatgaaacaatctagaagagtcgaacgataacggctgtctatcatttgttgttttcgattgtccttcgggtccgcgggtacttcgtcggggccacgggtaaccctggtcacggcgtctcctcacgccctaccaccgaacggcccacgtccgtcccttcccccgtggcccgtccctgccctccgaggcnccaccgtcgacgacgcacgcggccggccctcgggcctcggccctggaccgaaggtacccg

SEQ ID NO: 163332 - DNA, 504 bp, Homo sapiens
  misc_feature: GYAE6OF01AMLNH.47.55.E11.1.454.CMB.1.raw
  modified_base (489)..(490): a, c, t, g, unknown or other
  misc_feature (489)..(490): n is a, c, g, or t
  modified_base (492)..(504): a, c, t, g, unknown or other
  misc_feature (492)..(504): n is a, c, g, or t
tcagagctcacgtacacgaccggtgctcgatttagcactcgcacgttgggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagcccaccctggccatcagtgggcctccggcccgaggatgaggctgatttattactgtgtaggttggatcgcagcctgactgcttacgtcttcggagcgtgggaccaaggtcaccgtctaggtcacgcccaaggcccaaccccgatcgtcactctcgttccccgccctctctacgtgacgctcgtgacggtccgggctcggcgacggccgacatacgnncnnnnnnnnnnnnn

SEQ ID NO: 163333 - DNA, 510 bp, Homo sapiens
  misc_feature: GYAE6OF01BU022.47.55.E11.1.454.CMB.1.raw
  modified_base (292)..(292): a, c, t, g, unknown or other
  misc_feature (292)..(292): n is a, c, g, or t
  modified_base (392)..(392): a, c, t, g, unknown or other
  misc_feature (392)..(392): n is a, c, g, or t
  modified_base (499)..(499): a, c, t, g, unknown or other
  misc_feature (499)..(499): n is a, c, g, or t
  modified_base (503)..(510): a, c, t, g, unknown or other
  misc_feature (503)..(510): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccnccaaactccaggtaagggccagggaaccctggtcagcgtctcctcacgcctccaccaagggcccatcggtcttcccctggccgccctgcctccgaggacnccaccgtccgagacgccacgacgccgggcccctggggctcggcccgtgggtaccaaggtcctaccttccgtacgtgacgtctcgtggacgcggggctggctaaggcnatgnnnnnnnn

SEQ ID NO: 163334 - DNA, 487 bp, Homo sapiens
  misc_feature: GYAE6OF01DLMUC.47.55.E11.1.454.CMB.1.raw
  modified_base (412)..(412): a, c, t, g, unknown or other
  misc_feature (412)..(412): n is a, c, g, or t
  modified_base (475)..(487): a, c, t, g, unknown or other
  misc_feature (475)..(487): n is a, c, g, or t
tcagagctcacgtacacgaccggtgctcgatttagcactcgcacgttgggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatggaggctgatttattactgtgtaggttgggatcgcagcctgactgcttacgtcttcggagctgggaccaggtcaccgtcctaggtcagcccaaggcccaacccnctgtcactctcgttcccaccctcctctacgtgagctctgacgcgggctggacaggcgcatagnnnnnnnnnnnnn

SEQ ID NO: 163335 - DNA, 539 bp, Homo sapiens
  misc_feature: GYAE6OF01B1QRV.47.55.E11.1.454.CMB.1.raw
  modified_base (359)..(359): a, c, t, g, unknown or other
  misc_feature (359)..(359): n is a, c, g, or t
tcagagctcacgtacacgaccggtgctcgatttagcactcgcacgttgggtttggggagccgcagccctgggattcccagctgtttctgcttgctgatcaggactgcacacagagagctcaccatggagtctgggctgagctggtttcctgttgctctttaaaggtgtccagtgtgaggtgcaggtagtggagtccgggggaggcttagttcagcctggggagtccctgagactctcctgtgtagtctctggaatcagtttcagtaccttctggatgcactgggtcccgcaaactccgagggtaaggggctgggtgtgggtctcgacgtatcaatcctgactggcagtgttataaattntgcggactccgtggagggccattcagcatctaccagagacaacggcaaagatatactgtatctaggaaatgaaactatctagagagtacgaacgagtacggctgtactatctaagtttgttgttttcgagttcgtccgttccgggtcgtcgggtacttgcggggtccgaggggtaccccg

SEQ ID NO: 163336 - DNA, 549 bp, Homo sapiens
  misc_feature: GYAE6OF01C8X16.47.55.E11.1.454.CMB.1.raw
  modified_base (365)..(365): a, c, t, g, unknown or other
  misc_feature (365)..(365): n is a, c, g, or t
tcagagctcacgtacacgaccggtgctcgatttagcactcgcacgttgggtttgggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtacccttctggatgcacgtgggtccgccaaactccgagggtaaggggctgggtgtgggtctcacgtatcaatcctgatggcagtgttataaattntgcggactccggtggaggggccattcagcatctccagacgacaacggacaagagtatactgtatcgtaggaaatgaaactaatcgtagagagtcgagatacggctgtctatctattgttgttttacgattcggtcccgttcgggcccggtcgggtactttcggcggggcccgaggggtaccccg

SEQ ID NO: 163337 - DNA, 551 bp, Homo sapiens
  misc_feature: GYAE6OF01A5M2V.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccgaggtagggctggtgtggtctcacgtatcaatcctgatggcagtgttaataaattatggcggactcgtggaggggcctattcgagcatctcagagacaacggcaagagtatactgtatacgtaggaatgaactaatcgtagagagtcgaacgagtacggctagtactatactagtttggttgttttacgattcgtccgttccggtccgtcgggtacttcggtacgggggcctaacggggtcccgttcggg

SEQ ID NO: 163338 - DNA, 664 bp, Homo sapiens
  misc_feature: GYAE6OF01C2RTG.47.55.E11.1.454.CMB.1.raw
  modified_base (207)..(207): a, c, t, g, unknown or other
  misc_feature (207)..(207): n is a, c, g, or t
  modified_base (248)..(248): a, c, t, g, unknown or other
  misc_feature (248)..(248): n is a, c, g, or t
tcagagctcacgtacacgaccggtgctcgatttagcactcgcacgttgggtttggggagcttcagctgtggtagagaagacaggattcaggacaatctccagcatggccgcttccctctcctcctcaccctcctcactcactgtgcagggtcttgggcccagtctgtgttgactcagcccaccctcagcgtctcggggacccccggnagacggtcaccatctcttgttctggaagcagcctccaaatntacggaaatgataatgtatactggtaccagcaacgtccacgaaccggccccaaactcctacatctaataacaatgatcagcgccctacgacggggtcctcggccgtattcctcgtcggcctaccgaagtcgtcggccgtcctcacgcccacccgtggaccatcgaggtcgggccgtcccggcccggaggactgggacggctaggtaatttactttacgtggttaggttaggggtttgggaacttccggacgtacggtcccgttaggaccgttcggtccgtttaaccggttccgtttaccggggacgttccgggtacggggtaacccgtaaagggttccccgtaacccggttacccggttaacgggtccgaaccggacccccgtaaacgggacccccctaaaccccgtcgttacccg

SEQ ID NO: 163339 - DNA, 539 bp, Homo sapiens
  misc_feature: GYAE6OF01B4QLK.47.55.E11.1.454.CMB.1.raw
  modified_base (208)..(208): a, c, t, g, unknown or other
  misc_feature (208)..(208): n is a, c, g, or t
  modified_base (427)..(427): a, c, t, g, unknown or other
  misc_feature (427)..(427): n is a, c, g, or t
tcagagctcacgtacacgaccggtgctcgatttagcactcgcacgttgggtttggggcagcttcagctgtggtagagaagacaggattcaggacaatctccagcatggccggcttccctctcctcctcaccctcctcactcactgtgcagggtcttgggcccagtctgtgctgactcagccaccctcagcgtctcgggacccccgggnagacggtcaccatctcttgttctggaagcagctccaatatcggaaatgataatgtatactggtaccagcaagtccccacgaacggcccccaaactcctcatctaataacaatgatcagcggccctcacggggtccctggccattctctggctccaagtctggcgcctcagcccacctggccatcagtgggcctccgggcccgaggatgaggctgtattnttactgtgtaggttggatcgcagcctgactgtcttacgtcttcggagtccgtgggacccagggtccacccggttccgtagggtccaaggccccaaagggtccccaaaccccg

SEQ ID NO: 163340 - DNA, 539 bp, Homo sapiens
  misc_feature: GYAE6OF01BHJIP.47.55.E11.1.454.CMB.1.raw
  modified_base (190)..(190): a, c, t, g, unknown or other
  misc_feature (190)..(190): n is a, c, g, or t
  modified_base (330)..(330): a, c, t, g, unknown or other
  misc_feature (330)..(330): n is a, c, g, or t
  modified_base (348)..(348): a, c, t, g, unknown or other
  misc_feature (348)..(348): n is a, c, g, or t
tcagagctcacgtacacgaccggtgctcgatttagcactcgcacgttgggtttggggagagaagacaggattcaggacaatctccagcatggccggcttccctctcctcctcaccctcctcactcactgtgcagggtcttgggcccagtctgtgctgactcagccaccctcagcgtctgggacccccggnagacggtcaccatctcttgtctggaagcagctccaatatcggaaatgataatgtatactggtaccagcaagtcccacgaacggccccaaactcctcatctataacaatgatcagcggccctcagggtccctggccattcnctggctccaagtctggcncctcagccaccctggccatcaggtgggcctccgggcccgaggatggaggctgattattactgtgtaggttggatcgcagcctgactgcttacgtcttcggagcgtcgggacctagggtccaccgtcctagggtccagccccgaaggccccaaaccccgactcgtacaccttccttcggttcccccgtcccc

SEQ ID NO: 163341 - DNA, 519 bp, Homo sapiens
  misc_feature: GYAE6OF01A6JJY.47.55.E11.1.454.CMB.1.raw
  modified_base (206)..(206): a, c, t, g, unknown or other
  misc_feature (206)..(206): n is a, c, g, or t
  modified_base (346)..(346): a, c, t, g, unknown or other
  misc_feature (346)..(346): n is a, c, g, or t
  modified_base (363)..(363): a, c, t, g, unknown or other
  misc_feature (363)..(363): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctcgggacccccggnagacggtcaccatctcttgttctggaagcagctccaatatcggaaatgataatgtatactgtaccagcaacgtcccacgaaccgccccaaatcctcatctataacatgatcagccgcctcgacgggtcctggccgattcnctgctccaagtctggcncctcacgcccacctgccatcgaggtcgggcctccggcccgaggatgaggtctgattatactgtgtaggttggatcgctagcctgactgtcttacgtctcggagtcgtcgggactaggtccaccgtccgtagtccacgacccaacgcccaaccctcg

SEQ ID NO: 163342 - DNA, 521 bp, Homo sapiens
  misc_feature: GYAE6OF01CRC84.47.55.E11.1.454.CMB.1.raw
  modified_base (204)..(204): a, c, t, g, unknown or other
  misc_feature (204)..(204): n is a, c, g, or t
tcagagctcacgtacacgaccggtgctcgatttagcactcgcacgttgggtttggggagcttcagctgtggtagagaagacaggattcaggacaatctccagcatggccgcttccctctcctcctcaccctcctcactcactgtgcagggtcttgggcccagtctgtgctgactcagccaccctcagcgtctgggacccccggnagacggtcaccatctcttgtctggaagcagctccaatatcggaaggaatgatgtgtactggttgcagcaactccccggaacggcccccaaaactcctcatctatacgaataatcagcggtcctcaggggtccctgaccgattctctggctccaagtctgacacctcagccctccctgccatcagtggctccggtccgaggatgagctgattattattgtgcaacatgggatagtagcctgagtagtgttggttttcggcggagggacctaaacgtgaccgtccgtaggtcagcccaaggcctcgcccccgtggtccc

SEQ ID NO: 163343 - DNA, 601 bp, Homo sapiens
  misc_feature: GYAE6OF01AE17N.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagcgtggtttctgtagctctttaaagtgtcagtgtgaggtgcaggtagtggagtccgggggagcttagtcagccgtggggatccctgagactctcctgtgtagtctctggaatcgagtttcagttaccttctggatgctacgtcgggtcccaccaaacgtccgaagggtacgggctgggtgtgggtctacgacgtatcgaatcctgactggactagtagttaataaattgcggcggtactccggtggacggggctagttcgagtcatctaccgagacgacgaacggacaagtagtatacgtagtatacgtaggtaaatagtaactatcgtagaagtacgtacgacgtagtacggtctagtacctatcttagttgttacggttttcgagttcggttcccggttaccgggtccgtacgggttaccgttccgggtaccggggacccgtacggggtacccgttccggg

SEQ ID NO: 163344 - DNA, 482 bp, Homo sapiens
  misc_feature: GYAE6OF01DZYLW.47.55.E11.1.454.CMB.1.raw
  modified_base (409)..(409): a, c, t, g, unknown or other
  misc_feature (409)..(409): n is a, c, g, or t
  modified_base (470)..(482): a, c, t, g, unknown or other
  misc_feature (470)..(482): n is a, c, g, or t
tcagagctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccacctggccatcagtgggctccggcccgaggatgaggctgattattactgtgtaggttggatcgcagcctgactgcttacgtcttcggagcgtgggaccaggtcaccgtcctaggtcagcccaaggcccaacccntgtcactctcgttccccgcctcctctacgtgagctctgacgcgggctggcaggcgcatagnnnnnnnnnnnnn

SEQ ID NO: 163345 - DNA, 556 bp, Homo sapiens
  misc_feature: GYAE6OF01C01IJ.47.55.E11.1.454.CMB.1.raw
  modified_base (295)..(295): a, c, t, g, unknown or other
  misc_feature (295)..(295): n is a, c, g, or t
  modified_base (363)..(363): a, c, t, g, unknown or other
  misc_feature (363)..(363): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggagcttagttcagcctggggagtccctgagactctcctgtgtagtctctggaatcagtttcagttaccttcgtggatgcacgtgggtcccnccaaactccgaggtaagggctggtgtgggtctcacgtatcaatcctgatggcagttgttaataaattntgcggtactccggtggacggggccgtattcgagtcattctccaagacgacaacggcaagagtatactgtatacgtaggaaatagaactaatcgtagaagagtacgaacgtagtacggtctgtactatctagtttgttgtttcgattcgtccgttcggtccgcggtacttcggcggggccacgggtaccctcgg

SEQ ID NO: 163346 - DNA, 540 bp, Homo sapiens
  misc_feature: GYAE6OF01CAACV.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctggctgagctgggttttccttgttgcttcttttaaaggtgtccagtgtgaggtgcaggtagtggagtccgggggagcttagttcagccgtggggagtccctgagactctcctgtgcagcctctggcttccaccttcaataattatgtctatgcaggtcgggtccgccaggcctccgagcgaaggggctaggaggtgggtggcggtcagtagtccgtcagtcggacagtcttcagtattacgcagtactcccgtggacgggctatccactagtcctcagacacaaacttcccaagaacctacggtactatccgtgctacctcgaccacgtccctagaacgacgtgaaccgactacgtcctctactactacgtgtacgacgtgagtcgttagacgtagtactattgtagtcg

SEQ ID NO: 163347 - DNA, 645 bp, Homo sapiens
  misc_feature: GYAE6OF01DP3P0.47.55.E11.1.454.CMB.1.raw
  modified_base (172)..(172): a, c, t, g, unknown or other
  misc_feature (172)..(172): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgcttcttttaaaaggtntccagtgtgaggtgcaggtagtggagtccgggggagcttagttcagccgtggggatccctgagactctcctgtgtagtctcgtggaatctagtttcagttaccttctggatgcacgtcgggtccaccaaaactccgaagggttaaggggctgggtgtcgggtctacgacgttatctaatcctgagtggctagttagtttaataaatttagtaggcggtactcggtaggacggggtcctagttcgagtcacttctaccaaggaacgaaccgaacggacaaaggtagttaatactagtaactacgtaagtaaagtacgaaactaagtcgtagaagtacgtacgaacgtaagtaccggtacttagttctaattcgtagtttggtttagttttcgagttcggtcccggtttaccggggccggttaccgggttaccgtttcgggtaccggggccgtaaccggggttaaccccgtcggg

SEQ ID NO: 163348 - DNA, 682 bp, Homo sapiens
  misc_feature: GYAE6OF01D1LU7.47.55.E11.1.454.CMB.1.raw
  modified_base (192)..(192): a, c, t, g, unknown or other
  misc_feature (192)..(192): n is a, c, g, or t
tcagagctcacgtacacgaccggtgctcgatttagcactcgcacgttgggtttgggggagagaagacaggattcaggacaatctccagcatggccggcttccctctcctcctcaccctcctcactcactgtgcagggtcttgggcccagtctgtgctgactcagccaccctcagcgtctcgggacccccggnagacggtcaccatctcttgttctggaagcagctccaatatcggaaggatgatgtgtactggttgcagccaaccgtccccggaaccggcccccaaactccctcactctaataacaatgatcaggccgccctcgacgggtccctggccgtattctcgtggcctccaagtctggccgcctcacgcccaccctggccatcagtcgggcctcccggcccgaggactggacggtctagatttacgttacgtggttgggttagggttgggacttccggactacggcccttggtaacctggttccctttacgggttccgtttacgggacgttccggtacggggaacccgtaacggtaccccgtacccggttaccggtaaccgggttccgaaacccggtacccccgaaacgggaccccccctaaaacccccggtccgttaccgggttacccctaaacccgtttccccgtttcccggtttccccccccttaaaccccccg

SEQ ID NO: 163349 - DNA, 535 bp, Homo sapiens
  misc_feature: GYAE6OF01C48GI.47.55.E11.1.454.CMB.1.raw
  modified_base (207)..(207): a, c, t, g, unknown or other
  misc_feature (207)..(207): n is a, c, g, or t
  modified_base (463)..(463): a, c, t, g, unknown or other
  misc_feature (463)..(463): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctcgggacccccgggnagacggtcaccatctcttgttctggaagcagctccaatatacggaaatgaataatgtaatactggtaccagcaagtccccacgaaccggcccccaaactcctcatctaataacaatgatcagccggccctcgaggggtccctggccgattctctggctccgaagtcctggccgcctcacgcccaccctggcccatcgagtcgggcctccgggccgaggatggaggctgatttattactggtgtaggttggatcggnagcctgactgtcttacgtctcggagcgtggaccaaggtccaccgtctaggtcagcccaaggcccaaccctcg

SEQ ID NO: 163350 - DNA, 777 bp, Homo sapiens
  misc_feature: GYAE6OF01E226X.47.55.E11.1.454.CMB.1.raw
  modified_base (176)..(176): a, c, t, g, unknown or other
  misc_feature (176)..(176): n is a, c, g, or t
  modified_base (200)..(200): a, c, t, g, unknown or other
  misc_feature (200)..(200): n is a, c, g, or t
tcagagctcacgtacacgaccggtgctcgatttagcactcgcacgttgggtttggggagagaagacaggattcaggacaatctccagcatggccggcttccctctcctcctcaccctcctcactcactgtgcgagggtcgttcgggcccagtctgtgctgactcacgcccaccctnagccgtcgtccggggacccccggnacggaccggtccacctattccttcgtttgttccgtagggaacgccacgtcctaccaaattacgtaacggaaatgaattaagtgtaatacgtacggtaaccagacctaaccgtaccccgaaccggaaccccggaccccctaaacctccctactactacctaaactaaacaagtacgactacgacggcccggtcccctacggaccggggttccccgtcgggacccgtactttccgtcgtcgggtcccttaaccgtaacggttccgtcgggcccgtccctacgaccgcccctacccgtccggaccctacgtccgtagggtccgggccctcccgggacccggaaggtacgtacgggacggtcgttagttaagtttaactttacggtggttagggttaggggttcgggtacgttccggacgtacgtccgtagtaccgttcggtcccgtttacggttcggttaccgggacgtcggtacgggaaccgtaacgggtccctacccggtacgtacggtccacggacccgaaccggaccccaacccctacgtcgtacccaccgttcccgttcccgttcccccgtaccc

SEQ ID NO: 163351 - DNA, 815 bp, Homo sapiens
  misc_feature: GYAE6OF01A8CWY.47.55.E11.1.454.CMB.1.raw
  modified_base (297)..(297): a, c, t, g, unknown or other
  misc_feature (297)..(297): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggaggtccgggggaggcttagttcagccgtggggagtccctgagactctcctgtgtagtctctggaatctagtttcagtaccttcgtggatgcacgtgggtccncaaactccgaggtaagggctggtgtgggtctcgacgtatctaactccgtgagtcggactagttagttaataaattgtacggcggtaaccgtccggtaggggacggggtacccgtagtttaccgacgtaccgtaacgttcccgtacccgtaaggtaaccggaacccgtaaacccgggtacgaaaacggtaggtttaaactttaacccggttaggttaaacgtaccggtttaaagggaaaacgttaacggtaaaaccgtaaacttcggtaagggtaaccgggttaacggtaacccgggtaaacgggtaaacggtttaacccgggtaccgtttacgggttaacccttaaggtttacccttaaggtttttaccgggtttacgggtttttttacccggaaagttttcccggggttaccccggtttaccccggggttcccggggtaccggggttttaaccccgttcggggtttaacccgggggggacccgttaaaccgggggttaacccccccgggtttagggg

SEQ ID NO: 163352 - DNA, 721 bp, Homo sapiens
  misc_feature: GYAE6OF01CRKJT.47.55.E11.1.454.CMB.1.raw
  modified_base (181)..(181): a, c, t, g, unknown or other
  misc_feature (181)..(181): n is a, c, g, or t
  modified_base (596)..(596): a, c, t, g, unknown or other
  misc_feature (596)..(596): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagcgttggtttctgtgcttatttaaaggtgtcagtgtgaggtgngaggtagtgggacggtccgggggagtcttagttcagccgtggggactcccgtgagactctctgtgtagtcctgtagtatcgtagtttcacgttaccttgtaggtatgtaccgtacggttccggggtacccaaaccctaaaccgtaccggtaagggtaacggggtcgttggggttcgggtcggggtacctacgaaccgttatacctaacttcgtagcgtggataggttataaattaattagcggtacggtacgttccggagggaccgggtactacgttacgagtcgtacgttacctaccgaagaacgaaaccggaacggtaacaaaggtaacgttaagttacgtagttaactaggtaaagaaagtaacgtaactaagttacgaggaagtacggtaaccgtaagtaacgtaccggtntacggttacttactacgttagtttggtttacgttttacgcgttccggttcccggtttacccgggtccggtacccgggtttacggttcgggtaccggggacccggtaaccgggtacccggttcggg

SEQ ID NO: 163353 - DNA, 555 bp, Homo sapiens
  misc_feature: GYAE6OF01DPSPW.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggagcttagttcagcctggggagtccctgagactctcctgtgcagcctctggactcacctttagcaactctgtcatgggctgggtccgccaggctccgggggaaggggctggagtgggtctcgaagtatgatgagatggtgagcacattcgtacgtggactccggtaggaacgggtcccgttcaccatctccagaagactaatttcaggacgcacgctagtactcgtaacaaattcgaacagcctagagacgccggaggaccacggtaccgtattatttctaggtgacgtaaagtctaagtacgccgtacggtcccacccccgtacggcgacttacctttcgttgtacccgg

SEQ ID NO: 163354 - DNA, 669 bp, Homo sapiens
  misc_feature: GYAE6OF01AHSG8.47.55.E11.1.454.CMB.1.raw
  modified_base (212)..(212): a, c, t, g, unknown or other
  misc_feature (212)..(212): n is a, c, g, or t
tcagagctcacgtacacgaccggtgctcgatttagcactcgcacgttgggtttggggagcttcagctgtggtagagaagacaggattcaggacaatctaccagcatgggccggcttccctctcctcctcaccctcctcactcactgtgcagggtcttgggcccagtctgtgctgactcagccaccctcaggcgtcgtcggggacccccgggnaggaccggtcaccatcctcttgttctggaagcagctaccaatatcggaaatgataatgtactactggtaccagacaacgtcccaacggaacccggacccccaaactccctacactactaataacaatgatcacgccggcctcgacgggtcctggcctattcctcgtggctccgaagtccgtggccgtcctcacgccctacccgtcggcccagtccgaggtcgggccctcccgggaccgacggtagtcggacggtcgttagtactttacgttacgttggttaggttacggggtttgggtactccggacgtacggtcctacggtacgtcggtaccgtttacggttcgttacgggtacgtccggttacggggaaccctaacggggttcccctaacccgggttacccgttaacgggtcccgaacggtaccccgtaacccgggccccctaaaccccgtacgg

SEQ ID NO: 163355 - DNA, 599 bp, Homo sapiens
  misc_feature: GYAE6OF01AYZ16.47.55.E11.1.454.CMB.1.raw
  modified_base (344)..(344): a, c, t, g, unknown or other
  misc_feature (344)..(344): n is a, c, g, or t
  modified_base (405)..(405): a, c, t, g, unknown or other
  misc_feature (405)..(405): n is a, c, g, or t
  modified_base (423)..(423): a, c, t, g, unknown or other
  misc_feature (423)..(423): n is a, c, g, or t
  modified_base (432)..(432): a, c, t, g, unknown or other
  misc_feature (432)..(432): n is a, c, g, or t
  modified_base (506)..(506): a, c, t, g, unknown or other
  misc_feature (506)..(506): n is a, c, g, or t
  modified_base (511)..(511): a, c, t, g, unknown or other
  misc_feature (511)..(511): n is a, c, g, or t
  modified_base (520)..(520): a, c, t, g, unknown or other
  misc_feature (520)..(520): n is a, c, g, or t
tcagagctcacgtacacgaccggtgctcgatttagcactcgcacgtttggggttttggggggcccgacgagacccgtgggacttcccagtctgtttcctcgccttaggcctgagtcctaccggacgtcgccacacacgaggagcctccaccgatggagtctgggcgtcgaggcttgggttttccttggttcgtacttacttttaaaaggtcgtcctagtgtgaggtgcgaagttggtgcaagtcgtgggggagcgttggtccagccgtgggggtcctcagctctcctgtgcagcctctggtacttctaccttttagttccttcttggatgtaacgttgggtccncacgacgtccgaggggaagggcgtgggaggtcggggtgcgaacgaagtaacgtcgagtagngaagtcaagaaactgtgnggactctgngaacggccgaatcaccatctccaagagacacgtaccaaagtctctctgtttacagaaatggacgaactcgacgngaagngaaaccggngaccgtgtcgtagtagttagtgtgtgtcgtcgtcgtcgccgtcgtccgtcgtcgtcgtcgtcggtcggtcggtcggtcg

SEQ ID NO: 163356 - DNA, 558 bp, Homo sapiens
  misc_feature: GYAE6OF01DAMK5.47.55.E11.1.454.CMB.1.raw
  modified_base (358)..(358): a, c, t, g, unknown or other
  misc_feature (358)..(358): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgagtgcaggtagtggagtccgggggaggcttagttcagcctggggagtccctgagactctcctgtgtagtctctggaatcagtttcagtaccttctggatgcactgggtccgaccaaactccgaggtaagggctggtgtgggtctcacgtatcaatcctgatggcagtgttataaattngcgactcgtgacgggcattcagcatctcagagacaacgacaagagtatactagtatcgtagaatagaactaatactagaagtagtcgaacgaagtacgacttgtactactctattgttagttttcgtagttacccgttcgggttccggtccgggttaaacgttccggtacgggacccgtacggggtacccgtggtaccgg

SEQ ID NO: 163357 - DNA, 534 bp, Homo sapiens
  misc_feature: GYAE6OF01BCM0A.47.55.E11.1.454.CMB.1.raw
  modified_base (292)..(292): a, c, t, g, unknown or other
  misc_feature (292)..(292): n is a, c, g, or t
  modified_base (510)..(510): a, c, t, g, unknown or other
  misc_feature (510)..(510): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccnccaaactccaggtaaggggctggtgtgggtctcacgtatcaatcctgatggcagtgttataaattatgcggactccgtgaggggccgattcagcatctccagagacaacggcaagagtatactgtatcgtaggaatgaacaatctgagagtcgacgatacgctgtctatctattgtgttttcgattcggtcccgtttcgggtcccgcgggtacttcgnggggcccaggggtaccccgtcggg

SEQ ID NO: 163358 - DNA, 562 bp, Homo sapiens
  misc_feature: GYAE6OF01BFWWC.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggagcttagttcagcctggggagtccctgagactctcctgtgtagtctctggaatcagtttcagtaccttctggatgcacgtgggtccgccaaactccgaggtaaggggctggtgtgggtctcgacgtatcaatcctgatggcagttgttaataaattatgacgtactcggtggacggggcctattcgagcatctccagacgacaacggacaaggagtactatagtatacgtaggaatagaactaatcgtagaagagtacgaacgactacggctagtctatctagttgttgtttcgattcggtcccgtttgggcccggtcgggtactttcggccggggacctacggggaccccgttggg

SEQ ID NO: 163359 - DNA, 565 bp, Homo sapiens
  misc_feature: GYAE6OF01BYWOZ.47.55.E11.1.454.CMB.1.raw
  modified_base (208)..(208): a, c, t, g, unknown or other
  misc_feature (208)..(208): n is a, c, g, or t
  modified_base (383)..(383): a, c, t, g, unknown or other
  misc_feature (383)..(383): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagcccaccctcagcgtcgtcgggacccccggnagacggtcaccatctcttgttctggaagcagctaccaatatcggaaatgataatgtatactggtaccagcaacgtccccaacgaaccgcccccaaactcctcactctataacatgatcagcggccctcgacgggtccctggccgtattcctcgtcggcctaccaagtcgtggccncctcacgcccacccgtggccctatcaggtcggcccgtcccggccgaggactcggacggtctagtacttattacgtggtggttagggttggatcggcacgtcctgactgtacttacgtcgttcggagtcgtagggacctagggtccaccgtctacggtcacgacccaacggcccaaccctacg

SEQ ID NO: 163360 - DNA, 813 bp, Homo sapiens
  misc_feature: GYAE6OF01DKZHJ.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctggctgagctgggtttccttgttgctctttaaaggtgtcagtgtgaggtgcaggtagtggaggtccggggaggcttagttcagccgtggggagtcctgagactctcctgtgtagtctctggaatctagttcagtaccttctggatgcacgtcgggtccgaccaaacgtccgagggttaagggccgtggtggtacggggtctacgtacgtatcgtaactccgtgtatcggtactagttagttaaattaaattagtacggtacggtaacgttccgggtaggacgggggtaccgtaacgtttacgaacggtacctaacgtaccgttacccgaaggtaaacggaacccgtaaaacgggacctaaaagggtaacgtttaacgttaacccgtttaggttaaactttaccggttaaagggtaaaaacgttacgggtaaaaactaaagtttaccgtaagggaaaacggttaccgggtaaccggtaaaaccggtaaacgggttaacccgggttcgtttacggttaacccgttaaatttaccgttaaaccgttttgggttttacgggtttttacccggtaagtttccgggttaccccccgttttccggggggttaccccggtaccggggtttaaccgtttccggggtaaccgggggtaacccgtaaccggggggttaacccccgttacggggg

SEQ ID NO: 163361 - DNA, 618 bp, Homo sapiens
  misc_feature: GYAE6OF01DPNRK.47.55.E11.1.454.CMB.1.raw
  modified_base (423)..(423): a, c, t, g, unknown or other
  misc_feature (423)..(423): n is a, c, g, or t
  modified_base (551)..(551): a, c, t, g, unknown or other
  misc_feature (551)..(551): n is a, c, g, or t
  modified_base (603)..(603): a, c, t, g, unknown or other
  misc_feature (603)..(603): n is a, c, g, or t
  modified_base (605)..(618): a, c, t, g, unknown or other
  misc_feature (605)..(618): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggtttttccttgttgcttacttttaaaaggtgtccagtgtgaggtgcaggtagtggaggtccgggggagtcttagttcagccgtggggacgtccctgacgtactctccttgtgtacgtctcgtggaattctagttttcagttacccttgtggtatgcgtacgtcgggtcccacctaaacgtccggaagggtaacggggccgaacgggtacccgtggtcgacgtccgtcctcctcgacgccctaccgaccgacggccctacgttcccggtccttcccccgnggccctcccgtcgcccgtaccgacggtaccgcctacccggtcgaacggaccgcgaccgaccggcccgggccccgtgggcctcggcccgttacgggtaccaaacggttccttaccgtttacctacggtnacgtcttcgtagcgggcggtcgtacgggactaacgggccacgtaagtgctgngnnnnnnnnnnnnnn

SEQ ID NO: 163362 - DNA, 574 bp, Homo sapiens
  misc_feature: GYAE6OF01EP78J.47.55.E11.1.454.CMB.1.raw
  modified_base (262)..(262): a, c, t, g, unknown or other
  misc_feature (262)..(262): n is a, c, g, or t
  modified_base (503)..(503): a, c, t, g, unknown or other
  misc_feature (503)..(503): n is a, c, g, or t
tcagagctcacgtacacgaccggtgctcgatttagcactcgcacgttgggttttccttgttgctcttttaaaaggtgtccagtgtgaggtgcaggtagtggagtccggggaggcttagttcagcctggggagtccctgagactctcctgtgtagtctctggaatcagtttcagtaccttctggatgcactgggtccgccaaactccaggtaagggctggtgtgggtctcacgtatcaatcctgatggcagtgttataaattntgtggactccgtgaggggccgattcagcatctccagagacaacggcaagagtatactgtatctaggaaatgaacaatctgagagtcgacgatacggctgtctatcatttgtgttttcgatgccttcgggtccgcgggtacttcgtgggccagggaaccctggtcaggcgtctcctcacgcctccaccgaacgggcccagtccggtcccttcccccgtggccgcccctgcctaccgaggacnccacccgttccggacgacgccaccgacggccggaccccgtggggacctcggcccttgggtactaaaccggg

SEQ ID NO: 163363 - DNA, 573 bp, Homo sapiens
  misc_feature: GYAE6OF01C0KPV.47.55.E11.1.454.CMB.1.raw
  modified_base (171)..(171): a, c, t, g, unknown or other
  misc_feature (171)..(171): n is a, c, g, or t
  modified_base (191)..(191): a, c, t, g, unknown or other
  misc_feature (191)..(191): n is a, c, g, or t
  modified_base (357)..(357): a, c, t, g, unknown or other
  misc_feature (357)..(357): n is a, c, g, or t
tcagagctcacgtacacgaccggtgctcgatttagcactcgcacgttgggtttggggagagaagacaggattcaggacaatctccagcatggccggcttccctctcctcctcaccctcctcactcactgtgcagggtcttgggcccagtctgtgctgactcagccaccctnagcgtctcgggacccccggnagacggtcacatctcttgttctggaagcagctccaatatcggaaatgaataatgtatactggtaccagcaagtcccacgaacggccccaaatcctcatctataacaatgatcagcggccctcgacggggtccctggccgattctctggcctcaagtctggcgcctnacgccacctggccatcagtcgggctccggcccgaggatgaggctgattattactgtgttaggttggatcgcagcctgactgcttacgtcgttcggagcgttgggaacctaacgggtccaccggttcctagggtccgaacggaccccgtaaacgggccccctaaacccccgacttccgtacctacccgttccgttccggtttccccccgtacccccg

SEQ ID NO: 163364 - DNA, 529 bp, Homo sapiens
  misc_feature: GYAE6OF01DOILJ.47.55.E11.1.454.CMB.1.raw
  modified_base (215)..(215): a, c, t, g, unknown or other
  misc_feature (215)..(215): n is a, c, g, or t
tcagagctcacgtacacgaccggtgctcgatttagcactcgcacgttgggtttggggggggaagctcagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccggnagacggtcaccatctcttgttctggaagcagctccaatatcggaaatgataatgtatactggtaccagcaagtcccacgaaccggcccccaaactcctcatctataacaatgatcagcgccctcgacggggtccctggccgattctctggctccaagtctggcgcctcacgcccaccgtcggccatcaggtcgggcctccggcccgaggactgagctgattatactgtgtaggtggatcgcagcctgactgccgttacgtcgttcggagcgtgggaccaaggtccaccgtccgtaggtccagcccgtaaaccgg

SEQ ID NO: 163365 - DNA, 558 bp, Homo sapiens
  misc_feature: GYAE6OF01DFA9S.47.55.E11.1.454.CMB.1.raw
  modified_base (375)..(375): a, c, t, g, unknown or other
  misc_feature (375)..(375): n is a, c, g, or t
  modified_base (482)..(482): a, c, t, g, unknown or other
  misc_feature (482)..(482): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggttttccttgttgctcttttaaaaggtgtccagtgtgaggtgcaggtagtggagtccgggggaggcttagttcaggccgtggggagtccctgagactctcctgtgtagtctctgaatcagtttcagttaccttcgtggatgccacgtgggtccgaccaaacgtccgaagggtaaggggctgggtgtgggtctcgacgtatcaatcctgatggctagtagttaataaagttntcgcggtacgtcggtggacgggccgtattcagcatctcagacgacaacgacaagagtatactgtatacgtagtaatagaacaatcgagagtagtacgacgagtacgntgtactatctattgtgttttcgattcgtccttcggtccgtcggtcgttacggcgggaccgtacgggtacccgtcgg

SEQ ID NO: 163366 - DNA, 576 bp, Homo sapiens
  misc_feature: GYAE6OF01C1NZT.47.55.E11.1.454.CMB.1.raw
  modified_base (279)..(279): a, c, t, g, unknown or other
  misc_feature (279)..(279): n is a, c, g, or t
  modified_base (366)..(366): a, c, t, g, unknown or other
  misc_feature (366)..(366): n is a, c, g, or t
tcagagctcacgtacacgaccggtgctcgatttagcactcgcacgttgggtttggggccgcagccctgggattcccagctgtttctgcttgctgatcaggactgcacacagagagctcaccatggagtctgggctgagcttgggttttccttgttgcttacttttaaaaggtgtccagtgtgaggtgcaggtagtggagtccgggggaggcttagttcagccgtggggagtccctgagactctcctgtgtagtctctggaatcagtttcagttaccttntggatgcacgtgggtccgaccaaacgtccgaaggtaagggctggtgtgggtctcacgtatcaatcctgatgcagtgttaataaattntgcgtatccgtgagggctatcagcatctcgagacgacaaggcaagagtatactgtatcgtagaaatagaacaatcagagacgtacgaacgtaatacggctagtactaatcgtagtttgttacgttttcgagtttcggccccgtttcgggtccccggtacggggttacctttcgggtacggggacccgtaagggggtaaccccgttcgggg

SEQ ID NO: 163367 - DNA, 607 bp, Homo sapiens
  misc_feature: GYAE6OF01EJ723.47.55.E11.1.454.CMB.1.raw
  modified_base (207)..(207): a, c, t, g, unknown or other
  misc_feature (207)..(207): n is a, c, g, or t
  modified_base (382)..(382): a, c, t, g, unknown or other
  misc_feature (382)..(382): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctcgggacccccgggnagacggtcaccatctcttgttctggaagcagctccaatatcggaaatgataatgtatactggtaccagacaacgtcccaacgaaccggcccccaaaactccctacactctaataaccaatgactcagcccggccctcgacgggtccctggcctattctctggctacagtctggcncctcacgcccacccgtggaccactcgagtcgggccgtcccgggccgaggacgtggacgtcgtagtatttacgttacgttaggttggttagggttcggacgttccggacgacgtcctacgacttcgtacgtttaccgtcgttccggagtcggtacgggacctaacggtccgtaccccggtcgttacgggtacaccggtaccccgaacgggtccccaaccccgtacg

SEQ ID NO: 163368 - DNA, 486 bp, Homo sapiens
  misc_feature: GYAE6OF01DYTWN.47.55.E11.1.454.CMB.1.raw
  modified_base (465)..(465): a, c, t, g, unknown or other
  misc_feature (465)..(465): n is a, c, g, or t
  modified_base (471)..(472): a, c, t, g, unknown or other
  misc_feature (471)..(472): n is a, c, g, or t
  modified_base (474)..(486): a, c, t, g, unknown or other
  misc_feature (474)..(486): n is a, c, g, or t
tcagagctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgagctgattattactgtgtaggttggatcgcagcctgactgcttacgtcttcggagctgggaccaggtcaccgtctaggtcagcccaaggcccaacccatgcactctcgttccccacccttcctctacgtgacgctctggacgcgggctggcaggcncatagnngnnnnnnnnnnnnn

SEQ ID NO: 163369 - DNA, 574 bp, Homo sapiens
  misc_feature: GYAE6OF01DV870.47.55.E11.1.454.CMB.1.raw
  modified_base (205)..(205): a, c, t, g, unknown or other
  misc_feature (205)..(205): n is a, c, g, or t
  modified_base (371)..(371): a, c, t, g, unknown or other
  misc_feature (371)..(371): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccggnagacgtcaccatctcttgttctggaagcagctccaatatcggaaatgataatgtatactggtaccagcaagtcccacgaaccggcccccaaactcctcatctaataacaatgatcagccggccctcgacggggtccctggccgattctctggctcaagtctggccnctcgacgcccacctggccagtcaggtcgggcctccggcccgaggatggaggctagtatttagttacgtggtaggtagggttgggactcggactacggcctgtacgtgtaccgtttacggtcgttcggagcgtcggggaaccctaagggtcccaacccggttccgtaacggtccacggaccccaacgggccccaaaccccgtcg

SEQ ID NO: 163370 - DNA, 736 bp, Homo sapiens
  misc_feature: GYAE6OF01C84WP.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctggctgagctgggtttcctgtgcttactttaaagtgtcagtgtgaggtgcgaggtagtggaggtccgggggaggcgttagttcgaggccgtggggacgtcccgtgacgtacctctccgtgtgtacgtctcgtaggaatcgtagtttcacgttaccttcgtggtatcgctacgtggtaccgacctaaacgtccgagggtacgggtcgtggtggtcgggtctacgtacgtatacaactcgtgagtggtactaggttagttaattaaagttacgtacggtacgggtacttccgggtaggtacgggggtacctacgtttacgaacgccgtacgttacccgtacggtaacggaacgtaaccgtaacgggacgtaaacggtaacgtaagttaaccgtagttaacgtaccgtaaaggtaaacgtaacgtaaactacgttactaagggagttacggacgtaacgtacgtacggtcttacggttacttagtccgttaagtttcggtttacggtttactaggttccggttcccgtttacccgggttaccgggtacccgggttaccggttaccgggtacgggggttaccccggaacggggttccccggttaaccggg

SEQ ID NO: 163371 - DNA, 503 bp, Homo sapiens
  misc_feature: GYAE6OF01AQ57Y.47.55.E11.1.454.CMB.1.raw
  modified_base (465)..(465): a, c, t, g, unknown or other
  misc_feature (465)..(465): n is a, c, g, or t
  modified_base (486)..(486): a, c, t, g, unknown or other
  misc_feature (486)..(486): n is a, c, g, or t
  modified_base (491)..(503): a, c, t, g, unknown or other
  misc_feature (491)..(503): n is a, c, g, or t
tcagagctcacgtacacgaccggtgctcgatttagcactcgcacgtagggtcttgggcccagtctgtgctgactcagccaccctcagcgtctgggacccccggcagacggtcaccatctcttgttctggaagcagctccaatatcggaaatgataatgtatactggtaccagcaagtcccacgaacggccccaaactcctcatctataacaatgatcagcggccctcgaggggtccctggccgattctctggctccaagtctggcgcctcacgcccacctggccatcaggtgggcctccgggcccgaggatggaggctgactttattactggtgtaggttggatcgcagcctgactgcttacgtcttcggagcgtgggacctaggtcaccgtctaggtcacgcccaaggccccaacccatcgtccacttctcgttcccacgtccccttctctacgtgactctcgnggagccgggctgggacaggcncatgnnnnnnnnnnnnn

SEQ ID NO: 163372 - DNA, 529 bp, Homo sapiens
  misc_feature: GYAE6OF01AXYXM.47.55.E11.1.454.CMB.1.raw
  modified_base (205)..(205): a, c, t, g, unknown or other
  misc_feature (205)..(205): n is a, c, g, or t
  modified_base (431)..(431): a, c, t, g, unknown or other
  misc_feature (431)..(431): n is a, c, g, or t
  modified_base (478)..(478): a, c, t, g, unknown or other
  misc_feature (478)..(478): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccggnagacggtcaccatctcttgttctggaagcagctccaatatcggaaatgataatgtatactggtaccagcaagtcccacgaacggcccccaaactcctcatgtctaggaataatcagcggccctcacggggtccctgaccgattctctggctccaagtctggccacctcacgcctccctggccatcagtcgggctccggtccgaggatgaggctgattattactgtncagcagtgggatgacagcctgccgtggtctagttcgggtgttcgggnggacgggaccaaggctacggaccgttccgtaaggtccacggcccgtaacgg

SEQ ID NO: 163373 - DNA, 524 bp, Homo sapiens
  misc_feature: GYAE6OF01DRRBF.47.55.E11.1.454.CMB.1.raw
  modified_base (190)..(190): a, c, t, g, unknown or other
  misc_feature (190)..(190): n is a, c, g, or t
tcagagctcacgtacacgaccggtgctcgatttagcactcgcacgttgggtttggggagagaagacaggattcaggacaatctccagcatggccggcttccctctcctcctcaccctcctcactcactgtgcagggtcttgggcccagtctgtgctgactcagccacctcagcgtctgggacccccgggnagacggtcaccatctcttgttctggaagcagctcaaatatcggaaaatgataatgtatactggtaccagcaagtcccacgaacggccccaaaatcctcatctataaacaatgatcagcggccctcaggggtccctggccgattctctggctccaagtctggcgcctcagccaccctggccatcagtgggctccggcccgaggatgagggctgattattactgtgtaggttgggatcgcagcctgactgcttacgtcttggagctgggaccaaggtcaccgtcctaggtcagcccaaaggcccaaaccccactcgtcactctgttcccctacccc

SEQ ID NO: 163374 - DNA, 567 bp, Homo sapiens
  misc_feature: GYAE6OF01B1XIH.47.55.E11.1.454.CMB.1.raw
tcagagctcacgtacacgaccggtgctcgatttagcactcgcacgttgggttttccttgttgctcttttaaaaggtgtccagtgtgaggtgcaggtagtggagtccggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctaggaaatgaaacatctgagagtcgacgatacggctgtctatcattgtgttttcgatgtccttcgggtccgcgggtacttcgtgggccagggaaccctggtcagcgtctcctcacgccctccaccagggcccagtccggtcctcccccgtggccgtccctgccgtccagggcgccacccgtccgagtacgccacgacggccggaccccgtggggcccttggcccgtgggtccgtaaaccggg

SEQ ID NO: 163375 - DNA, 559 bp, Homo sapiens
  misc_feature: GYAE6OF01EDKU8.47.55.E11.1.454.CMB.1.raw
  modified_base (219)..(219): a, c, t, g, unknown or other
  misc_feature (219)..(219): n is a, c, g, or t
  modified_base (247)..(247): a, c, t, g, unknown or other
  misc_feature (247)..(247): n is a, c, g, or t
  modified_base (334)..(334): a, c, t, g, unknown or other
  misc_feature (334)..(334): n is a, c, g, or t
tcagagctcacgtacacgaccggtgctcgatttagcactcgcacgttgggtttgggggggggaagctcagcttcagctgtggtagagaagacaggattcaggacaatctccagcatggccggcttccctctcctcctcaccctcctcactcactgtgcagggtcttgggcccagtctgtgctgactcagccaccctcagcgtcgtcgggacccccgggnagacggtcaccatctcttgttctggaancagctccaatatacggaaatgataatgtatactggtaccagcaagtcccacggaaccggcccccaaactcctcatctaataacaatnatcagccggcctcgacggggtccctggccgtattcctcgtcggcctaccgaagttccgtcggccgccctcacgccctacccgtcggccatcgaggtcgggcctccgggcccgaggactggagtctgtatttattacgtgtggtagggtggattcgcagcctgctgtcttacgtcgtcggagcgtcgggacctaggcctaccgtcgtaggcacgcccgtaacccgg

SEQ ID NO: 163376 - DNA, 544 bp, Homo sapiens
  misc_feature: GYAE6OF01BVELJ.47.55.E11.1.454.CMB.1.raw
  modified_base (180)..(180): a, c, t, g, unknown or other
  misc_feature (180)..(180): n is a, c, g, or t
  modified_base (200)..(200): a, c, t, g, unknown or other
  misc_feature (200)..(200): n is a, c, g, or t
  modified_base (362)..(362): a, c, t, g, unknown or other
  misc_feature (362)..(362): n is a, c, g, or t
  modified_base (530)..(530): a, c, t, g, unknown or other
  misc_feature (530)..(530): n is a, c, g, or t
tcagagctcacgtacacgaccggtgctcgatttagcactcgcacgttgggtttggggagctgtggtagagaagacaggattcaggacaatctccagcatggccggcttccctctcctcctcaccctcctcactcactgtgcagggtcttgggcccagtctgtgctgactcagccaccctnagcgtctcgggacccccggnagacggtcaccatctcttgttctggaagcagcctccaatatcggaaatgataatgtatactggtaccagcaagtcccacgaacggcccccaaactcctcatctataacaatgatcagcgccctcaggggtccctggccgattctctggctccaagtctggcncctcacgcccaccctggccatcaggtcgggcctccgggcccgaggactgacggctgatttattactgtgtaggttggatcgcagctgtactgtcttacgtcttcgggagcgtgggaaccagggtccacccgttcgtagggtccacggccccaaaggccccaaaccccncttcggtcctaccg

SEQ ID NO: 163377 - DNA, 651 bp, Homo sapiens
  misc_feature: GYAE6OF01D11G4.47.55.E11.1.454.CMB.1.raw
  modified_base (191)..(191): a, c, t, g, unknown or other
  misc_feature (191)..(191): n is a, c, g, or t
  modified_base (349)..(349): a, c, t, g, unknown or other
  misc_feature (349)..(349): n is a, c, g, or t
tcagagctcacgtacacgaccggtgctcgatttagcactcgcacgttgggtttggggagagaagacaggattcaggacaatctccagcatggccggcttccctctcctcctcaccctcctcactcactgtgcagggtcttgggcccagtctgtgctgactcagccaccctcagcgtctcgggacccccggnagacggtcaccatctcttgttctggaagcagctccaatatcggaaatgaataatgtatacgtggtaccagacaacgtcccaacgaaccggaccccaaactcctcatactaataacaatgatcagccggccctcgacggggtccctggcccgtattccnctcgggcctcgaagtcgtggccgcctcacgcccaccctggcccatcgaggtcgggcctcccgggccgaggacgtggaggtctagtatttacgttacgtagggtgttaggggttggacgttccggacgtagtcccgtaggtacttcggtaccgtttacggttcgttacgggacggtacgttacggggaacccgtaacgggttccacccggttaccgtacgggtccaaccggaccccgtaacgggacccccaaaccccgtacgttccgtcctaaccgttcccgttccgttcccccgtacccccg

SEQ ID NO: 163378 - DNA, 541 bp, Homo sapiens
  misc_feature: GYAE6OF01DO6K7.47.55.E11.1.454.CMB.1.raw
  modified_base (292)..(292): a, c, t, g, unknown or other
  misc_feature (292)..(292): n is a, c, g, or t
  modified_base (439)..(439): a, c, t, g, unknown or other
  misc_feature (439)..(439): n is a, c, g, or t
  modified_base (442)..(442): a, c, t, g, unknown or other
  misc_feature (442)..(442): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccncaaactccgaggtaaggggctggtgtgggtctcacgtatcaatcctgatggctagttgttaataaattatgcggactccggtggacggggccgagttcagcatctccaagacgaacaacggcaaagactctctgttcagcaatgacngcngagagtcgaagacgacgctgtgttagttacgtgttgtcgtctctggacccgccgtcggacccggtaccttgggccctttcggcggggtcccgtacgggg

SEQ ID NO: 163379 - DNA, 562 bp, Homo sapiens
  misc_feature: GYAE6OF01A5IVZ.47.55.E11.1.454.CMB.1.raw
  modified_base (208)..(208): a, c, t, g, unknown or other
  misc_feature (208)..(208): n is a, c, g, or t
  modified_base (382)..(382): a, c, t, g, unknown or other
  misc_feature (382)..(382): n is a, c, g, or t
  modified_base (474)..(474): a, c, t, g, unknown or other
  misc_feature (474)..(474): n is a, c, g, or t
tcagagctcacgtacacgaccggtgctcgatttagcactcgcacgttgggtttggggcagcttcagctgtggtagagaagacaggattcaggacaatctccagcatggccggcttccctctcctcctcaccctcctcactcactgtgcagggtcttgggcccagtctgtgctgactcagccaccctcagcgtcgtcgggacccccggnagacggtcaccatctcttgttctggaagcagctaccaatatcggaaatgataatgtatactggtaccagcaacgtccccaacgaaccggcccccaaactcctacatctaataacaatgatcagccgccctcgacggggtccctggccgtattctcgtggcctcaagtctggccncctcgacgcccacccgtcggccagtcgaggtcgggcctcccgggcccgaggactcggaggctgtaattattactggttgtaggttggatcgnacgtctgactgtcttcgtcgttcggagtcgtgggaacctacggtccacccgttcgtacggtcaccggacccaaggcccctaaaccccg

SEQ ID NO: 163380 - DNA, 587 bp, Homo sapiens
  misc_feature: GYAE6OF01B22V0.47.55.E11.1.454.CMB.1.raw
  modified_base (206)..(206): a, c, t, g, unknown or other
  misc_feature (206)..(206): n is a, c, g, or t
  modified_base (229)..(229): a, c, t, g, unknown or other
  misc_feature (229)..(229): n is a, c, g, or t
  modified_base (245)..(245): a, c, t, g, unknown or other
  misc_feature (245)..(245): n is a, c, g, or t
  modified_base (346)..(346): a, c, t, g, unknown or other
  misc_feature (346)..(346): n is a, c, g, or t
  modified_base (355)..(355): a, c, t, g, unknown or other
  misc_feature (355)..(355): n is a, c, g, or t
  modified_base (478)..(478): a, c, t, g, unknown or other
  misc_feature (478)..(478): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccgggnagacggtcaccatctcttgttcnggaagcagctcaatancggaaatgataatgtataactggtaccagcaagtcccaacgaaccggacccccaaactcctcatctaataacaactgatcagccggcctcgacgggtcccnggccattcnctggctccaagtcgtcggccgtcctaccacgccctaacccgtggacccatccgaggtcggggcctcccgggccggaggatcgaggtctagatttattacgtggttacgttagggttggatcgntacgcctgacctgccttacgttccgtcggacgcgtcgggacctaacgggtcccaacccggtcgttaccggtccaccggaccccgaacggtacccccaaaccccgtaccg

SEQ ID NO: 163381 - DNA, 189 bp, Homo sapiens
  misc_feature: GYAE6OF01DRL1M.47.55.E11.1.454.CMB.1.raw
  modified_base (186)..(189): a, c, t, g, unknown or other
  misc_feature (186)..(189): n is a, c, g, or t
tcagagctcacgtacacgaccggtgctcgatttagcactcgcacgttgggatcgcagcctgactgcttacgtcttcggagctgggaccaaggtcaccgtcctaggtcagcccaaggccaaccccactgtcactctgttcccgccctcctctacgtgagctctgagcgggctggcaaggcgcatagnnnn

SEQ ID NO: 163382 - DNA, 608 bp, Homo sapiens
  misc_feature: GYAE6OF01EM1CX.47.55.E11.1.454.CMB.1.raw
  modified_base (205)..(205): a, c, t, g, unknown or other
  misc_feature (205)..(205): n is a, c, g, or t
  modified_base (228)..(228): a, c, t, g, unknown or other
  misc_feature (228)..(228): n is a, c, g, or t
  modified_base (377)..(377): a, c, t, g, unknown or other
  misc_feature (377)..(377): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccacctcagcgtctcgggacccccggnagacggtcaccatctcttgttcnggaagcagctccaatatcggaaatgaataatgtatactggtaccagcaacgtcccaacgaaccggcccccaaactcctacatctaataacaatgatcagccggcctcgacgggtccctggccgtattctctggcctccaagtctggccncctcacgcccaccctcggaccatcgaggtcgggccctccggcccgaggactggacggtctgtatttacttacgttggttggttagggttgggactcggacgtacgtccttgacgtcgtaccgtttacggtccgttacgggacgtcggtacgggtaaccctaagggtcccgtacccggttccgtaacgggttccgaaccggaccccgaaaccggaccccaaacccccgtacg

SEQ ID NO: 163383 - DNA, 744 bp, Homo sapiens
  misc_feature: GYAE6OF01B7NJ6.47.55.E11.1.454.CMB.1.raw
  modified_base (186)..(186): a, c, t, g, unknown or other
  misc_feature (186)..(186): n is a, c, g, or t
  modified_base (206)..(206): a, c, t, g, unknown or other
  misc_feature (206)..(206): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctnagcgtcgtcgggaccccggnaggacggtcaccatctcttgttctggaagcagctaccaatatacggaaatgaataatagtaatacgtaggtaccagacaacgtccccaacggaacccggacccccaaaactccctacactacctaataacaatgatcagccgcctacgacgggtcctggccgtattctctcggctaccgaagtcgtaggcccgtacctacgacgtccctacccgtcggacctaatccgtaacggtccgggtccctaccccggggacccggaagggtagtacgggtacggtaccgttacggtaaacttttacgtttaaccgttgggtttaacgggtttaacggggtttcgggtaacttacccgggaccgtacggtacccgtttaggtaaccgtttcgttaacccgtttaaccggtttccggttacggggtaaccgtccggtttaaaccgggggtaaccctaaccggggttcccaaaccccgggtttcccgtaaacgggttcccgaaccgtacccccggaaaaccgggtcccccaaaaccccgttaccgg

SEQ ID NO: 163384 - DNA, 127 bp, Homo sapiens
  misc_feature: GYAE6OF01EDREH.47.55.E11.1.454.CMB.1.raw
  modified_base (126)..(127): a, c, t, g, unknown or other
  misc_feature (126)..(127): n is a, c, g, or t
tcagagctcacgtacacgaccggtgctcgatttagcactcgcacgttgggtttgggtgccgaagttgctgcctggtcaaggactacttcctacgtgagctctgagcgggctggcaaggcgcatagnn

SEQ ID NO: 163385 - DNA, 532 bp, Homo sapiens
  misc_feature: GYAE6OF01DUYWV.47.55.E11.1.454.CMB.1.raw
  modified_base (360)..(360): a, c, t, g, unknown or other
  misc_feature (360)..(360): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggatccctgagactctcctgtgtagtctctggaatcagtttcagtaccttctggatgcactgggtccgccaaactccgaggtaaggggctggtgtgggtctcacgtatcaatcctgatggcagtgttaataaattangcgactccgtgagggccattcagcatctccagagaacaacgcaagagtatactgtatcgtagaatgaacaatctagagagtcgacgagtacgctgtctatctattgttgtttcgattcgtccttccgggtccgtcgggtaccttcggtcggggaccgtgggaacccgtcggg

SEQ ID NO: 163386 - DNA, 183 bp, Homo sapiens
  misc_feature: GYAE6OF01A6UO7.47.55.E11.1.454.CMB.1.raw
  modified_base (176)..(183): a, c, t, g, unknown or other
  misc_feature (176)..(183): n is a, c, g, or t
tcagagctcacgtacacgaccggtgctcgatttagcactcgcacgttgggtttggggggaagaggaagactgacggccctgctccaggagcacctccgagagcacagcggccctgggctgcctggtcaaggactacttcctatgtatactctgagcgggctggcaaggcgcatagnnnnnnnn

SEQ ID NO: 163387 - DNA, 187 bp, Homo sapiens
  misc_feature: GYAE6OF01A9JSC.47.55.E11.1.454.CMB.1.raw
  modified_base (186)..(187): a, c, t, g, unknown or other
  misc_feature (186)..(187): n is a, c, g, or t
tcagagctcacgtacacgaccggtgctcgatttagcactcgcacgttgggatcgcagcctgactgcttacgtcttcggagctgggaccaaggtcaccgtcctaggtcagcccaaggccaaccccactgtcactctgttcccaccctcctctacgtgagctctgagcgggctggcaaggcgcatagnn

SEQ ID NO: 163388 - DNA, 739 bp, Homo sapiens
  misc_feature: GYAE6OF01BB4XM.47.55.E11.1.454.CMB.1.raw
  modified_base (198)..(198): a, c, t, g, unknown or other
  misc_feature (198)..(198): n is a, c, g, or t
  modified_base (298)..(298): a, c, t, g, unknown or other
  misc_feature (298)..(298): n is a, c, g, or t
  modified_base (311)..(311): a, c, t, g, unknown or other
  misc_feature (311)..(311): n is a, c, g, or t
tcagagctcacgtacacgaccggtgctcgatttagcactcgcacgttggggtttaggggggagagaagacaggattcaggacaatctccagcatggccggcttccgtctcctcctcaccctcctcactcactgtgcgagggtcttgggcccagtctgtgctcgactcacgccaccctcagcgtcgtcgggaccccggnagacggtcacatctcttgtctggaacgcaggctcaatagtacggaaatgaataatgtatactacggtacaagacaacgtaccacgaaccgacccaactcncatctatacaatnatcacgcgcctcgacgggtcctgaccgtacttctcgtggcctaccgtaagtcgtcggaccgtcctacgaccgtcccgtaaccctcgggcctacgttaccgacgggtccgggtaccgtcccgggtacccgggaaggtacgttcgggtaacggtccgttaacggttaacgttttaaacggttaacgttagggtttcgggttaacgggtttacgggtaactaccggtacgaaccgggtaccgttcggtaacgttacggttaccgttaccgggtttacggtacggggttaccgggacggttacgggggaaccttaccgggtacctacccggtcggttaaccggtaccgtaacccggaacccggtaaaccgtccccgaaaccccttacggtacccgtcgaccctttccgttacccggttccccgtacccccgg

SEQ ID NO: 163389 - DNA, 550 bp, Homo sapiens
  misc_feature: GYAE6OF01DW1GR.47.55.E11.1.454.CMB.1.raw
  modified_base (208)..(208): a, c, t, g, unknown or other
  misc_feature (208)..(208): n is a, c, g, or t
tcagagctcacgtacacgaccggtgctcgatttagcactcgcacgttgggtttggggcagcttcagctgtggtagagaagacaggattcaggacaatctccagcatggccggcttccctctcctcctcaccctcctcactcactgtgcagggtcttgggcccagtctgtgctgactcagccaccctcagcgtcgtcgggacccccggnagacggtcaccatctcttgtctggaagcagctcaatatcggaaatgataatgtatactggtaccagcaagtcccacgaaccggcccccaaactcctcatctaataacaatgatcagcgccctgacgggtccctggccgattctctcggctccaagtctaggccgcctcacgcccacccgtggccatcgaggtcggcctcccggcccgaggagtgaggctagtattattacgtgtggtagggttggtatcgcagtcctgactgtcttacgtcgttacggacgcgtgggacctacggtaccgacccgttcctacggtccaacgcccaacggcccctaaaccccg

SEQ ID NO: 163390 - DNA, 697 bp, Homo sapiens
  misc_feature: GYAE6OF01C9EPR.47.55.E11.1.454.CMB.1.raw
  modified_base (135)..(135): a, c, t, g, unknown or other
  misc_feature (135)..(135): n is a, c, g, or t
  modified_base (139)..(139): a, c, t, g, unknown or other
  misc_feature (139)..(139): n is a, c, g, or t
  modified_base (235)..(235): a, c, t, g, unknown or other
  misc_feature (235)..(235): n is a, c, g, or t
  modified_base (364)..(364): a, c, t, g, unknown or other
  misc_feature (364)..(364): n is a, c, g, or t
  modified_base (413)..(413): a, c, t, g, unknown or other
  misc_feature (413)..(413): n is a, c, g, or t
tcagagctcacgtacacgaccggtgctcgatttagcactcgcacgttgggtttggggagccgcagccctgggattcccagctgtttctgcttgctgatcaggactgcacacagagagctcaccatggagtctggntggntcgtggtttaccgtgtcgacttacgtttaaagtgtcagtgtgaggtgcgaggtgtggaggtccgggggagcttagtcagccgtggggattccaggnctctccgtgtgtatctgtaggaatctaggtttcagttacctttgaggtattccgacgtcgggtcctaccaaacgtccgaagggttagggctgggtcgtgggtctaccgagtaattccaatccgtaggtntggactaagttgttaaaacttaagtttagcggtcggtaaccttccgggnggacggggtcctagttacacggtacaacgttccgtccgaaaggtaacgaaccggtaaagaaccgtaaaggtacttagttaaaccgtagttaacgtcgtttaaaggtaaaacctcggaaactaacgtacgttacgtaaggtaggtaacggaacgtaacgtacggtacgttacgtacgttaacttacgtagtttgtttacggtttcgtagttcggtccggttccggtccggtaccggttccggttacggtaccgggtaccgggtaccgggtacccgggttaccggg

SEQ ID NO: 163391 - DNA, 128 bp, Homo sapiens
  misc_feature: GYAE6OF01CAIE3.47.55.E11.1.454.CMB.1.raw
  modified_base (126)..(128): a, c, t, g, unknown or other
  misc_feature (126)..(128): n is a, c, g, or t
tcagagctcacgtacacgaccggtgctcgatttagcactcgcacgttgggtttgggtgccgaagttgctgcctggtcaaggactacttcctacgtgagctctgagcgggctggcaaggcgcatagnnn

SEQ ID NO: 163392 - DNA, 717 bp, Homo sapiens
  misc_feature: GYAE6OF01C3R82.47.55.E11.1.454.CMB.1.raw
  modified_base (575)..(575): a, c, t, g, unknown or other
  misc_feature (575)..(575): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggttttccttgttgctacttttaaaaggtgtccagtgtgaggtgcgaggtagtgggaggtccgggggaggtcttagttcgaggccgtgggggacgtcccgtgagacctctcctgtgtagtctcgtggaatctagtttcagttaccttgtggatcgctacgtcgggtaccacctaaacgtccgaagggtaagggcttgggtgtagggtctcgtacgtatacaactccgtagagtggctagttagttaaataaagttgtacggtccggtacgtccgggtagggacggggtaccgtagttaccgaggtacctacgtaccgtacgaaggacgaacgaacggtacgaaaggtacgtacgtacgttagtaactacgtaaaggtaactaacgaactaacttcggtaagaaggacggttaccgaacgtaagtaccgggtnttacgtaacttagttacttagtttcgtttacggtttaccggtagttcccggtttcccgggttaccgggttccccgggtaccgggtttaccggttacccggggtacccggggtaccccggtaacggggtaaccccgttcgggg

SEQ ID NO: 163393 - DNA, 642 bp, Homo sapiens
  misc_feature: GYAE6OF01CWBZW.47.55.E11.1.454.CMB.1.raw
  modified_base (517)..(517): a, c, t, g, unknown or other
  misc_feature (517)..(517): n is a, c, g, or t
  modified_base (566)..(566): a, c, t, g, unknown or other
  misc_feature (566)..(566): n is a, c, g, or t
  modified_base (623)..(623): a, c, t, g, unknown or other
  misc_feature (623)..(623): n is a, c, g, or t
  modified_base (625)..(626): a, c, t, g, unknown or other
  misc_feature (625)..(626): n is a, c, g, or t
  modified_base (628)..(632): a, c, t, g, unknown or other
  misc_feature (628)..(632): n is a, c, g, or t
  modified_base (634)..(642): a, c, t, g, unknown or other
  misc_feature (634)..(642): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggttttccttgttgtcttacgttttaaaaggtgtccagtgtgaggtgcgaggtagtggaggtccgggggagtcttagttcagccgtggggacgtccctgacgactctccgtgtgtagtctcgtaggaattcgtagtttcacgttaccttcgtggtactgcctacggtcggtccccgaacctaaaaccgtccggaagggtaaccggggccaacgggaacccgtggtacgacgtccgttcctccgtccgacgccctaccgaaccgacggccctacgttcccgtcccttccccgcggccccgtcccgtcgccgtaccgacggacacccaccgtccgacgaccgacgaaccgaccggtcccgggccccgtggggtccncgggtccgttaccgggtacgtaaccggtaccttacccgttccgtaaggngtacctcgtacgtggaccgggtccgggtatacgggaccgtaagggccaagactaggngnngnnnnngnnnnnnnnn

SEQ ID NO: 163394 - DNA, 770 bp, Homo sapiens
  misc_feature: GYAE6OF01D4D5Q.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtcgtgggctgagtcgttgggttttccttgttgcttacttttaaaaggtgtccagtgtgaggtgcgaggtagtgggaggtccggggagtcttagttcgaggccgtggggtacgtccgtgagacttctccgtgtgtagtctcgtagaactctagtttcgaacgttaccgttcgtaggattcgaccgtacggttcgggtaccccgaacccgtaaaaccgtccggtaaggggttaaacggggtccgttggggttcgggttcgggtacctacgtaacggttaactacgtaaacgttccgtaggtacgtcgggtacttaaggtttaagtttaaaagttaaaagtttacgtcgggtaaccggtaccgttccgggtagggaacggggttacctaagttcgaacggtctacgttaccgtaccgaaagacgaaaccgtacggaactaaaggtaacgttaactacgttagtaacgttacggtaaagtaaagtacggaaactaacgttacgtaggaacgtacggttaccgaaacgtaacggtacggttacttagtacgttatacgttagttgttttcgttacgtgttcccggttcgttccggtccggtacggttaccggttacggtacggggacccgttaaggtcccggttcgg

SEQ ID NO: 163395 - DNA, 440 bp, Homo sapiens
  misc_feature: GYAE6OF01BXDXB.47.55.E11.1.454.CMB.1.raw
  modified_base (290)..(290): a, c, t, g, unknown or other
  misc_feature (290)..(290): n is a, c, g, or t
  modified_base (323)..(323): a, c, t, g, unknown or other
  misc_feature (323)..(323): n is a, c, g, or t
  modified_base (326)..(326): a, c, t, g, unknown or other
  misc_feature (326)..(326): n is a, c, g, or t
  modified_base (337)..(337): a, c, t, g, unknown or other
  misc_feature (337)..(337): n is a, c, g, or t
  modified_base (346)..(346): a, c, t, g, unknown or other
  misc_feature (346)..(346): n is a, c, g, or t
  modified_base (350)..(350): a, c, t, g, unknown or other
  misc_feature (350)..(350): n is a, c, g, or t
  modified_base (422)..(440): a, c, t, g, unknown or other
  misc_feature (422)..(440): n is a, c, g, or t
tcagagctcacgtacacgaccggtgctcgatttagcactcgcacgttgggtttggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccggggagcttagtcagcctggggatccctgagactctcctgtgtagtctctggaatcagtttcagtaccttctggatgcacgtgggtccnccaaactccagcctcacaggccatcgtctcccngcncctgctcagancactcgagncacngcgcctggctgcctgcaaggctactcctaagtgacgctctgacgtcgggctgggcaacggcgaccagtagcnnnnnnnnnnnnnnnnnnn

SEQ ID NO: 163396 - DNA, 557 bp, Homo sapiens
  misc_feature: GYAE6OF01CG4AR.47.55.E11.1.454.CMB.1.raw
  modified_base (530)..(537): a, c, t, g, unknown or other
  misc_feature (530)..(537): n is a, c, g, or t
  modified_base (539)..(557): a, c, t, g, unknown or other
  misc_feature (539)..(557): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcacgtcgggtcccgaccaaactccacgccctcccaacccgaacgggcccctatccggttcccttccccccgtgggcccgtcccctcgcctccgaggcgcccacccgtaccgacgacgccacgacggccggccccgtgggcctcggcccgtagggtaccgaaacggtccttaacccgttccgtaaccggtgtacgtccgtacgtcggacggccggggtctgggaccgaacggggtccgactaacgtagcnnnnnnnngnnnnnnnnnnnnnnnnnnn

SEQ ID NO: 163397 - DNA, 711 bp, Homo sapiens
  misc_feature: GYAE6OF01DWZO7.47.55.E11.1.454.CMB.1.raw
  modified_base (179)..(179): a, c, t, g, unknown or other
  misc_feature (179)..(179): n is a, c, g, or t
  modified_base (654)..(654): a, c, t, g, unknown or other
  misc_feature (654)..(654): n is a, c, g, or t
tcagagctcacgtacacgaccggtgctcgatttagcactcgcacgttagggtttggggccgcagccctgggatttcccaggctggtttctgcttgctggatcacggactgacacacagagaggctcaccatggagtctgggctgagctgggttttccttgttgtcttacttttaaaggngtccagtgtggagtgctaggtagtggagtcggggaggctagtcagcctgggtctccgtgacgtctcctccgtaggtcgtacgttcctcgtacgtactcgtaccgttcgacttacctgtagacgtacgacgaggtcggtaccacgaaccgtacggtacgggtacggtcgtggtcggtcggtactacgtacgtactacctacgtcgtagtcgtcgacgtaggttacgttaattaagttacgtacgggtaccgtacggttaccggtaggggtcggtacgtacgttacgacgtactacgttacccaggaacgaacggaaacgaccgtagaaaaggttattaccgttagtaggttcctaaggtaaggtaaacctaggtaaacctaacgttcgggaagaacggttacggaaacccgagggtaaaccctcgggttaacttacgttaccttaaggttccttgttttccgggtttagttaccgnttccggttccccgtacgggcggtaaccgttgttaccgggcggaccgtagttcggacg

SEQ ID NO: 163398 - DNA, 695 bp, Homo sapiens
  misc_feature: GYAE6OF01B4G6R.47.55.E11.1.454.CMB.1.raw
  modified_base (207)..(207): a, c, t, g, unknown or other
  misc_feature (207)..(207): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctcgggacccccgggnagacggtcaccatctcttgttctggaagcagctccaatatcggaaatgataatgtatactggtaccagcaagtcccacgaaccggccccaaactcctcatctataacatgatcagccgccctcgacgggtccctggccgtattctcgtcggcctccaagtctcgggccgcctcgacgcccacccgtcggccactcgacggtcgggtcccgtcccgggcccggaaggagtcggacggtcgtagtaactttacgtttaacgttggttacgggtttagggttcgggtaacttccgggaccgtaacggtcccgttacgggtaccttcggtacccgttttaacggttccggtttaccggggacgttaccgggttaccgggggtaaaccccgtaacggggtccccgttaaccccgggttaccccgttaacggggttacccaacccgggaaccccccgtaaaccgggacccccccgtaaaacccccggtacccgg

SEQ ID NO: 163399 - DNA, 628 bp, Homo sapiens
  misc_feature: GYAE6OF01DXLE4.47.55.E11.1.454.CMB.1.raw
  modified_base (557)..(557): a, c, t, g, unknown or other
  misc_feature (557)..(557): n is a, c, g, or t
tcagagctcacgtacacgaccggtgctcgatttagcactcgcacgttgggtttggggagccgcagccctgggattcccagctgtttctgcttgctgatcaggactgcacacagagagctcaccatggagtctgggctgagcttgggttttccttgttgcttacttttaaaaggtgtccagtgtgaggtgcaggtagtggaggtccggggaggcttagttcagccgtggggagtccctgagactctcctgtgtagtctctggaatctagtttcagttaccttctggatgcacgtcggggtcccgaccaaaacgtccgaagggtaacggggcttgggtggtgggtctcgaacgtatcaactcctgagtggactagttagttaataaatttatggccggtactccggtaggacggggtacctagttacgagactaactcctaccgagaacgaacgaacggacaaagtagtatacgtagtactacgtaggtaaatagaaactagtctaggaagtagtcgaacgtagtacggcttgtactatctagtttcgttgttttacgngttcggtcccgtttcgggtcccgggtccgggtaccgtttcggtacgggggtcccgacggggttaaccccgg

SEQ ID NO: 163400 - DNA, 562 bp, Homo sapiens
  misc_feature: GYAE6OF01C745Y.47.55.E11.1.454.CMB.1.raw
  modified_base (431)..(431): a, c, t, g, unknown or other
  misc_feature (431)..(431): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcacgtgggtcccgaccaaaacgtccgaagggtaacggggcgtgggtggtgggtctcgacgtatcaatcctgatggctagttagtttaataaattatggcggtactccggtggacggggccgtattcagtcatcctaccagagacaacganaagagtatactgtatcgtagaaatgaactatctagagagtacgacgagtacgctgtctatctattgttgtttcgattcggtccgttcgggtccgtacgggtcgttcggtacggggccacgggtacccgtgg

SEQ ID NO: 163401 - DNA, 602 bp, Homo sapiens
  misc_feature: GYAE6OF01DOZIY.47.55.E11.1.454.CMB.1.raw
  modified_base (369)..(369): a, c, t, g, unknown or other
  misc_feature (369)..(369): n is a, c, g, or t
  modified_base (374)..(374): a, c, t, g, unknown or other
  misc_feature (374)..(374): n is a, c, g, or t
  modified_base (392)..(392): a, c, t, g, unknown or other
  misc_feature (392)..(392): n is a, c, g, or t
  modified_base (564)..(564): a, c, t, g, unknown or other
  misc_feature (564)..(564): n is a, c, g, or t
  modified_base (570)..(570): a, c, t, g, unknown or other
  misc_feature (570)..(570): n is a, c, g, or t
  modified_base (572)..(576): a, c, t, g, unknown or other
  misc_feature (572)..(576): n is a, c, g, or t
  modified_base (578)..(578): a, c, t, g, unknown or other
  misc_feature (578)..(578): n is a, c, g, or t
  modified_base (580)..(583): a, c, t, g, unknown or other
  misc_feature (580)..(583): n is a, c, g, or t
  modified_base (585)..(586): a, c, t, g, unknown or other
  misc_feature (585)..(586): n is a, c, g, or t
  modified_base (588)..(594): a, c, t, g, unknown or other
  misc_feature (588)..(594): n is a, c, g, or t
  modified_base (596)..(602): a, c, t, g, unknown or other
  misc_feature (596)..(602): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggttttccttgttgctcttttaaaaggtgtccagtgtgaggtgcaggtagtggaggtccggggagcttagttcagccgtggggagtccctgagactctcctgttgtagtctcgtaggaattcgtaagttttcaagttaccctttctgggattgcctacgtcggggtcccacccaaaactcccaagccctaccaccgaacgggccctagtccggtcccttcccccgnggccncccctgcctccgaggacnccacccgtccgaagacgccaaccgacggcccggtccccgttggggcccttcggcccgttagggtaccgtaaaacgggtccctttaacctttccccgtaaacggttacgtccgtacgttacgggacggtccggggtacgtacgggaccgtaaacggggccgacgtaagtaagngagacngnnnnngngnnnngnngnnnnnnntnnnnnnn

SEQ ID NO: 163402 - DNA, 550 bp, Homo sapiens
  misc_feature: GYAE6OF01DGA17.47.55.E11.1.454.CMB.1.raw
  modified_base (206)..(206): a, c, t, g, unknown or other
  misc_feature (206)..(206): n is a, c, g, or t
  modified_base (245)..(245): a, c, t, g, unknown or other
  misc_feature (245)..(245): n is a, c, g, or t
  modified_base (377)..(377): a, c, t, g, unknown or other
  misc_feature (377)..(377): n is a, c, g, or t
  modified_base (425)..(425): a, c, t, g, unknown or other
  misc_feature (425)..(425): n is a, c, g, or t
  modified_base (455)..(455): a, c, t, g, unknown or other
  misc_feature (455)..(455): n is a, c, g, or t
  modified_base (485)..(485): a, c, t, g, unknown or other
  misc_feature (485)..(485): n is a, c, g, or t
tcagagctcacgtacacgaccggtgctcgatttagcactcgcacgttgggtttggggagcttcagctgtggtagagaagacaggattcaggacaatctccagcatggccgcttccctctcctcctcaccctcctcactcactgtgcagggtcttgggcccagtctgtgctgactcagcccaccctcagcgtctcgggacccccggnagacggtcaccatctcttgttctggaagcagctacaatntacggaaatgaataatgtatactggtaccagcaagtcccacgaaccggccccaaactcctcatctaataacatgatcagccgccctgacgggtccctggcctattctcgtggcctaccgaagtcctgggccncctcacgcccacccgtggcccatcgaggtcgggcctccgggcccgagntcggagctgatttatacgtggtgtggtggntcgctagcctgactgcgttacgtcgtcggngcgtcgggacctaaggtcccaaccggttcgacggtcaacgcccgaaacggcccctaacccgtacg

SEQ ID NO: 163403 - DNA, 593 bp, Homo sapiens
  misc_feature: GYAE6OF01AWM6U.47.55.E11.1.454.CMB.1.raw
  modified_base (207)..(207): a, c, t, g, unknown or other
  misc_feature (207)..(207): n is a, c, g, or t
  modified_base (370)..(370): a, c, t, g, unknown or other
  misc_feature (370)..(370): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctcgggacccccgggnagacggtcaccatctcttgttctggaagcagctccaatatcggaaatgataatgtatactggtaccagcaagtcccacgaaccggcccccaaactcctcatctataacaatgatcagccgcctcgacgggtccctggccgattctctgctccaagtctggccncctcacgccaccctggccatcaggtcgggcctcccgggacccgaggactggacggtctacgtatttacttacgtggttaggttagggttgggaattccgactacggtcctgtaccgtgtccttaccggttcgttaccgggagtccggtaggggtaacccaacgggttccaaccccggttccgtagggtaccacggaccccaacgggccccaaacccccgtacg

SEQ ID NO: 163404 - DNA, 676 bp, Homo sapiens
  misc_feature: GYAE6OF01CLRJF.47.55.E11.1.454.CMB.1.raw
  modified_base (418)..(418): a, c, t, g, unknown or other
  misc_feature (418)..(418): n is a, c, g, or t
tcagagctcacgtacacgaccggtgctcgatttagcactcgcacgttgggtttgggggggggaagctcagcttcagctgtggtagagaagacaggattcaggacaatctccagcatggccggcttccctctcctcctcaccctcctcactcactgtgcagggtcttgggcccagtctgtgctgactcacgccaccctcacgcgtcgtcggggacccccgggcagacggtcaccatctcttgttctggaagcagcctaccaatatacggaaatgaataatgtaatacgtggtaccagacaacgtccccaccgaaccggcccccaaactcctacatactaataaacaatgatcgacgccggccctcgacggggtccctggccgtatttccgtcgtcggcctaccgaagttccgtggcccncctcgaccgccctacccgtcggcctacgtcgacggtcgggccgtcccgggacccggagggtactcggacggtcttacgtaatttacgttacgttgggttacggttaggggttcgggtacgttccgcgtaacggtccgtaggtaccgttcggtaccgtttacggtccgtttcgggacggtaccggttacggggaacccgtaaacgggttcccgtaacccggttaccggttaggtacccaccggtaaccccgaaaccggg

SEQ ID NO: 163405 - DNA, 584 bp, Homo sapiens
  misc_feature: GYAE6OF01ETRYP.47.55.E11.1.454.CMB.1.raw
  modified_base (192)..(192): a, c, t, g, unknown or other
  misc_feature (192)..(192): n is a, c, g, or t
  modified_base (332)..(332): a, c, t, g, unknown or other
  misc_feature (332)..(332): n is a, c, g, or t
  modified_base (398)..(398): a, c, t, g, unknown or other
  misc_feature (398)..(398): n is a, c, g, or t
tcagagctcacgtacacgaccggtgctcgatttagcactcgcacgttgggtttggggagagaagacaggattcaggacaatctccagcatggccggcttccctctcctcctcaccctcctcactcactgtgcagggtcttgggcccagtctgtgctgactcagccaccctcagcgtcgtcgggacccccggnagacggtcaccatctcttgtctggagcagctccaatatcggaaatgatatgtatactgtaccagcaagtcccacgaaccgccccaaactcctcatctaataacaatgatcagccgccctgacgggtccctggcctattcnctcggcctacgaagtcgtggccgcctcgacgcccaccgtgccatcgagtcgggcctccggccgagntcgagctagtacttagttacgtgtaggtaggtcggatcgcacgtccgtgtaccgtcgtaccgttacgttcgttacggacgtcgtacgggaacctaacggtccgacccgttacgtaggtccgacgacccgtaacccgacccgaaccccgtactcgtacctaccttaccttcccgtcccgtacccccg

SEQ ID NO: 163406 - DNA, 688 bp, Homo sapiens
  misc_feature: GYAE6OF01CJ4K2.47.55.E11.1.454.CMB.1.raw
  modified_base (172)..(172): a, c, t, g, unknown or other
  misc_feature (172)..(172): n is a, c, g, or t
  modified_base (196)..(196): a, c, t, g, unknown or other
  misc_feature (196)..(196): n is a, c, g, or t
  modified_base (224)..(224): a, c, t, g, unknown or other
  misc_feature (224)..(224): n is a, c, g, or t
tcagagctcacgtacacgaccggtgctcgatttagcactcgcacgttgggtttggggagagaagacaggattcaggacaatctccagcatggccgcttccctctcctcctcaccctcctcactcactgtgcagggtcttgggcccagtctgtgctgactcacgcccaccctnaggcgtccgtcggggacccccggnaggacggtcaccatctcttgtcaggaancagctacaaatacgtacggaaatgaataatgtaatactggtaccagacaacgtacccaaccggaacccgacccctaaactcctacactactaaactaaacaatgactacaacggcccgaccgtcgaacggggtcccctgggaccgtattccgtcgtggtacccttacaaggtccgtacggcctcctcgaacgtcccaacccgtggacctaagtcgacgggtcgggtcccgtaccgggacccggtaggacgtagggaacggtcctaagttaacgtttacgttaaggtcggttagggttaacgggttgggacttcggacgtaacggccttacgtaccgtcgttaccgttacggttccgtagggacgtacgtacggaaccgtacggtcctaccggttcacggtacacgaacccgaccggaccctaaccccagttcccgtaactccgtaccgttccgtcccctacccg

SEQ ID NO: 163407 - DNA, 485 bp, Homo sapiens
  misc_feature: GYAE6OF01CKEAK.47.55.E11.1.454.CMB.1.raw
  modified_base (353)..(353): a, c, t, g, unknown or other
  misc_feature (353)..(353): n is a, c, g, or t
  modified_base (375)..(375): a, c, t, g, unknown or other
  misc_feature (375)..(375): n is a, c, g, or t
  modified_base (386)..(386): a, c, t, g, unknown or other
  misc_feature (386)..(386): n is a, c, g, or t
  modified_base (408)..(408): a, c, t, g, unknown or other
  misc_feature (408)..(408): n is a, c, g, or t
  modified_base (438)..(438): a, c, t, g, unknown or other
  misc_feature (438)..(438): n is a, c, g, or t
  modified_base (467)..(467): a, c, t, g, unknown or other
  misc_feature (467)..(467): n is a, c, g, or t
  modified_base (471)..(485): a, c, t, g, unknown or other
  misc_feature (471)..(485): n is a, c, g, or t
tcagagctcacgtacacgaccggtgctcgatttagcactcgcacgtagggtcttgggcccagtctgtgctgactcagccaccctcagcgtctcgggacccccgggcagacggtcaccatctcttgttctggaagcagctccaatatcggaaatgataatgtatactggtaccagcaagtcccacgaaccgcccccaaactcctcatctaataacaatgatcagccggccctcgacggggtccctggccgtattctcgtggctccaagtctggccgctcacgcccacctggccatcaggtgggcctccggcccgaggatggaggctagatttattactgtgtaggttggatcgnagctgactgcttagtctcggancgtggacagcncgtctgcacgccagcccaaccntcgtcactctccgtcccacctcctctacgncgctcgtgacggtcggctggcaggcgcanacgnnnnnnnnnnnnnnn

SEQ ID NO: 163408 - DNA, 559 bp, Homo sapiens
  misc_feature: GYAE6OF01A77Q3.47.55.E11.1.454.CMB.1.raw
  modified_base (206)..(206): a, c, t, g, unknown or other
  misc_feature (206)..(206): n is a, c, g, or t
  modified_base (377)..(377): a, c, t, g, unknown or other
  misc_feature (377)..(377): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccgggnagaccggtcaccatctcttgttctggaagcagctaccaatatcggaaatgaataatgtatactggtaccagcaagtcccacgaaccggcccccaaactcctacactctaataacaatgatcagcggtccctcgacggggtccctggccattctctggcctcaagtctggcncctcacgcccacccgtgccagtcaggtcgggcctccgggcccgaggactgaggtctgtatttattacgtggttggttagggttggaactcggcgtacgccttgactcgtcttacggtcgttcggagtcgacgggaccacggtccaccgtccgtaggcacgaccccgaaggccccaaccctcg

SEQ ID NO: 163409 - DNA, 594 bp, Homo sapiens
  misc_feature: GYAE6OF01BPBXZ.47.55.E11.1.454.CMB.1.raw
  modified_base (210)..(210): a, c, t, g, unknown or other
  misc_feature (210)..(210): n is a, c, g, or t
  modified_base (481)..(481): a, c, t, g, unknown or other
  misc_feature (481)..(481): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggttttccttgttgctattaataaaaggtgtccagtgtcaggtgcagctggtggagtcgtggggganacgttggtcaagccgtgggacgggtccctgacgactctcctgtgcacgcctcgtggacttccaccttcagtgacttactacatgagcgtggactccgccgaggcctaccggaaggggacggcgtagggaggtggattgcttacatcgtaaggtagtagtggtaacttacaattactactacgctagtactcgtggtacggaacgggtcctaacttccgacccgtctacggaacggacaaccgacaagagtctattcgatcgtagacgtaanacgaactacggcctaaggacggaacgcggaacgggtacggttccgttaagtcgtgaccggaggacggacgtccctacgttccacccgtatttccgggttcggttcgggtccgg

SEQ ID NO: 163410 - DNA, 695 bp, Homo sapiens
  misc_feature: GYAE6OF01AOQ5O.47.55.E11.1.454.CMB.1.raw
  modified_base (207)..(207): a, c, t, g, unknown or other
  misc_feature (207)..(207): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctcgggacccccgggnagacggtcaccatctcttgttctggaagcagctccaatatcggaaatgataatgtatactggtaccagcaacgtcccacgaaccggcccccaaactcctcatctataacatgatcagccggccctgacgggtcctggccgattctctcggcctcaagtctggcgcctcacgcccaccctggccatcaggtcgggcctccgggacccgagggactggacggtcgtagactttaacgtttacgtggtttacggttagggtttacgggaagttcccggtacgtaacggtcccgttacggtaaccgttcggtaccgttttaacccggtccggttttaccggggtacggtaccgggtttaccggggggaaccccgttaaaccggggttcccgtaaccccccgggtttacccgttaacggggttaccccgaaccgggtaaacccccccggtaaaccgggtaacccccccgtaaaacccccccgttaaaccccgg

SEQ ID NO: 163411 - DNA, 567 bp, Homo sapiens
  misc_feature: GYAE6OF01DSN7A.47.55.E11.1.454.CMB.1.raw
  modified_base (294)..(294): a, c, t, g, unknown or other
  misc_feature (294)..(294): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagccgtggggagtccctgagactctcctgtgtagtctctggaatcagtttcagttaccttctggatgcactgggtccnccaaactccgagggtaacggggctgggtggtgggtctcacgtatcaatcctgatggctagtgtttaataaatttatggacggactccggtggacggggcctattcagctatcctaccgagagaacgaacggcaagagtatactagtatcgtagaatagaactaatcgtagagtagtacgacgatacggctgtactatcgtatttggttgttttcgagttcgtcccggttcggtccggcgggtacttcggcggggaccgacgggtaccctcggg

SEQ ID NO: 163412 - DNA, 645 bp, Homo sapiens
  misc_feature: GYAE6OF01C4ZG9.47.55.E11.1.454.CMB.1.raw
  modified_base (340)..(340): a, c, t, g, unknown or other
  misc_feature (340)..(340): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcacgtcgggtccaccaaaactccgaagggtaacggggctgggtgtcgggtctcaacgtntacaatcctgattcggctagttagttaataaagttagtcggacggtactccggtagggacgggggtcccgtagtttcaggtctaacttcctaccgaaggaacgaaccgaaacgggacaaaggtaacgttacgtactaggttaatacgtaaggtaaattgaaacctaatcgtaggaagtagtaccgaacgtagtacgtctagtctattcgatttggttcgttttacggattacggtcccgtttccgggtcccggtaccgggttctttaccggtcgggggaacccgtacggggtaaccccgttcggg

SEQ ID NO: 163413 - DNA, 614 bp, Homo sapiens
  misc_feature: GYAE6OF01E17DM.47.55.E11.1.454.CMB.1.raw
tcagagctcacgtacacgaccggtgctcgatttagcactcgcacgttgggtttgggggggggaagctcagcttcagctgtggtagagaagacaggattcaggacaatctccagcatggccggcttccctctcctcctcaccctcctcactcactgtgcagggtcttgggcccagtctgtgctgactcagccaccctcagcgtctcgggacccccgggcagacggtcaccatctcttgtctggaagcagctccaatatcggaaatgataatgtatactggtaccagacaacgtccccaacgaaccgacccccaaactcctcatctaataacatgatcagccgtcctcgacggggtccctagaccgattctctggcctaccaagtctagacaccctcacgccctcccgtcgccactccgaggtcgggtccgtcccgggtaccggaggagtaggacggtcgtagtaatttattagttgtgacaacgtagtagggtataggtacgtccgtagtagttaggttggttacggggttttcgggacgggtaacgggtaacccgtaaaccgttacggaacccgttaccgtacggtaccgaccggtaccccgaacgggtccccg

SEQ ID NO: 163414 - DNA, 374 bp, Homo sapiens
  misc_feature: GYAE6OF01ETOU3.47.55.E11.1.454.CMB.1.raw
  modified_base (362)..(362): a, c, t, g, unknown or other
  misc_feature (362)..(362): n is a, c, g, or t
  modified_base (368)..(374): a, c, t, g, unknown or other
  misc_feature (368)..(374): n is a, c, g, or t
tcagagctcacgtacacgaccggtgctcgatttagcactcgcacgttgggttttccttgttgctcttttaaaaggtgtccagtgtgaggtgcaggtagtggagtccggggaggcttagttcagcctggggagtccctgagactctcctgtgtagtctctggaatcagtttcagtaccttctggatgcacgtgggtccgccaaactccagcctccaaccaagggcccatccggtcttccccctggccgccctgcctccaggacgccacctccgagacgccacaggccggcccgtgggcctgccctggtacaaggtaccttacgttcctacggtgacgctcgtgaggcgggctggacaaggcgnagtagnnnnnnn

SEQ ID NO: 163415 - DNA, 785 bp, Homo sapiens
  misc_feature: GYAE6OF01C661N.47.55.E11.1.454.CMB.1.raw
tcagagctcacgtacacgaccggtgctcgatttagcactcgcacgttgggtttggggagccgcagccctgggattcccagctgtttctgcttgctgatcaggactgcacacagagagctcaccatggagtctggctgagtctgggttttcctgttgcttactttaaaggtgtccagtgtgaggtgcgaggtaggtgggagggtccgggggaggtcttaacgtaccgacccggttcggggggtccctgacgtacctccgtcctgtgccacgtcctcgtcggtaccttcgtacctttagcctaaccttccgtagtcgagttcggggtccgttcgggtacccggccgtacggggaccgggtcccggggggtaaggggtccgtggggtacggttcgggtacgttactaaggttagttaggaagtaggtaggtaaggttagggaacggaacgtacgtacgttacgttacgtacgggtacggttacccgtcggtacgggtaccgggttccgtacctaccgtacgtccgaacgtagaaacgtaacttacggtaacggaggtaccgtacgtacgttacgttacgtacttaaacgtaaacgtaacgtaacggacgttacgtacggaaggtaaccgggaccgggtaacggaccggtaaccggttaccggtacgtttaacgttaggttccgtaggtaaccgtaaacgtaacgttagtaaccggtacgtccggtaccccgtaccccgtacccgtacggtcttaaccgtttaccgtttctacgggttccgtaccgggg

SEQ ID NO: 163416 - DNA, 767 bp, Homo sapiens
  misc_feature: GYAE6OF01DIJ4J.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggttttccttgttgtctacttttaaaaggtgtccagtgtgaggtgcaggtagtggagtccggggagcttagtcagccgtggggatccctgagactctcctgtgtagtctctggaatctaagtttcagttaccttcgtgatgctacgtcgggtacccaccaaacgtccgtaaggggtaaggggtcgttgggtggtcgggttctaccgtaacggttaactaccgaaacttccgtggtaacgttcgggacttaaggtttaagtttaaataaaagttttcgtacggaccgggtaccttaccggggtggtaacgggggacccttaatttaccgaaggtcctaacgttaccgttaaccccgaaagggaccgtaaaaccggaaaccgggtactaaaaaggtaacgtttaacgtaacgtttggttaaacttaccgtaaagggtaaaattacggaaactaagttccgtaagaacgtaacggacgtaacgaacgttaaccggcttagttactaattcgttagttttcggtttacgaagttcccgttcccgggttccgggtacccgggttccgggtaacccgtttcgggtaacccggggtaccggaaacccggggttacccgtcgggttaacccg

SEQ ID NO: 163417 - DNA, 672 bp, Homo sapiens
  misc_feature: GYAE6OF01A83DR.47.55.E11.1.454.CMB.1.raw
  modified_base (254)..(254): a, c, t, g, unknown or other
  misc_feature (254)..(254): n is a, c, g, or t
  modified_base (620)..(620): a, c, t, g, unknown or other
  misc_feature (620)..(620): n is a, c, g, or t
tcagagctcacgtacacgaccggtgctcgatttagcactcgcacgttgggtttgggggaagaggaagactgacggtcctgccacaggtggtgctgggcacggtgggcactcgacacaacatttgcgctcaactgtcttgctcaccatggagtctgggctgagctgggttttccttgttgctcttttaaaaggtgtccagtgtgaggtgcaggtagtgggagtccgggggagcttagttcagcctggggatcccngagactctctgtgtagtctctggaatcagtttcagtaccttcgtggtatgccgtacgtcggggtacccgacctaaacgtccgaagggtaacgggtcttgggtgtgggtctacgacgtatacaatcctagacgtggactaggttagtttaattaaaagttgtacggtacggtaccttccggtagggacgggccctaagttccgacggtcctaagttcccgtaccgaaggtaaccgaaccgaaaccggacgtaaaaggtacgttaacttaccgttagttaacgttcgtaaacgggtaaaattacgaaacgttaagttccgtaagacggtaacgtccgaaggtactaccgggtagttacgtagttactnttaggtttcggttgtttacgacttggaccctcgttccgggtccggtaccggg

SEQ ID NO: 163418 - DNA, 553 bp, Homo sapiens
  misc_feature: GYAE6OF01DIBN2.47.55.E11.1.454.CMB.1.raw
  modified_base (204)..(204): a, c, t, g, unknown or other
  misc_feature (204)..(204): n is a, c, g, or t
  modified_base (232)..(232): a, c, t, g, unknown or other
  misc_feature (232)..(232): n is a, c, g, or t
tcagagctcacgtacacgaccggtgctcgatttagcactcgcacgttgggtttggggagcttcagctgtggtagagaagacaggattcaggacaatctccagcatggccgcttccctctcctcctcaccctcctcactcactgtgcagggtcttgggcccagtctgtgctgactcagccaccctcagcgtctgggacccccggnagacggtcaccatctcttgttctggaancagctccaatatcgaaatgataatgtatactggtaccagcaagtcccacgaacggcccccaaactcctcatctaataacaatgatcagccggccctcgacggggtccctggccgtattctcgtggcctccaagtcctggccgcctcacgcccaccctggcccatcgaggtcgggcctccgggcccgaggactggaggctgatttattacgtgtgttaggttggatcgcacgcctgactgcctttacgtcgttcggagtcgtacgggacccaagggttccaccgttccgtaggtccacgcccgaacggcccaaccccgtacg

SEQ ID NO: 163419 - DNA, 622 bp, Homo sapiens
  misc_feature: GYAE6OF01A72WV.47.55.E11.1.454.CMB.1.raw
  modified_base (323)..(323): a, c, t, g, unknown or other
  misc_feature (323)..(323): n is a, c, g, or t
  modified_base (492)..(492): a, c, t, g, unknown or other
  misc_feature (492)..(492): n is a, c, g, or t
tcagagctcacgtacacgaccggtgctcgatttagcactcgcacgttgggttttccttgttgctcttttaaaaggtgtccagtgtgaggtgcaggtagtggagtccggggaggcttagttcagcctggggagtccctgagactctcctgtgtagtctctggaatcagtttcagtaccttctggatgcactgggtccgccaaactccaggtaagggctggtgtgggtctcacgtatcaatcctgatggcagtgttaataaattatgcggactccgtgagggccgattcagcatctccagagacaacggcaagagtatactgtanctggaaatgaacaatctgagagtcgacgatacggctgtctatctaattgtgttttcgattgccgtttcggtccgtcggtacttcgtgggccagggaacctggtcagccgtctcctcacgtccctaccgaccaacgggcccagtcccggttccttccccccgtgggcccnccccgttgcccgttacccgagggtaccgcccgtaaccccgtcccggaacggtacgcccgaacccggaccggacccgggtcccccggtagggggtcccttacgggccccgttgggtacccgtaaaccgggg

SEQ ID NO: 163420 - DNA, 726 bp, Homo sapiens
  misc_feature: GYAE6OF01BVFZN.47.55.E11.1.454.CMB.1.raw
  modified_base (186)..(186): a, c, t, g, unknown or other
  misc_feature (186)..(186): n is a, c, g, or t
  modified_base (364)..(364): a, c, t, g, unknown or other
  misc_feature (364)..(364): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctnagcgtctcgggacccccggagacggtcaccatctcttgtctggaagcagcctaccaatatcggaaatgaataatgtaatacgtggtaaccagcaacgtccccaacggaacccggacccccaaactccctacatactaataacaatgatcagccgcctcgagggtccctggccatttcncgtcggtctaccgtaagtccgtacggccgtaccctcgaaccgtccccgaaccccgttcgggccctaagtccgtaacgggtccggggccccgttacccggggaccccgggaaggtaccgttagggaaccggtccgttaggtaacttttacgtttaacgttgggttagggtttacggggttcgggaactttccgggactaaccggtccttacggaccgtttcggtaccgttttaccggtccggtttacgggaccggtccgggtaacggggtaaccccgtaacgggttcccgtaaccccggttccggtaacgggttacccgacccggaacccccggtaaaccggtccccctaaaacccccggtcg

SEQ ID NO: 163421 - DNA, 697 bp, Homo sapiens
  misc_feature: GYAE6OF01DRE6N.47.55.E11.1.454.CMB.1.raw
  modified_base (208)..(208): a, c, t, g, unknown or other
  misc_feature (208)..(208): n is a, c, g, or t
  modified_base (231)..(231): a, c, t, g, unknown or other
  misc_feature (231)..(231): n is a, c, g, or t
tcagagctcacgtacacgaccggtgctcgatttagcactcgcacgttgggtttggggcagcttcagctgtggtagagaagacaggattcaggacaatctccagcatggccggcttccctctcctcctcaccctcctcactcactgtgcagggtcttgggcccagtctgtgctgactcagccaccctcagcgtcgtcgggacccccggnagacggtcaccatctcttgttcnggaagcagctcaatatacgaatgataatgtaatactggtaccagacaacgtcccaacgaaccggacccccaaactcctacactctaataacaatgactcacgccgccctgacggggtccctggaccttattcctcgtcggtcctaccgaagttccgtcggccgtacccttcgaaccgcccccgtaccccgttcgggaccctacgtaccgtaacggggttccgggaccccggttccccggggaccccgggtaagggtacgttacgggaccgggtcgttaggttaacgtttttaacgttacggtttgggttagggtttacggggtttacgggaacgttccggtaccgacggttccgttaggtaccttcggttaccgtttacgtccggttcggacgtccggtacgggaacccgtaggtacccaccggttaccgtacggtccaaccggaccccaaaggccccctaacccg

SEQ ID NO: 163422 - DNA, 718 bp, Homo sapiens
  misc_feature: GYAE6OF01D5N56.47.55.E11.1.454.CMB.1.raw
  modified_base (343)..(343): a, c, t, g, unknown or other
  misc_feature (343)..(343): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctcgggacccccggcagacggtcaccatctcttgtctggaagcagctccaatatacggaaatgaataatgtatactggtacagcaacgtcccacgaaccgacccccaactcctcatctaataacaatgatcagccggccctcgacgggtccncggccgtattctcgtcggcctaccgaacgttcgtcgggccgccctccgacgcccctaccccgtcggacccagttccgacggttccggggcccgttcccccggggacccggtaagggacgtacgggaacgggtccgttaggtaacttttaacgtttacgttcgggttagggtttaacggggtttcgggggtaacttccggaccgtacggtcccgttacggtaccgttacgggtccctttaccggttaccggtttccgggaacggtccggtaacggggaacccgtaaacggggttcccgtaaaccccgggttcccgttaacgggtacccgaacccgggtaccccgaaacccggggcccccctaaacccccgtaaccg

SEQ ID NO: 163423 - DNA, 777 bp, Homo sapiens
  misc_feature: GYAE6OF01CXU3H.47.55.E11.1.454.CMB.1.raw
  modified_base (229)..(229): a, c, t, g, unknown or other
  misc_feature (229)..(229): n is a, c, g, or t
  modified_base (245)..(245): a, c, t, g, unknown or other
  misc_feature (245)..(245): n is a, c, g, or t
  modified_base (304)..(304): a, c, t, g, unknown or other
  misc_feature (304)..(304): n is a, c, g, or t
tcagagctcacgtacacgaccggtgctcgatttagcactcgcacgttgggtttggggagcttcagctgtggtagagaagacaggattcaggacaatctccagcatggccgcttccctctcctcctcaccctcctcactcactgtgcagggtcttgggcccagtctgtgctgactcagccaccctcagcgtctcgggacccccgggcagacggtcaccatctcttgttcnggaagcagctcaatancggaaatgataatgtatactggtaccagcaacgtcccacgaaccggcccccaaactccncatctaataacaatgatcagccggccctcgacggggtccctggcccgtatttccgtcgttacgggccttacccgaaaggttccgtcgggccgtcccttaccgacggccccaaccccgttcgggacccctacgttaccgaacgggttccggggccccgttccccggggaccccggtaacgggtacgttcgggaacgggtccgttaggtaacgttttaacgtttaaccgttgggtttacgggtttaacggggtttacggggaacgtttcccggaccgtaacggtccccgttaggtaacccgtttcgggtaacccgttttaaccgggttcccggtttaccggggaacggtacccggttaccgggggaaaccccttaaacggggttcccgtaacccccgggtttacccgttaacgggggttacccaaacccgggtaccccccgaaacgggtacccccccaaaaccccccgttaccgg

SEQ ID NO: 163424 - DNA, 534 bp, Homo sapiens
  misc_feature: GYAE6OF01ASB7Q.47.55.E11.1.454.CMB.1.raw
  modified_base (361)..(361): a, c, t, g, unknown or other
  misc_feature (361)..(361): n is a, c, g, or t
  modified_base (511)..(511): a, c, t, g, unknown or other
  misc_feature (511)..(511): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagccgtggggagtcctgagactctcctgtgtagtctctggaatcagtttcagtaccttctggatgcacgtgggtccgccaaactccgaggtaaggggctggtgtgggtctcgacgtatcaatcctgatggcagtgttataaattntgcggactcgtgaggggcattcagcatctccagacgacaacgcaagagtatactgtatcgtaggaaatgaacaatctgagagtcgaacgataacggctgtctatctattgttgtttcgattcgtccttcgggtccgcggtacctttcggngggcccgagggtacccgtacggg

SEQ ID NO: 163425 - DNA, 673 bp, Homo sapiens
  misc_feature: GYAE6OF01BKMBC.47.55.E11.1.454.CMB.1.raw
  modified_base (246)..(246): a, c, t, g, unknown or other
  misc_feature (246)..(246): n is a, c, g, or t
tcagagctcacgtacacgaccggtgctcgatttagcactcgcacgttgggtttggggcagcttcagctgtggtagagaagacaggattcaggacaatctccagcatggccggcttccctctcctcctcaccctcctcactcactgtgcagggtcttgggcccagtctgtgctgactcagccaccctcagcgtctcgggacccccgggcagacggtcaccatctcttgttctggagcagctccaatntcggaaatgataatgtatactggtaccagcaagtccccacgaaccggcccccaaactcctcatctataacatgatcagccggcctcgacggggtccctggcccgtattcctctggcctccgaagtcgtggccgcctcacgcccaccctggcccatcaggtcggcctccgggcccgaggactggacgggtcttaggtaattttacgttaaccgttgggttaggtttaacggggtttagggggtaacttccggtaccgtaacggtcccttggtaacccgttggtacccgtttaccggttccgttacggggtacggtccggttacgggggaacccctaaacggggttccccgtaaccccggtttcccggttaacgggttacccggaacccggtaccccccgggaaggggtacccccctaaaaccccccgg

SEQ ID NO: 163426 - DNA, 612 bp, Homo sapiens
  misc_feature: GYAE6OF01CODJV.47.55.E11.1.454.CMB.1.raw
  modified_base (385)..(385): a, c, t, g, unknown or other
  misc_feature (385)..(385): n is a, c, g, or t
  modified_base (489)..(489): a, c, t, g, unknown or other
  misc_feature (489)..(489): n is a, c, g, or t
  modified_base (515)..(515): a, c, t, g, unknown or other
  misc_feature (515)..(515): n is a, c, g, or t
tcagagctcacgtacacgaccggtgctcgatttagcactcgcacgttgggtttggggccgcagccctgggattcccagctgtttctgcttgctgatcaggactgcacacagagagctcaccatggagtctgggctgagcttggttttccttgttgctacttttaaaaggtgtccagtgtgaggtgcaggtagtggaggtccggggagcttagttcagccgtggggactccctgagactctcctgtgtagtctctggaattcagttttcagttaccttcgtggtatgactacgtcgggtccccgacctaaactccgaggtaagggcgtggtgtcggtctcgacgtatacatccgtagatggactagttagtttaactaaatttagngtacggtacgttccggtaggacggggtcctatttcgacgtcacgtccgtacagacgaacgaacggacaagtaagtatactagttatcgtaagaatagaactatntagagtacgtacgtacgtacgtacgntgtactagtcttagttgttgtttacgagttcggtcccgttccgggtacccggtacggttaccgttcggtacggggaccctacggggtacccgtcggg

SEQ ID NO: 163427 - DNA, 692 bp, Homo sapiens
  misc_feature: GYAE6OF01C0OIM.47.55.E11.1.454.CMB.1.raw
  modified_base (191)..(191): a, c, t, g, unknown or other
  misc_feature (191)..(191): n is a, c, g, or t
  modified_base (214)..(214): a, c, t, g, unknown or other
  misc_feature (214)..(214): n is a, c, g, or t
  modified_base (285)..(285): a, c, t, g, unknown or other
  misc_feature (285)..(285): n is a, c, g, or t
tcagagctcacgtacacgaccggtgctcgatttagcactcgcacgttgggtttggggagagaagacaggattcaggacaatctccagcatggccggcttccctctcctcctcaccctcctcactcactgtgcagggtcttgggcccagtctgtgctgactcagccaccctcagcgtctcgggacccccggnagacggtcaccatctcttgttcnggaagcagctccaatatcggaaatgataatgtatactggtaccagcaagtcccacgacgccccaaatcctnatctataacatgatcagcgcctgagggtccctggccgattctcgtggcctcaagtctggccgtcctcgacgcccaaccctggccctatccgaggtcgggcctcccgggcccgtagggactggacggccttaggaacttttaagttaccgtttgggttacgggttaagggtttcggggaacttccggaccgaacggtcccttaggtaaccttcggtaccgttttaaccggttccgtttccgggaacgtcccgttacggggaaaccctaaacggggttcccaaccccggtttcccggtaagggtacccgaaccggtaacccccgaaacgggtacccccctaaaaccccccgttacgttacggttaccccaacccgtttcccttcccgggtttcccccccgtaccccccg

SEQ ID NO: 163428 - DNA, 723 bp, Homo sapiens
  misc_feature: GYAE6OF01DBOU1.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagtcgttgggttttccttgttgcttacttttaaaaggtgtccagtgtgaggtgcaggtagtggaggtccgggggagtcttagttcagccgtggggatccctgagactctcctgtgtagtctctaggaatctaagttttcagttaccttgtggatgcctacgtcgggtacccaccaaaccgtccgagggtaagggtcgtaggtggtcgggtctacgacgttatactaatccgtgacgtggactagttagtttaataaagttgtcggaccggtacgttcgggtaggacggggtacctattccgagtacgtacttccgaaccgagaacggaaccgaaacccggtaagaaaggttaactaacgttaacttacggttaagtaaccggttaaggaaaacttacgaaaactaacgttacgttaaggaagggaacgttaccggaaacgtacggttaccgttagttacggttaacttaagttcgttaaagttttgtttacggtttcgacgtttccggtaccccgtttccggggtacccggttacgggttacgttaccgggaccggggtaaccgttacgggtaaccccgttcgggg

SEQ ID NO: 163429 - DNA, 718 bp, Homo sapiens
  misc_feature: GYAE6OF01EAYZ4.47.55.E11.1.454.CMB.1.raw
  modified_base (232)..(232): a, c, t, g, unknown or other
  misc_feature (232)..(232): n is a, c, g, or t
  modified_base (242)..(242): a, c, t, g, unknown or other
  misc_feature (242)..(242): n is a, c, g, or t
tcagagctcacgtacacgaccggtgctcgatttagcactcgcacgttggggtttgggggggggaagctcagcttcagctgtggtagagaagacaggattcaggacaatctccagcatggccggcttccctctcctcctcaccctcctcactcactgtgcagggtcttgggcccagtctgtgctgactcacgccaccctcagcgtcgtcggggacccccggagacggtcaccntctcttgtcnggagcagctacaatatacggaatgataatgtatacgtaggtaccagacaacgtcccaacggaacccgaccccaaactcctacatctaataacatgactcacggtccgccgtcggacggggtccctcgggtcctacgtttcgtccgtcggtacctaccgtaacggttccgtcgggccctacccgtaccgaaccgtcccccgtaacccgttcgggacccctagtccggtaacgggtccggggtccccgtacccgggaccccggtagggtacgtcgggacgttccgttagttaacgtttcgttaacggtgggttacgggttagggtcggtaacgttcggacgtaacggtccgtaggtaacgtccggttaccgttacggttaccggttacggagggtaccggttacgggaaccccgtaagggttccccgtaaccccggttcgtaaccgggtcctaacccggtaaccccggtaaaccccgg

SEQ ID NO: 163430 - DNA, 561 bp, Homo sapiens
  misc_feature: GYAE6OF01A8Q1C.47.55.E11.1.454.CMB.1.raw
tcagagctcacgtacacgaccggtgctcgatttagcactcgcacgttgggtttggggggaagaggaagactgacggtcctgccacaggtggtgctgggcacggtgggcactcgacacaacatttgcgctcaactgtcttgctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcacgtgggtcccaccaaactccgagggtaaggggctgggtgtgggtctcgacgtatacaatcctgatggctagtgttaataaattagtgcggtactccggtggacgggcctattcagcatctacagagacgaacggcaagagtatacgtagtatacgtaggaaatgaaactagtctagagacgtacgaacgtactacggctgtctatcgtatttgttgttttacgattcgtcccgtttcggtccggtcgggtaccg

SEQ ID NO: 163431 - DNA, 594 bp, Homo sapiens
  misc_feature: GYAE6OF01CPNMN.47.55.E11.1.454.CMB.1.raw
  modified_base (279)..(279): a, c, t, g, unknown or other
  misc_feature (279)..(279): n is a, c, g, or t
  modified_base (354)..(354): a, c, t, g, unknown or other
  misc_feature (354)..(354): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggttttccttgttgctacttttaaaggtgtccagtgtgaggtgcgaggtagtggaggtccggggagtcttagtcagccgtggggagtcccgtgagactctcctgtgtagtctcgtgaatctagtttcagttacctntggatgctacgtcggtccaccaaacgtccgagggtaggctaggtgtcggtctacgtagtactactaactcgtagngtgactagttagttaataaagttgtcggtccggtactcgggtaggacggggtcctattcgaagtcctacgtccgtacgacgacgaaccgaacgacaagtacgtatacgttgtaactacgtaagtaaatgaaactagtacgtagaaggtacgacgtaacgtacgtacgtctatactatctagtttgtgtttcgatcgtccgttcggccgtacggtacttcggcggacctcggtaccgtcgg

SEQ ID NO: 163432 - DNA, 617 bp, Homo sapiens
  misc_feature: GYAE6OF01BF464.47.55.E11.1.454.CMB.1.raw
tcagagctcacgtacacgaccggtgctcgatttagcactcgcacgttgggttttccttgttgctcttttaaaaggtgtccagtgtgaggtgcaggtagtggagtccggggaggcttagttcagcctggggagtccctgagactctcctgtgtagtctctggaatcagtttcagtaccttctggatgcactgggtccgccaaactccaggtaagggctggtgtgggtctcacgtatcaatcctgatggctagtgttataaattatgcggactccgtggaggggccgattcagcatcctccagagacaacggcaagagtatactgtatctaggaaatgaaacatctgagagtcgacgatacggctgtctatctatttgttgttttcgattcgtccgtttcgggtcccggtcgggtacttcgggtcggggacccgtacgggtaacccgttgggtaccacggtccgttctcccgtcaccgccctacccgaccgaacgggccccacgttcccggtccccttcccccgtgggcccctacccgtgcccgtccgacgggccaccgaccgtccggagcgactccgacggccggcccgtcgggcctcggccgtcggtccgtaaaccg

SEQ ID NO: 163433 - DNA, 616 bp, Homo sapiens
  misc_feature: GYAE6OF01ACMIR.47.55.E11.1.454.CMB.1.raw
tcagagctcacgtacacgaccggtgctcgatttagcactcgcacgttgggttttccttgttgctcttttaaaaggtgtccagtgtgaggtgcaggtagtggagtccggggaggcttagttcagcctggggagtccctgagactctcctgtgtagtctctggaatcagtttcagtaccttctggatgcactgggtccgccaaactccaggtaagggctggtgtgggtctcacgtatcaatcctgatggcagtgttataaattatgcggactccgtgaggggccgattcagcatctccagagacaacggcaaagagtatactgtatctaggaaatgaaacaatcgtagagagtacgacgatacggctgtactatctatttggttgttttcgattcggtcccgtttcgggtcccggtcgggtaccttcggtcggggcccgaacggggtaaccctggtacagtccgttccgtcctccgacgcccgtcccaccgaaccgggccctagtcccggtcccttcccccgtggcccgtcccgtcgccctccgaggcgcccacccgtccggacgcgaccacgacggccgggcccgtcgggcctcggcccgtgggtaccgtaaccggg

SEQ ID NO: 163434 - DNA, 680 bp, Homo sapiens
  misc_feature: GYAE6OF01AXIXW.47.55.E11.1.454.CMB.1.raw
  modified_base (531)..(531): a, c, t, g, unknown or other
  misc_feature (531)..(531): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggttttccttgttgcttcttttaaaaggtgtccagtgtgaggtgcaggtagtgggaggtccgggggaggcttagttcagccgtggggagtccctgagactctcctgtgtagtctctggaatcagtttcagtaccttcgtggatgcacgtcgggtcccacctaaacgtccgaagggtaagggctgggtgtgggtctcgacgtatcaatcctaggatggactagttagttaattaaattagtgcggtactccggtaggacggggtccgtattcgacgtcacttcctaccgaaggaacgaaccgaaacgggtacaaaggtaacgtaattactgtaatccgtaaggaaactgaaactaagtcgtagaagtacggtacgaacgtagttacggnttacggtactagttcttaggttttaggtttcggtttttaccggtagttccgggttcccgtttcccggggttacccgggttccggggttaacccggttttccgggtacccggggggtaccccggtaaccgggggttaccccgttacgggg

SEQ ID NO: 163435 - DNA, 598 bp, Homo sapiens
  misc_feature: GYAE6OF01ACC9S.47.55.E11.1.454.CMB.1.raw
  modified_base (266)..(266): a, c, t, g, unknown or other
  misc_feature (266)..(266): n is a, c, g, or t
  modified_base (363)..(363): a, c, t, g, unknown or other
  misc_feature (363)..(363): n is a, c, g, or t
  modified_base (502)..(502): a, c, t, g, unknown or other
  misc_feature (502)..(502): n is a, c, g, or t
  modified_base (526)..(526): a, c, t, g, unknown or other
  misc_feature (526)..(526): n is a, c, g, or t
tcagagctcacgtacacgaccggtgctcgatttagcactcgcacgttgggttttccttgttgctcttttaaaaggtgtccagtgtgaggtgcaggtagtggagtccggggaggcttagttcagcctggggagtccctgagactctcctgtgtagtctctggaatcagtttcagtaccttctggatgcactgggtcccgccaaactccgaggtaaggggctgggtgtgggtctcacgtatcaatcctgatggcagtgttataaattntgcgactccgtggagggcattcagcatcaccagagacaacggcaagatatactgtatctaggaaatagaacaatcgtagagagtcgaacgatacggntgtactatctatttgtttttacgattcgtccgttcgggtccgcgggtacttcggcggggactacgggaaccctggtacgagtccgtcctcctcacgtccctccgaaccgaacggcccacgttccggttcccttccccgngcccgcctcggcctccgaacggcnccgaccgtcccgagccgacaccgccggcccggtcccgtgggcctacggcccgtacggaccgtaacggtaccc

SEQ ID NO: 163436 - DNA, 545 bp, Homo sapiens
  misc_feature: GYAE6OF01A11YK.47.55.E11.1.454.CMB.1.raw
  modified_base (522)..(522): a, c, t, g, unknown or other
  misc_feature (522)..(522): n is a, c, g, or t
  modified_base (524)..(545): a, c, t, g, unknown or other
  misc_feature (524)..(545): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgcttcttttaaaaggtgtccagtgtgaggttgcaggtagtggaggtccgggggaggcttagttcagccgtggggacgtccctgagacctctcctgtgtagtctctggaatctagtttcagttaccttcgtggatgcacgtcggggtcccgaccaaactccacgccctaccaacccgaacgggccctagtccggtcccttcccccgtggcccgtccctcgcctccgacggacgccacccgtccgagacgcacgacgccggcccgtggcctcggccgtggtaccaacgggtaccttaccgttcccgtacggtcgacggtccttcgtcggacggccggggtctacgggaccgaagggccgactagtagcngnnnnnnnnnnnnnnnnnnnnnn

SEQ ID NO: 163437 - DNA, 126 bp, Homo sapiens; identical to SEQ ID NO: 163319
  misc_feature: GYAE6OF01A7YDM.47.55.E11.1.454.CMB.1.raw
  modified_base (126)..(126): a, c, t, g, unknown or other
  misc_feature (126)..(126): n is a, c, g, or t

SEQ ID NO: 163438 - DNA, 727 bp, Homo sapiens
  misc_feature: GYAE6OF01CBIRQ.47.55.E11.1.454.CMB.1.raw
tcagagctcacgtacacgaccggtgctcgatttagcactcgcacgttgggtttggggccgcagccctgggattcccagctgtttctgcttgctgatcaggactgcacacagagagctcaccatggagtcgtgggctgagtcttgggttttccttgttgtcttacttttaaaaggtgtccagtgtgaggtgcgtaggtaggtggaggtccgggggagtcttaggttcaggccgtggggtacgtcccgtgacgacctcgtcctggttgtagtctcgtggtaatcgtagtttcacgttaccttcgtaggattgccgtacgtcgggtacccgacctaaaacgtccggaaggggtaacgggtccgttgggttcggttgggttacctacgtaacgttactacgtaacgtccgttagtagttacggtacgtaagtttaaggtttaaattaaaagtttacggtacggtaccgggttaaccgttccggggtacgggtaacggggtacccttagtttacggacgtacctacgtaccgttacgaaggaacgaaaccgaacggtaacgaaagttaacgttattaacgtagttaacgttacgttaagaaagtacgaaactaacgtgtacgaagacgttacgaacgtagtcggtagtatacgtagttagtacgtttgttacgtttcgagttcgtccggttcgcggtacgtcgttcgggacgggtaccgaaccggtcgtcgg

SEQ ID NO: 163439 - DNA, 711 bp, Homo sapiens
  misc_feature: GYAE6OF01D0TBF.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagccgtggggacgtccctgagactctcctgtgtagtctcgtggaatctagtttcagttaccttctggatgctacgtcggggtcccgaccaaacgtccgaaggggttaacggggccgttgggttcgtggggttctccgtacgtatactaaatccgtagaagtggtacctagtttacgtttaaattaaaagtttagtcggtaccggtacgtccgggtaggacggggccgtaagttcagtctacgtcctaccgaggaacgtaacgaaacggacaaaggacgttaatacgtgttaacgtacgtaaggtaaactagaaactaacgttacgtagaacgtacggtacgaacggtaacgttacggcctttacgtcttaacttctaagttttggtttacggttttttccggaagtttccggttcccggtttccgggttcccgggtacgggttaccgtttacgggtaccggggtaacccgacgggggttaaccccgttaccgggg

SEQ ID NO: 163440 - DNA, 560 bp, Homo sapiens
  misc_feature: GYAE6OF01ET3XI.47.55.E11.1.454.CMB.1.raw
  modified_base (497)..(497): a, c, t, g, unknown or other
  misc_feature (497)..(497): n is a, c, g, or t
tcagagctcacgtacacgaccggtgctcgatttagcactcgcacgttgggtttggggggaagaggaagactgacggtcctgccacaggtggtgctgggcacggtgggcactcgacacaacatttgcgctcaactgtcttgctcaccatggagtctgggctgagctgggttttccttgttgctcttttaaaaggtgtccagtgtgaggtgcaggtagtggagtccggggagcttagttcagcctggggatccctgagactctcctgtgtagtctctggaatcagtttcagtaccttctggatgcacgtcgggtccaccaaactccagggtaagggctgggtgtgggtctcgacgtatcaatcctgagtggctagttgttaataaattagtgcgtactcggtggagggcctattcgagctatctacgagacgacgaacgcaagtagtatacgtgtatcgtagaaatcgaaactatcgagaagacgtacgagtatacggnttagtcttatcgtaattggttcgtttacgagttacgtcccgtttcgggtccgtcggttaccgg

SEQ ID NO: 163441 - DNA, 584 bp, Homo sapiens
  misc_feature: GYAE6OF01DQD71.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccggggagcttagttcagcctggggatccctgagactctcctgtgtagtctctggaatcaagttttcagttaccttctggatgcacgtgggtccgaccaaactccgagggtaaggggctggtgtcgggtctcgacgtatcgaatcctgatggcagttgttaactaaattgtgccggtactccggtagggacggggtacctattcgagtcctaatcctaccgaggaacgaacgaacggtcaaaggtagtactacgttagtactacgtagtaaatagaaacatcgttagagtacggtcgaacgtatacggtctgtactatcgtattcgttgtttactatcggtccgttcggccgacgggtaccttggcgggaccacgggtacccgtgg

SEQ ID NO: 163442 - DNA, 726 bp, Homo sapiens
  misc_feature: GYAE6OF01BH9B2.47.55.E11.1.454.CMB.1.raw
tcagagctcacgtacacgaccggtgctcgatttagcactcgcacgttgggtttggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggaggtccgggggagcttagttcagccgtggggatccctcagacctctcctgtgccgacgtcctcgtacggtacttaccgttaccgttttacgttccttcgttaggacgttacggtaaggtttccgggtcccaccgtaacgtaccgtaccggaagggggaacgggtcggtagggtagggtttggggtacgaacgtaaacgtaacgtaaacgtaccgaaggtaacgtaggtaaacgtacgtaaaacgtaaacctagtacggtaggtactcgttacgtacgggaacggtcctacgtacccgactactccgtaacgaacggtacaacccgtaaccaacgaaacgtaacttccgttacgttacgggtttacacggtaaacgtaacgtcggaactaccgtacgttagaacgtaccgtacgaacggtacggtcgtacgttggttacttacgttggtagttgttccgttactcggtacgccgtccggttccggtaaccgttcgtcggttacgttggggcccgttccggtccggtacccg

SEQ ID NO: 163443 - DNA, 568 bp, Homo sapiens
  misc_feature: GYAE6OF01C3U7R.47.55.E11.1.454.CMB.1.raw
  modified_base (276)..(276): a, c, t, g, unknown or other
  misc_feature (276)..(276): n is a, c, g, or t
  modified_base (372)..(372): a, c, t, g, unknown or other
  misc_feature (372)..(372): n is a, c, g, or t
  modified_base (432)..(432): a, c, t, g, unknown or other
  misc_feature (432)..(432): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggttttccttgttgctcttttaaaaggtgtccagtgtgaggtgcaggtagtggagtccgggggaggcttagttcagcctggggatccctgagactctcctgtgtagtctcgtggaatcagtttcagtaccttntggatgcacgtcgggtccgaccaaacgtccgaagggttaagggctggtgtgggtctcacgtatcaatcctgatggactagttagttaataaattangcggactcgtgagggccgattcagcatcaccagagacaacggcaaaggtatatactgtanacgtagaaatgaacaatatagagagtacgacgaagtacgacgtgtactatactagttagttgtttcgttagtcgtccgttccggttcccggtcggtaccgttacggtcgggtccggaccgggtaaccggtaccggg

SEQ ID NO: 163444 - DNA, 651 bp, Homo sapiens
  misc_feature: GYAE6OF01C9I9X.47.55.E11.1.454.CMB.1.raw
  modified_base (227)..(227): a, c, t, g, unknown or other
  misc_feature (227)..(227): n is a, c, g, or t
  modified_base (254)..(254): a, c, t, g, unknown or other
  misc_feature (254)..(254): n is a, c, g, or t
  modified_base (290)..(290): a, c, t, g, unknown or other
  misc_feature (290)..(290): n is a, c, g, or t
  modified_base (327)..(327): a, c, t, g, unknown or other
  misc_feature (327)..(327): n is a, c, g, or t
  modified_base (345)..(345): a, c, t, g, unknown or other
  misc_feature (345)..(345): n is a, c, g, or t
  modified_base (353)..(353): a, c, t, g, unknown or other
  misc_feature (353)..(353): n is a, c, g, or t
  modified_base (371)..(371): a, c, t, g, unknown or other
  misc_feature (371)..(371): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagcgtggttttctgttaggctctttaaaaggtgtccagtgtgaggtgcaggtagtggaggtccgggggaggcttagttcagccgtggggntccctgagctctcctgtgtagtcttcnggaatcagtttcagtacctctgatgcacgtggtccnccaaaacgtccgaagggtagggtctggtgtgggtctnacgtatcgaatccgtagngtacggtntagttattaataattcgngcgtactccggtagggtacgggtacgtattcgacgtctactccaacgaagaacgaaccgtaaacggagtaaaggtagttaactacgttagtactacgtaagtaaatacgtaaactaagttacgaggacgtaaggtacggtaacgtacgtacggtcttacgttaacgttacttacgttagtttcgttacgtttacgtagttcccggttcccggtttaccgggtcccggttacgggttaccgttaccgggtaccggggtacccgggtacggttcccggtagg

SEQ ID NO: 163445 - DNA, 593 bp, Homo sapiens
  misc_feature: GYAE6OF01EYQQO.47.55.E11.1.454.CMB.1.raw
  modified_base (205)..(205): a, c, t, g, unknown or other
  misc_feature (205)..(205): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccacctcagcgtctgggacccccgggnagacggtcaccatctcttgttctggaagcagctaccaatatcggaaatgataatgtatactggtaccagcaacgtccccaacgaaccggcccccaaactcctacatctaataacaatgatcagccgcctcgacgggtccctggcctattctctggctccgaagtcgtcggccgcctcacgcccaccctcggcctatcgaggtcgggcctcccgggcccgaggactgggagctagtatttattacgtgtaggttagggttgggactcgcgtacgtctgacgtcgtccgtttacgttcgttcgggacgtccggtacgggaacccgtaaggttcccgacccggttaccgtacgggtccgacgaccccgaacggacccccaaaccccgtacg

SEQ ID NO: 163446 - DNA, 690 bp, Homo sapiens
  misc_feature: GYAE6OF01C9GWL.47.55.E11.1.454.CMB.1.raw
  modified_base (140)..(140): a, c, t, g, unknown or other
  misc_feature (140)..(140): n is a, c, g, or t
  modified_base (207)..(207): a, c, t, g, unknown or other
  misc_feature (207)..(207): n is a, c, g, or t
  modified_base (241)..(241): a, c, t, g, unknown or other
  misc_feature (241)..(241): n is a, c, g, or t
tcagagctcacgtacacgaccggtgctcgatttagcactcgcacggttgggtttggggagctgtggtagagaagacaggattcaggacaatctccagcatggccggcttccctctcctcctcaccctctcactcactgtncagggtcttgggcccagtctgtgctgactcacgcccaccctcagccgttcgtccggggacccccggnaggaccggtcaccgtatcctctttgtctggaacnccagtcctaccaatacgtacggaatgataagtgtaatactggtaccagctaacgtcccaacgaacgaccccctaaactcctataactctaataaccagttacgactacgacggccggtaccctacggtacgggtacccctaggtaccgtacttccgtcgttcggtacctaccgtaagtcgtcggcctaccctcgaccgccctaacccgtggaccctagttacgacggtccgggtccctacccgggacccgagggtactacgggtacggccttaggtattttaacggttacgttggttacggtttagggttcgggaattccggacgtacgtcgttagtaccttcggtacctttaggttcgtacggcgtcgtaccggaaccgtacgggtcctacccggtcctaggtcacccggacccgtaaacggacccccaccctgtacgtccctacccg

SEQ ID NO: 163447 - DNA, 492 bp, Homo sapiens
  misc_feature: GYAE6OF01CPHEP.47.55.E11.1.454.CMB.1.raw
  modified_base (336)..(336): a, c, t, g, unknown or other
  misc_feature (336)..(336): n is a, c, g, or t
  modified_base (451)..(451): a, c, t, g, unknown or other
  misc_feature (451)..(451): n is a, c, g, or t
  modified_base (458)..(458): a, c, t, g, unknown or other
  misc_feature (458)..(458): n is a, c, g, or t
  modified_base (475)..(475): a, c, t, g, unknown or other
  misc_feature (475)..(475): n is a, c, g, or t
  modified_base (483)..(492): a, c, t, g, unknown or other
  misc_feature (483)..(492): n is a, c, g, or t
tcagagctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcgacggggtccctggccgtattctctggcctccaagtctggcgcctcagccaccctggccatcaggtggctccggtccgaggatgaggctgattattattgtgcaacngtggatagtagctgagtagtgtaggtttcggcggaggaccaacgtgaccgtcgtacggtcacgcccgaagccgtacgcccccgtggtccactctcgttcccaccctcctctcgtnacgctcngcgcggctggacaggcncgatacgnnnnnnnnnn

SEQ ID NO: 163448 - DNA, 698 bp, Homo sapiens
  misc_feature: GYAE6OF01BBR7F.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgcttacttttaaaaggtgtccagtgtgaggtgcaggtagtggaggtccgggggagtcttagttcgaggccgtggggacgtccctgagacctctcctgtgtagtctcgtggaatcgtagtttcagttaccttctggatgcacgtcgggtcccacaaactcgaggtaggctggtgtggtctcagtatcgatcctgagtggactaggttagttaataaagttgcggacggtaccgtccggtaggacgggtacctaacgttcgacgtactacttccgtaccgagtaaccgaacgaaacgacgaaaggtacgttaataccgttagttaactacgtaaggtaaatacgtaaactaacgttcgtaagaagggtaacggttaccgaacggtaacgttaacggtccgttagtaaccttaacgttacgttagttttacggttacggtttttaccgtaacgttccggttccccggtttaccggggttccccggaccggggttaaccttttcggggaaccggggtacccgtaaaccgggggtaaccccgttgggg

SEQ ID NO: 163449 - DNA, 687 bp, Homo sapiens
  misc_feature: GYAE6OF01ELG2X.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgcttcttttaaaaggtgtccagtgtgaggtgcaggtaggtggaggtccggggggaggtcttagttcaggccgtggggagtccctgagactctcctgtgtagtctctggaatctagtttcacgttacctttcgtggatgacgacgtcgggtacccgacccgaaactccgagggtaaggggtcgtgggtggtgggtcctcgtacgtatactaatcctgagtggctaagttagttaattaaattagtcggcggtacgtccggtagggacgggggccgtattcgacgtctacgttcctaccgaaggaacgaaccgaacgggaacgaaaggtaagttaacttacgtaggtttaactacggtaaggtaaacttaggaaactaagtcgtaaggagtacggtacgtaaccggtagttacggcttagtacttatcgttaagttttggtttggttttccgtagttccggtcccgtttccggggtcccggtccggggttccttacgggttcgggggacccggtaacgggtacccggtccgggg

SEQ ID NO: 163450 - DNA, 680 bp, Homo sapiens
  misc_feature: GYAE6OF01B6I2X.47.55.E11.1.454.CMB.1.raw
  modified_base (369)..(369): a, c, t, g, unknown or other
  misc_feature (369)..(369): n is a, c, g, or t
  modified_base (503)..(503): a, c, t, g, unknown or other
  misc_feature (503)..(503): n is a, c, g, or t
tcagagctcacgtacacgaccggtgctcgatttagcactcgcacgttgggtttgggggccgcagccctgggattcccagctgtttctgcttgctgatcaggactgcacacagagagctcaccagtggagtcgtgggctgagtcttgggttttccttgttgcttacgttttaaaaggtgtcagtgtgaggtgcgaggtaggtggaggtccgggggagtcgttagttcaggccgtcggggacgtccccgagactcctccgtgtgtagtctcgtaggaatcgtagtttcacgttccttcgtggatgctacgtcggtcccaccaaacgtccgagggtaacgggtcgtggtgtggtctcgacgtatcaactcgngtagtggacgtagttagttaataaagttgacggtcgtacgtcggacgggtacgggtcctagttacgagctacgtcctacgaagaacgaacggaacgacgaaaggtataacgtagtagtactagtaagaaactanaaactatcgtagagtaacgcgaatacggtacggtacttggttactagttacgttgtttaggtttcgtttacggtacgttcccggttacccggtttccgggtaccccgggtacgggtttacccggtttaccggggtaccggggtaacccgtaccccggggtaacccgttcgggtaccg

SEQ ID NO: 163451 - DNA, 867 bp, Homo sapiens
  misc_feature: GYAE6OF01BMM2P.47.55.E11.1.454.CMB.1.raw
  modified_base (202)..(202): a, c, t, g, unknown or other
  misc_feature (202)..(202): n is a, c, g, or t
tcagagctcacgtacacgaccggtgctcgatttagcactcgcacgttgggtttggggagagaagacaggattcaggacaatctccagcatggccggcttccctctcctcctcacccctcctcactcactgtgcgagggtccgtcgggcccagtctgtgctgactcacgcccaccctcagtccgtcgtccggggacccccggngaggcggtcactattcttcgttgttcgtaggaagcagcctaccaaattacgtaacggaaatgaattaatgttaattaccgtaggtaaccagacctaaccgtccccgaaaccggaacccgaaccccctaaacttccctactaacgttacctaaactaaacaagtacgactaccgacggtcccggtaccccgtacggggaccggggttcccctagggtaccccgttacttttcccgtacggttcgggtaccccttaaccgtaacggttccggtcgggcccgtacccctacggacccgtccccgtaaccccgttcggacctaacgtcggacgggtccgggtccccggtaccccgggacccggtagggtacgtacgggtaacgggtcccttaaggtttaacttttaacgttttaaccgggtggttttaacggggttaggggtttaccggtacgttaccggacggtacccgtccgttaagtaccgttcgttaccgttttacgggtccggttacgggacgttaccgggtccggaaaaccgtcgggtccccgttacccggtaccggtaccgggtccgaacccgaccccggtaacccggaaccccttaaaccccggtcgttaccggtaccccttacccggtttcccctacccccggtttaccccctaccccgg

SEQ ID NO: 163452 - DNA, 549 bp, Homo sapiens
  misc_feature: GYAE6OF01EF0SG.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccgaggtaaggggctgggtgtgggtctcacgtatcaatcctgatggcagtgttataaattatgcggtactccgtggacggggccgattcagcatctccagacgacaacggcaagagtatactgtatctaggaatgaacaatctagagagtcgacgtagtacggctagtctatctatttgtttcgattcgtccgttcgggtcccgtacgggacctttcggacggggaccctaacgggtacccgtggtaccg

SEQ ID NO: 163453 - DNA, 706 bp, Homo sapiens
  misc_feature: GYAE6OF01B50JB.47.55.E11.1.454.CMB.1.raw
tcagagctcacgtacacgaccggtgctcgatttagcactcgcacgttgggtttgggggagccgcagccctgggattcccagctgtttctgcttgctgatcaggactgcacacagagagctcaccatggagtctgggctgagcttgggttttccttgttgcttcttttaaaaggtgtccagtgtgaggtgcaggtagcggaggtccgggggaggcttagttcaggccgtggggacgtccctgacgactctcctgtgtagtctcgtgaatctagtttcacgttaccttcgtggatgctacgtcggtccaccaacgtccgaggtaagggcgtgggtgtggtctcacgtactcaatcctgacgtggactagttagttaattaaagttagtcggtacggtacgtccggtaggacggggtccgtagttacgagtaccacttccgtaccgaagaacggtaacgaaaccggagaaagtacgtaattacgtagtaactacgtaaggtaaataacgaactaagtcgtaggaacgtacgtaacggacgtaacgtaccgggtattacggttacttacttacgtaagtttttcggtttacggtttttaccgacggtttcccgggttcccggtttacccggggtcccgggttaaccggggtttacccggtttacccggggtacccggggggtacccggtaaacccgggggttaaccccgg

SEQ ID NO: 163454 - DNA, 640 bp, Homo sapiens
  misc_feature: GYAE6OF01D3QYU.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctggctgagcttgggttttccttgttgtcttactttttaaaaggtgtccagtgtgaggtgcaggtagtggaggtccgggggagtcttagttcagccgtggggacgtccctgagactctcctgtgtagtctctggaatctagttctagtaccttctggatgcacgttcgggtcccgacctaaacgtccgaagggtaacggggcgttgggtgtgggtctacgacgttatcaatccgtgatcggactagttagttaaataattagtggacggtacttcggagggacggggcctattcgagtcactccgaccagaacgaacgaacggacaagacgttatacgtagtatacgtagtaaatagaactaacgtactaggaacgtaaggtacgtaacgtacgttacggacttggtacttaattcttagtttgtttgttttcgagtttccggtccggtttaccggtccggtcggttacccgttcgggtaccgggacccggtaacgggtccccggttacgg

SEQ ID NO: 163455 - DNA, 616 bp, Homo sapiens
  misc_feature: GYAE6OF01A4VSP.47.55.E11.1.454.CMB.1.raw
  modified_base (592)..(592): a, c, t, g, unknown or other
  misc_feature (592)..(592): n is a, c, g, or t
  modified_base (600)..(600): a, c, t, g, unknown or other
  misc_feature (600)..(600): n is a, c, g, or t
  modified_base (603)..(603): a, c, t, g, unknown or other
  misc_feature (603)..(603): n is a, c, g, or t
  modified_base (606)..(606): a, c, t, g, unknown or other
  misc_feature (606)..(606): n is a, c, g, or t
  modified_base (609)..(612): a, c, t, g, unknown or other
  misc_feature (609)..(612): n is a, c, g, or t
  modified_base (614)..(614): a, c, t, g, unknown or other
  misc_feature (614)..(614): n is a, c, g, or t
tcagagctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagtaagtcccacgaacggcccccaaactcctcatctataacaatgatcagccggccctcgacggggtccctggccgatttctcgtggctccaagtctggccgcctcacgcccaccctggcccatcaggtcggctccggcccgaggatggaggctgattatacgtgtgtaggttgggactcgcagcctagactcgctttacgtcttcggagcgtcgggaaccgtacggtccgaccgttccgtacggtccacggacccccgaacgggcccccaaacccccgtacgttccggtacctacccttaccgttcccggtttcccccgcccccgtttacccttaccgtacggtcgaccgtcccgttacggtcgggaaccgggtccggggtcccgttagggacccgtaagggcccgacgtaacgtaggcnctgctagncgntcngcnnnngngc

SEQ ID NO: 163456 - DNA, 700 bp, Homo sapiens
  misc_feature: GYAE6OF01CE88Y.47.55.E11.1.454.CMB.1.raw
  modified_base (264)..(264): a, c, t, g, unknown or other
  misc_feature (264)..(264): n is a, c, g, or t
tcagagctcacgtacacgaccggtgctcgatttagcactcgcacgttgggttttccttgttgctcttttaaaaggtgtccagtgtgaggtgcaggtagtggagtccggggaggcttagttcagcctggggagtccctgagactctcctgtgtagtctctggaatcagtttcagtaccttctggatgcactgggtccgccaaactccgaggtaagggctgggtgtgggtctcacgtatcaatcctgatggcagtgttataaattngcgactcgtgagggccatcagcatctcagagacaacggcaagagtatactgtatcgtaggaaatgaaacatcgtagaagagtcgaacgagtacggctgttactatctaattgttgttttcgagttcgtcccgtttcgggacccggtcgggtacctttccggtacgggggaccctaacgggggtaaaccccttgggtaccgtacggtcccgttccgtcccttccgaccggtcccccttacccgaacccggaaacgggtcccccgtaacgttcccgggttacccctttccccccgtgggccccgtccccgtcgtcccgttaccggaacggaccgtaccccgacccgtcccggaaacggacccgtaccgaaccggacccgggcccggtcccccggtcggggccctacgggtccccgttacgggtaccgtaaaacccggg

SEQ ID NO: 163457 - DNA, 601 bp, Homo sapiens
  misc_feature: GYAE6OF01CO6BT.47.55.E11.1.454.CMB.1.raw
  modified_base (277)..(277): a, c, t, g, unknown or other
  misc_feature (277)..(277): n is a, c, g, or t
  modified_base (347)..(347): a, c, t, g, unknown or other
  misc_feature (347)..(347): n is a, c, g, or t
  modified_base (355)..(355): a, c, t, g, unknown or other
  misc_feature (355)..(355): n is a, c, g, or t
  modified_base (365)..(365): a, c, t, g, unknown or other
  misc_feature (365)..(365): n is a, c, g, or t
  modified_base (394)..(394): a, c, t, g, unknown or other
  misc_feature (394)..(394): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctggctgagctgggttttccttgttgcttcttttaaaaggtgtccagtgtgaggtgcaggtagtggagtccgggggaggcttagttcagccgtggggagtccctgagactctcctgtgtagtctctggaatcagtttcagtacccttntggatgcacgtggtccgccaaaactccgaggtaaggggctggtgtgggtctcgacgtatcaatcctgacnggctagtntaataaattngcgactcgtaggagggcattcagcactcnccagacgacgaacggacaaggatatactgtatcgtaggaaatagaacaagttacgtagaagtaggtaccgaagtagtacggtctcgttactagtacgtatttcggttagtttttccggaagtttcggttccccgtttccggggtacccggttaccggggtacctttaccgggtcggggtacccgtaacgggggtaaccccttcgggg

SEQ ID NO: 163458 - DNA, 576 bp, Homo sapiens
  misc_feature: GYAE6OF01CGVLW.47.55.E11.1.454.CMB.1.raw
  modified_base (554)..(554): a, c, t, g, unknown or other
  misc_feature (554)..(554): n is a, c, g, or t
  modified_base (556)..(556): a, c, t, g, unknown or other
  misc_feature (556)..(556): n is a, c, g, or t
  modified_base (560)..(562): a, c, t, g, unknown or other
  misc_feature (560)..(562): n is a, c, g, or t
  modified_base (566)..(567): a, c, t, g, unknown or other
  misc_feature (566)..(567): n is a, c, g, or t
  modified_base (569)..(572): a, c, t, g, unknown or other
  misc_feature (569)..(572): n is a, c, g, or t
  modified_base (574)..(576): a, c, t, g, unknown or other
  misc_feature (574)..(576): n is a, c, g, or t
tcagagctcacgtacacgaccggtgctcgatttagcactcgcacgttgggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaatcctcatctataacaatgactcagcggccctcaggggtccctggccgtattctctggctccaagtctggcgcctcacgccacctggccatcagtcggctccggcccgaggatgaggctgattatactgtgtaggttggatcgcagcctgactgtcttacgtcttcggagtcgtcggacctaaggtcaccgtctacggtcacggccccaacggccccaaaccccgtcgtcgtacctacccgttaccttccggttacccccgtccccttcccgtttaacggtcgtaaccgtccgttcccgtcgggaacggtccggggtaccgttccgggaccgtaacgggccgaaccgtagttacggcncncgcnnncgcnncnnnncnnn

SEQ ID NO: 163459 - DNA, 677 bp, Homo sapiens
  misc_feature: GYAE6OF01BF29L.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggttttccttgttgcttacttttaaaggtgtccagtgtgaggtgcgaggtaggtgggaggtccgggggaggtcgttagttcgagccgtggggacgtcccgtgagactctcctgtgtagtctcgtggaattcgtagtttctacgtaccttcgtaggtatgctacgtcgggtaccccgacctaaaccgtaccggtagggtaaggggccgtagggttggtcgggtctacgtacgtactactaacgtccgtaggagtggtactagttagtttaaataagttagtcggacggtacgtaccggtggacggggtccgtagttaccgagtaccgtatccgtacgaaggacgaaacggaaccggaacgaaggtacgtaacgttactacggttatacgtaagtaagtaagtaaactaagtacgtagaaggtacggtacgaacgtaggtacgtctagtactagtctagttgttcggtttctgttccgttcggttcccggtccggcggttacgtccgggtacgggaccgtaccggggtccctcggg

SEQ ID NO: 163460 - DNA, 588 bp, Homo sapiens
  misc_feature: GYAE6OF01EPI0J.47.55.E11.1.454.CMB.1.raw
  modified_base (266)..(266): a, c, t, g, unknown or other
  misc_feature (266)..(266): n is a, c, g, or t
  modified_base (376)..(376): a, c, t, g, unknown or other
  misc_feature (376)..(376): n is a, c, g, or t
  modified_base (440)..(440): a, c, t, g, unknown or other
  misc_feature (440)..(440): n is a, c, g, or t
tcagagctcacgtacacgaccggtgctcgatttagcactcgcacgttgggttttccttgttgctcttttaaaaggtgtccagtgtgaggtgcaggtagtggagtccggggaggcttagttcagcctggggagtccctgagactctcctgtgtagtctctggaatcagttttcagtaccttctggatgcactgggtccgccaaaactccaggtaaggggctggtgtgggtctcacgtatcaatcctgatggcagtgttataaattangcggactccgtgaggggccgattcagcatctccagagacaacggcaagagtatactgtatctagaaatgaacaatctagagagtcgacgatacggctgtctatcattgtnttttcgatgcctttcggtccgcgggtacttcgtgggccagggaaccctggtcagcgtctcctcncgcctcaaccagggccctagtccggtccttcccccgtggccgcccctgccgtccgacggacgacctacccgtccggtaacgacggcaccgacggacccgggtccccggttcggggcccttcggcccgttgggtaccgtaaaaccgggg

SEQ ID NO: 163461 - DNA, 639 bp, Homo sapiens
  misc_feature: GYAE6OF01BCAI7.47.55.E11.1.454.CMB.1.raw
  modified_base (322)..(322): a, c, t, g, unknown or other
  misc_feature (322)..(322): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggagcgtggtccagcctgggacgtccctgagactctcctgtgcagcctctggcttcaccttcaataattatgctatgcaggtcgggtccgccgaggcctccgaggcgaaggggctaggnggtgggtggcggtcatagtcgtccaggtggactatcttacagttattacgcagtacctcccgtgggacggggcctattccgacctactccaccgtaaggaacgtaacctaaacttaccccgaagaaccgtaccggttaccttactccgtacgaccctacccgttacgaacccgtacgacccgttagaacgtaaccgtcgaacccgtaacctacccggttccttccgttaccttaacccgttacgttcggttacgaccggtaaggacggttaaggtttacggaacggtacgttacctaaggtttcggtggtaacccgg

SEQ ID NO: 163462 - DNA, 635 bp, Homo sapiens
  misc_feature: GYAE6OF01EN3R7.47.55.E11.1.454.CMB.1.raw
  modified_base (553)..(553): a, c, t, g, unknown or other
  misc_feature (553)..(553): n is a, c, g, or t
tcagagctcacgtacacgaccggtgctcgatttagcactcgcacgttgggttttccttgttgctcttttaaaaggtgtccagtgtgaggtgcaggtagtggagtccggggaggcttagttcagcctggggagtccctgagactctcctgtgtagtctctggaatcagtttcagtaccttctggatgcactgggtccgccaaactccaggtaagggctggtgtgggtctcacgtatcaatcctgatggcagtgttataaattatgcggactccgtgaggggccattcagcatctccagacgacaacggcaagagtatactgattttcgaggaaatagaactaatctagagagtacgacgtaagtacggctagtctatctatttgttgttttcgattcgtccgttcggtccgtcgggtacttcggtcggggccgtacgggtaacccgtggtaccgagtccgtcctcccgtcaccgtccctacccaaccgacgggcccctagttcccggtacccttccccgtcggcccgtccccgtcgcccgtcccgacggtaccncccgtaacccgtcccggacgacgccgtacgaccggcccggaccccggtcgggacctccggcccgttgggtccgtaaaccggg

SEQ ID NO: 163463 - DNA, 545 bp, Homo sapiens
  misc_feature: GYAE6OF01AUBY6.47.55.E11.1.454.CMB.1.raw
  modified_base (295)..(295): a, c, t, g, unknown or other
  misc_feature (295)..(295): n is a, c, g, or t
  modified_base (364)..(364): a, c, t, g, unknown or other
  misc_feature (364)..(364): n is a, c, g, or t
  modified_base (523)..(523): a, c, t, g, unknown or other
  misc_feature (523)..(523): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagttaccttctggatgcacgtgggtcccnccaaactccgaggtaaggggctgggtgtgggtctcacgtatcaatcctgatggcagtgttaataaattntgcggactccgtggagggccattcagcatctccagagacaacggcaagtagtatactgtatcgtaggaatgaacatctagagagtccgaagtagtacggctgtactatctagttgttgttttcgattcggtcccgttcgggtccgtcgggtacttcggnggggccctaagggtcccgtggg

SEQ ID NO: 163464 - DNA, 493 bp, Homo sapiens
  misc_feature: GYAE6OF01BIRL1.47.55.E11.1.454.CMB.1.raw
  modified_base (443)..(443): a, c, t, g, unknown or other
  misc_feature (443)..(443): n is a, c, g, or t
  modified_base (479)..(480): a, c, t, g, unknown or other
  misc_feature (479)..(480): n is a, c, g, or t
  modified_base (482)..(493): a, c, t, g, unknown or other
  misc_feature (482)..(493): n is a, c, g, or t
tcagagctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctaataacaatgatcagcggccctcaggggtccctggccgattctctggctccaagtctggcgcctcagccacctggccatcagtgggctccggccgaggatgaggctgattattactgtgtaggtgggatcgcagcctgactgcttacgcttcggagcgtgggaccaaggtcaccgtcctaggtcacgcccaaggcccaacccgactgtccactctcgttcccaccctcctctacgngagctctgacgcgggctcggcaacgggcgcatacgnngnnnnnnnnnnnn

SEQ ID NO: 163465 - DNA, 680 bp, Homo sapiens
  misc_feature: GYAE6OF01APSO1.47.55.E11.1.454.CMB.1.raw
  modified_base (194)..(194): a, c, t, g, unknown or other
  misc_feature (194)..(194): n is a, c, g, or t
  modified_base (646)..(646): a, c, t, g, unknown or other
  misc_feature (646)..(646): n is a, c, g, or t
  modified_base (662)..(662): a, c, t, g, unknown or other
  misc_feature (662)..(662): n is a, c, g, or t
tcagagctcacgtacacgaccggtgctcgatttagcactcgcacgttagggttcggttgggtcccagtctgtgctggactcagccaccctcagcgtactgggaacccccgggcacgacggtcgtacctactcctcttgttcgtgggaagccacgctccagtactcggaaactgataatgtagtactgggtaccnggccaaaggtccctacggaaccggacccccctaaacggtccctcactcctaataaccgaattgactcaggccgtccctgacggggtaccctggccgatttcctccgtggccgtccaaggtcctcgggcccgaccctccgaggacccgacccttggaccctagtccggtaaggtcgggcctttcccgggaccccgaaggtacttggacgggcctcggtaacctttaacttaccgtgttcggtacgggttcggactcggctacggcctcgacctgtccttacgtcttacggacgtccgtacggaacctaacggttcctacccgtcgtacggtccacgcccgaagcccaacccgctcgacacctctcgtccccgtcctccttactacggtgcgtccgtactggaccggtccgggtctttacggggacgttaccggggacctcgaacgttaccggnacctgtcccgatcgtngctgcggcgcgcgtgtcg

SEQ ID NO: 163466 - DNA, 733 bp, Homo sapiens
  misc_feature: GYAE6OF01DS5GR.47.55.E11.1.454.CMB.1.raw
  modified_base (193)..(193): a, c, t, g, unknown or other
  misc_feature (193)..(193): n is a, c, g, or t
  modified_base (212)..(212): a, c, t, g, unknown or other
  misc_feature (212)..(212): n is a, c, g, or t
tcagagctcacgtacacgaccggtgctcgatttagcactcgcacgttgggtttggggagcttcagctgtggtagagaagacaggattcaggacaatctccagcatggccggtcttccctctcctcctccaccctcctcactcactgtgcgagggtcgttcgggcccagtctgtgctgactcacgcccacctcngcgtcgtccgggacccggnacgacgtcaccattctcttgtctgtagcagctacaatgtacgaatgatatgtatacgtacgtacagacacgtaccaacggacccgaccccaacgtccctatactactaactaaactatacgtactaccgacggccccggtaccggtaccggacggggttcccgtacggtcccgtagttcctaccggtcgtaccgtaccgtaacggtccggttacggcccgttcccgtacccgaccgtacccgtacccggttcggacccgtaagtcccggtaacggggtcccgggtacccggtacccgggtaacccgggacgggtacgtaccgggtacggtaccgttacgttacgtttactttacggtagggttacggttacgggttagggtctaccgacggtccgtcgtacgtcgttcgtaccggttccgtccggtacggacggttaccggtccggaaccgttacggttccccgaccggtaccggtacggtaccccacggaaccccgaccggtccccgtaacccgttccgg

SEQ ID NO: 163467 - DNA, 597 bp, Homo sapiens
  misc_feature: GYAE6OF01CLBGL.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctggctgagctgggttttccttgttgtctacttttaaaaggtgtccagtgtgaggtgcaggtagtggaggtccgggggagcttagttcagccgtggggacgtccctgagactctcctgtgtagtctctgaatcagtttcagttaccttctggatcgcacgtcgggtccgaccaaacgtccgaagggtacgggcgtggtgtggtctcgacgtatacaatcctgactggctagttagtttaaataaattagtcggacggtactccggtaggtacgggtccgtagttcgacgacattcctaccgagtaacgaacgaaacggacaagtactaatacgtagtagtacgtaaggaactagaaactatgtagaagagtacgacgtactacggtctgtactagtctagtttgttgtttcgagttcgtccgttcggcccggtaggtccgttcgggtacggcccgtaggtacccgtgg

SEQ ID NO: 163468 - DNA, 831 bp, Homo sapiens
  misc_feature: GYAE6OF01DDXI1.47.55.E11.1.454.CMB.1.raw
  modified_base (209)..(209): a, c, t, g, unknown or other
  misc_feature (209)..(209): n is a, c, g, or t
  modified_base (643)..(643): a, c, t, g, unknown or other
  misc_feature (643)..(643): n is a, c, g, or t
tcagagctcacgtacacgaccggtgctcgatttagcactcgcacgttgggtttggggagcttcagctgtggtagagaagacaggattcaggacaatctccagcatggccgcttccctctcctcctcaccctcctcactcactgtgcagggtcttgggcccagtctgtgctgactcacgcccaccctcagcgtcgtcggggacccccggnacgaccggtcaccatctcttgttctggaagcagctaccaatacgtacggaaaatgaattaaatgttaactacgttacggtaaccagaccaaacgtccccaaccggaaacccggacccccctaaaaccttccctactaacttacctaaacgttaaaaccaaagtgaacttaccgaacggtcccgggtaccccttacgggacgggggttccccctacgggtaccccgttaacttttccgccggttacgggtaacccttacccgaaacgttcccgtcgggcccgtccccttacgaccgaccccgtaccgtcggaccctacgtccgacggtccgggcccgtcccgggacccggaaggtacgtcgggacggtaccgttaggtaacttttaacgtttaacgttgggtttagggttagggtttacgggactacgggtaccncggtccgttacgttaccgttacggtcccgttttaaccggttccggttaccgggtacggtccgggttaaaccggggtaaacccgtaaacgggttacccctaaaccccgggtttcccggttaaaccgggttcccgaaaacccgggacccccggtaaaaccgggacccccccgtaaacccccgtaacccgg

SEQ ID NO: 163469 - DNA, 990 bp, Homo sapiens
  misc_feature: GYAE6OF01DB7VZ.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagtcttgggttttccttgttgcttacttttaaaaggtgtccagtgtgaggtgcgaggtagtgggaggtccgggggaggtcttagttcgagccgtggggtagtccctgagtactctccgtgtgtacgtctcgtggtaacttcgtaagtttcaacgttaccttcgttaggattcgcctaaccggttcggggttaccccgaaccctaaaaccggttcccggaaagggggttaaacgggggtccgttaggggttcgggttacggggttccttaccgtaaccggtttaactaccgtaaacgttcccgttaggtaacgttcggggtaacgtttaaggtttaaggttttaaaagttaaaaaacgtttcggttacgggtacccgggttaaaccggtttcccggggttaaggggaacccggggggtaccgttaacgtttaacccggaacgggttacctaacgtttcccggtaaccgaaacggggaaaccgttaaaccgggaaacccgggtaaacgtaaaacgggttaacgtttaaccgtttaaacgtttcgggttaaacttaccgggttaaagggtaaaaacgttacggttaaaaaccgtaacgtttaccggttaaagggaaaccgggttaaaccgttaacccggggtaaacccggtaaacggttaaccgggttaccgtttacgttaaaccgtttacgttacgttaaacggttttttccggttttacgaacgttttaccccgggttcccgggttttaccccgggtacccgggtacccggggttttaacccgttaccccgggggtttaacgggggacccccggtttaaaaccggggggttaacccccgttgggttaccccggg

SEQ ID NO: 163470 - DNA, 837 bp, Homo sapiens
  misc_feature: GYAE6OF01B739M.47.55.E11.1.454.CMB.1.raw
  modified_base (191)..(191): a, c, t, g, unknown or other
  misc_feature (191)..(191): n is a, c, g, or t
tcagagctcacgtacacgaccggtgctcgatttagcactcgcacgttgggtttggggagagaagacaggattcaggacaatctccagcatggccggcttccctctcctcctcaccctcctcactcactgtgcagggtcttgggcccagtctgtgctgactcagcccacctcagcgtcgtcgggaccccggnagacgtcacattctcttgtctaggaagcagctacaatagtacggaaatgataatgtaatacgtggtaccagacaacgtacccaacgaacccggaccccaaacttcctacactactaataacaatgatacgacgccgcctacggaccgggtccctcggacctattccgtcgtcggacctacgaacgtctacgactaccgtcgacgtcccttcccgtcggaccctagtaccgtaacggggtccggggtcccgttaccccggggtaccggaacgggtacgtacgggtacgggtacctttaacggttaaactttttaacggttttaaccgttgggtttaacgggttttaacggggttacgggtaaccttcgggaccgttaccggtaccgttaggtaaccgtttcggttacccgttttacgggtttccggttaaccgggtacggttaccgggttaccggggtaaaacccgttaaccggggttacccgtaaaccccgggttttaccggtaaaccgggtttaaccccggaaccccgggtaaaccccccggtaaaaccccggggccccccctaaaaaccccggttaccggtttacccgttaccccttaacccggtttcccgtttacccccgttaacccccccgttaccccccgg

SEQ ID NO: 163471 - DNA, 607 bp, Homo sapiens
  misc_feature: GYAE6OF01A7SAZ.47.55.E11.1.454.CMB.1.raw
  modified_base (192)..(192): a, c, t, g, unknown or other
  misc_feature (192)..(192): n is a, c, g, or t
  modified_base (303)..(303): a, c, t, g, unknown or other
  misc_feature (303)..(303): n is a, c, g, or t
  modified_base (420)..(420): a, c, t, g, unknown or other
  misc_feature (420)..(420): n is a, c, g, or t
tcagagctcacgtacacgaccggtgctcgatttagcactcgcacgttgggtttggggagagaagacaggattcaggacaatctccagcatggccggcttccctctcctcctcaccctcctcactcactgtgcagggtcttgggcccagtctgtgctgactcagccaccctcagcgtctcggggacccccggnagacggtcaccatctcttgttctggaagcagctaccaatatacggaaatgaattaatgtatactggtaccagcaacgtcccaacgaaccgccccaaactcctacatctaanaacaatgatcaggccgcctcgacgggtccctggccgtattccgtcgtcggcctacgagtcgtggccgcctcgacgcccacccgtcggcctatcgaggtcgggcctcccggccgaggntggacgtctagtattagtcgtgttgttagggttggactcgctacgccgtgactcgtctttacgtcgttcgggactcggtacgggaacctacggtcctacccggtaccgtagggtccaccggaccccgaacggaccccctaacccgtcgttaccgtacctaccgttccttcccggttccccctccccg

SEQ ID NO: 163472 - DNA, 946 bp, Homo sapiens
  misc_feature: GYAE6OF01BTLHN.47.55.E11.1.454.CMB.1.raw
  modified_base (87)..(87): a, c, t, g, unknown or other
  misc_feature (87)..(87): n is a, c, g, or t
  modified_base (100)..(100): a, c, t, g, unknown or other
  misc_feature (100)..(100): n is a, c, g, or t
  modified_base (103)..(103): a, c, t, g, unknown or other
  misc_feature (103)..(103): n is a, c, g, or t
  modified_base (137)..(137): a, c, t, g, unknown or other
  misc_feature (137)..(137): n is a, c, g, or t
  modified_base (152)..(152): a, c, t, g, unknown or other
  misc_feature (152)..(152): n is a, c, g, or t
  modified_base (202)..(202): a, c, t, g, unknown or other
  misc_feature (202)..(202): n is a, c, g, or t
  modified_base (210)..(210): a, c, t, g, unknown or other
  misc_feature (210)..(210): n is a, c, g, or t
  modified_base (277)..(277): a, c, t, g, unknown or other
  misc_feature (277)..(277): n is a, c, g, or t
tcagagctcacgtacacgaccggtgctcgatttagcactcgcacgttggggtttggggagcttcagctgtggtagagaagacgagtntcgagactatccncancagtcggccgtccttccctcctccctcctacccnccctcctacactacncgttgcgacggtcggttcgtccggaccctgttcgtgtgctcgactcaccnccctaccngacgtccgtccggacccggggacccgagtacgaccgtcaactctttccttgttacgtacggaggacncgacaccttaactaagtaacggaaataagtagtaaatagttagtaacgttacggtaaccgaactaacgaacccgtaccccgaaacccggaaaaccggaacccccctaaaacccctttacaccctttaaacaaacttaaacctaaataaaacaacgtacgtacccgacgacccggtcccgtaccccgtagggtaaccccggtcgtacgaaccttcgtcctacggtacgtccctaacggacggttccgccgtacccgaaccctcggaaaccccgccccctaacgggtaccgacctacgggttaaccggacggggttccccggtaccccgggtaccccgggaaacgggttaacggtagggttaacccgggtacgggtaataaacccgtttttaaaggttaggttttaaccggtagggggtttaacgggtttaaggggggttacgttaacccggtcccgaaacgggttacccggtcgttaccggggttaacctttccggggttaaaccccgttttgggttaaaccgggttaccgggacccgggtaacccggttaaaccggggttaacaaccccccgggttttaacccgggacccgtttaacggggaaacccgaccccgaaccccggggtaaaacccttaaacccccggggaaacccccgttaaacccttccgg

SEQ ID NO: 163473 - DNA, 704 bp, Homo sapiens
  misc_feature: GYAE6OF01B4VEB.47.55.E11.1.454.CMB.1.raw
  modified_base (209)..(209): a, c, t, g, unknown or other
  misc_feature (209)..(209): n is a, c, g, or t
tcagagctcacgtacacgaccggtgctcgatttagcactcgcacgttgggtttggggcagcttcagctgtggtagagaagacaggattcaggacaatctccagcatggccggcttccctctcctcctcaccctcctcactcactgtgcagggtcttgggcccagtctgtgctgactcagcccaccctcagcgtctcgggacccccgggnagacggtcaccatctcttgttctggaagcagctccaatatcggaaatgaataatgtatactggtaccagcaacgtccccaacgaaccggcccccaaactcccacactactataacaatgatcacgcgccctacgacgggtccctggccgtattccgtcgtcggccttaccgaagtcgtcggcctccctcgaccgccctacccgtcggaccctagtcgacggttccggggacccgttcccccgggacccgggtaaggacgttagggacgggtccttaaggtaacttttaaccgtttacggttcggttacgggttaaggggtttcggaacggttccggtaccgtacgggtcccgttaggacctttcggtacccgttttaaccggtcccggtttaccggggaacgtcccgggtaacgggaacccgtacgggttcccgtaaccccgttccgggttaacgtcccgaaccggaccccggaaaccggaccccctaaaccccg

SEQ ID NO: 163474 - DNA, 623 bp, Homo sapiens
  misc_feature: GYAE6OF01CJNS2.47.55.E11.1.454.CMB.1.raw
  modified_base (283)..(283): a, c, t, g, unknown or other
  misc_feature (283)..(283): n is a, c, g, or t
  modified_base (357)..(357): a, c, t, g, unknown or other
  misc_feature (357)..(357): n is a, c, g, or t
  modified_base (395)..(395): a, c, t, g, unknown or other
  misc_feature (395)..(395): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgcttacttttaaaaggtgtccagtgtgaggtgcaggtagtggaggtccgggggaggcttagttcgagccgtggggagtccctggagacctctccgtgtgtagtctctggaatcagtttcagtaccttntggatgctacgtgggtcccgccaaaccgtccgaggtagggcgtggtggtcgggtctcacgtatcaagtcctagngtgctagtagttaataaattgtgaccggacttccgggnggacggggccgtattcgagtctacgtcctaccgaagaacgtacgaaacggacaaggtaacgttaagtacgtgtaactacgtaaggtaaatgaactaatcgtaacgaagtacgtacgaagtagtaccgtctgtacttattacgtagtttgttacgtttcgattccggttccgttaccggtcccggtacggttcgtaccggtcgggtaaccgtacccgggtaacttcggg

SEQ ID NO: 163475 - DNA, 848 bp, Homo sapiens
  misc_feature: GYAE6OF01ABZ6U.47.55.E11.1.454.CMB.1.raw
tcagagctcacgtacacgaccggtgctcgatttagcactcgcacgttgggtttggggagccgcagccctgggattcccagctgtttctgcttgctgatcaggactgcacacagagagctcaccatggagtctgggctgagcgtggtttcctgttgctactttaaaaggtgtccagtgtgaggtgcaggtagtggagtccggggagcttagttcagccgtggggagtccctgacgacgtctcctggtgtatcgtctggaatcgtaagtttcagttaccttcgtaggattcgaccgtacgtcggggtacccgacctaaaccgtccgtaagggtaacggggtcgttacgggttggtacgggttcctacgtaacggtacttacctaacgttcccgtaggtacgttaacggcgtaacgggtttaggttaaacgtttaaaacgtttacgttacgggaaccgggttaccgttacccggggtgggtaaccggggggtacccgttaacgtttaccggaacgtacccgtacgtttaccgtacccggaaaggaccggtaaaaccgtaaccgggaaccgtaaaggggttaacttacttaaccggttacgttaacgttaccggtaaagggtaaaacgtttcaaaacggtaaacttccggttaaggaaacggttaacgggtacccgggtaagaaacgtttccggggactttaggttacccgtagttaaccgttaaggttttcgggttttacggtttaacccggtagtttcccgggttaccccggtttacgggggaccccggttacgggttaacccggtttccgggttaaccgggggccccgtaaaaccgggggttaccccgg

SEQ ID NO: 163476 - DNA, 789 bp, Homo sapiens
  misc_feature: GYAE6OF01E0G07.47.55.E11.1.454.CMB.1.raw
tcagagctcacgtacacgaccggtgctcgatttagcactcgcacgttgggtttggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcacgtgggtcccgccaaacgtccgagggtaaggggcgtgggtggtcgggtctcgaacggtatacaatccgtgatggctagtagtttaaattaaagtttagtcggtacggtaaccttccggtagggacgggggtcccgtaagttaccgaggtcctaacgttcctacccgaagacgaaacgaaaccgggaacgaaaggtaagttaactaacgttagttaagtacgtaagggaaaattacggaaactaagttccgtaaggtaaggtaacggttaccggtaaacggtaacgttaacccggggacctttaacggttacccgtttaaactttacccgtaaaggtttttttcgggttttaacggttttttacccgggtaaacgttttcccgggtttacccccggttttaccccgggggtttcccccgggtaacccggggggtttaaccccgttttaccccgggggttacggggggggtacccccctaaaccggggggggttaaacccccccggg

SEQ ID NO: 163477 - DNA, 679 bp, Homo sapiens
  misc_feature: GYAE6OF01ALL04.47.55.E11.1.454.CMB.1.raw
  modified_base (180)..(180): a, c, t, g, unknown or other
  misc_feature (180)..(180): n is a, c, g, or t
  modified_base (201)..(201): a, c, t, g, unknown or other
  misc_feature (201)..(201): n is a, c, g, or t
  modified_base (227)..(227): a, c, t, g, unknown or other
  misc_feature (227)..(227): n is a, c, g, or t
  modified_base (239)..(239): a, c, t, g, unknown or other
  misc_feature (239)..(239): n is a, c, g, or t
tcagagctcacgtacacgaccggtgctcgatttagcactcgcacgttgggtttggggagctgtggtagagaagacaggattcaggacaatctccagcatggccggcttccctctcctcctcaccctcctcactcactgtgcagggtcttgggcccagtctgtgctgactcagccaccctnagcgtctcgggacccccgggnagcgtcaccatctcttgttctggaancagctccaatancggaaatgataatgtatacgtggtaccagcaacgtcccacggaaccggcccccaatcctacatctaataacatgatcgacgccggaccctcgacggggttccctcgggcctattcctcgtcgggcctaccgtaacggtccgtgggcccgtaccctcaacccggcccctaccccgtgggaccctacgtccgtacgggtcgggacccggtccccggcccggtaggacgtggacggtctagtatttacgttacgtgtgggtttagggttcggagttcccggcgtacggacccgttgaccgttagttccgttaacgttccgtacggggtacctcgggttaccgggtaacccgtaacgggttccccgtaaccggtttccgtaaacgggttcccaacggtaccccgaaccggtaccccaacccccgtcgttcgtacccgttccccg

SEQ ID NO: 163478 - DNA, 548 bp, Homo sapiens
  misc_feature: GYAE6OF01AV1UU.47.55.E11.1.454.CMB.1.raw
  modified_base (511)..(511): a, c, t, g, unknown or other
  misc_feature (511)..(511): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttcctgttgctcttttaagaggtgtccagtgtcaggtgcagctggtggagtctgggggagcgtggtccagcctgggaagtccctgagactctcctgtgcaacgtctggattcaccttcagtacctacggcatgcactgggtccgccaggcctccgaggccgaaggggctgggaggtgggtggctattttagtagtggtacgagttagggaaagttaatttattactatggacagactccgtggacggggccgattccaccatacctccagtagacaattcccaagaaccacggtagtatccgtagacaaagtacgaatacgacctgagacgaccgaggacacggctgtgtattacgtgttgtggngagagttaggtaagttaggaaccttccgtgtactacg

SEQ ID NO: 163479 - DNA, 651 bp, Homo sapiens
  misc_feature: GYAE6OF01C5REA.47.55.E11.1.454.CMB.1.raw
tcagagctcacgtacacgaccggtgctcgatttagcactcgcacgttgggtttgggggagccgcagccctgggattcccagctgtttctgcttgctgatcaggactgcacacagagagctcaccatggagtctgggctgagctgggttttccttgttgctcttttaaaggtgtccagtgtgaggtgcaggtagtggagtccggggagcttagttcagccgtggggatcccgtgagactctcctgtgtagtctctggaatcagtttcagtaccttcgtggatgcacgtcgggtcccgaccaaactccgaggtaaggggctggtgtggtctcacgtatcaatcctgatggctagtgttaataaatttgtgcggtactcggtaggacggggtccaagttcgagctatcctaccgagaacgaacgtaacggacgtaaacggtagttaactaacgttagttaactacgttaagggtaaacgtagaaacctaagttaccgttaagggaaggtaacggtaccggtaacgaacggttaaccggtcttacggttacttaaacgtcttagttttggttacgtttttcggaacttcggttcccgtttcgggtccggtccgggttaccgtttcggtcgggggcccgtaacggggtaaccccgg

SEQ ID NO: 163480 - DNA, 741 bp, Homo sapiens
  misc_feature: GYAE6OF01ECAZS.47.55.E11.1.454.CMB.1.raw
  modified_base (208)..(208): a, c, t, g, unknown or other
  misc_feature (208)..(208): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagcccaccctcagcgtcgtcgggacccccggnaggacggtcaccattccttcttgttctaggaacgtcacgtcctaccaaatacgtacggaaatgaattaatgtaatacgtggtaccagcaacgtcccaacgacccgaccccaactcctacactctaataacatgactacgacgccgtccctacggaccgggtccctggcctattcctcgtacggtcctaccgtagtctcggcctcctacaccgccctaccgtcggaccctagtccgtacggtccgggacccgtcccgggacccgtagggtacgtcgggaccggtacgttacggttacttttaaccgttacgttagggttacgggttaacgggttcgggtaccgtaccggaccgtacgttaccccgttcggttacgttacccggttaccgtttaaccgggtttccgtaccggggacgtttacccgggtaccgggtaaacccggtaacgggtttcccccgtaaacccgggtttcccggaaccggttacccgaaccgggaacccccgaaccgggtaccccctaacccccggttaccg

SEQ ID NO: 163481 - DNA, 808 bp, Homo sapiens
  misc_feature: GYAE6OF01EESS1.47.55.E11.1.454.CMB.1.raw
tcagagctcacgtacacgaccggtgctcgatttagcactcgcacgttgggtttggggccgcagccctgggattccagctcgttctgcgttcgctcgagtcaggactgcacgacagacgagctcgaccagtcggtagtctcgggctcgagcttgggttttccgttgttgtctctttaaaggtgtccagtgtgaggtgcgtaggtagtgggaggtccgggggacggcgttagtcgacgtccgtggggacgtcccgtagacgactcgtacctgtgtacgtctcgtaggtaagtcgtacgtttctacgttaccgtttccgtggtactcgaccgtacgtcgggtacccgtaccaaccgtaccgtaaggggtaacggggtcgttggggtacgtcgggtcctacgacgtaatctaacgttccgtagtacgtggtacgtagttacgttaataacgtcgtcggtacggtacgtacgggtagggtacgggttactacgtctacggtacctacgtaccgtaccgaaggtacgtaacggtaaccggtataaggtaggttacttaaccgttggttaaaccgtacggttaagggaaacttacggaacgaccgttcggtacggaacgggtaaccggtacgggtaacgttaaccggtccggttcctaccggtttcttaaccggttacgttcccgttttacgggtttaccggtttaccgtacgggttacccggtttcccgggttacccgggttacccggttaaccgggttacccgttacccggggtaccggggtaacccgttaacccggggtcgttaccccgggg

SEQ ID NO: 163482 - DNA, 667 bp, Homo sapiens
  misc_feature: GYAE6OF01B2YBK.47.55.E11.1.454.CMB.1.raw
  modified_base (395)..(395): a, c, t, g, unknown or other
  misc_feature (395)..(395): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagccgtcgtcggggacccccggcagacggtcaccatctcttgttctggaagcagcctaccaatatacggaaatgaataatgtatacgtggtaccagacaacgtccccacgaaccggacccccaaactcctacactctataacaatgactcgagccgcctcgacgggtccctggaccgtattcctcgtggcctccgaagtccgtcggccncctcgacgcccacccgtcggccctagtccgacggtcgggtcccgtcccgggacccgtagggactcgggacgggtctggttaacttacgtttacgtgggttacggttagggtttcggggaacttccggacgtacgggtcctcggtacgttcgtaccgtttaccggttccgttcggacggtccggtaccggggaacccgtaacgggttcccgacccggttccggtaacggtaccgacccggaacccgaacccggacccccgtaacccgtaccgg

SEQ ID NO: 163483 - DNA, 744 bp, Homo sapiens
  misc_feature: GYAE6OF01AG7LX.47.55.E11.1.454.CMB.1.raw
tcagagctcacgtacacgaccggtgctcgatttagcactcgcacgttgggtttgggggagccgcagccctgggattcccagctgtttctgcttgctgatcaggactgcacacagagagctcaccatggagtctgggctgagctgggttttccttgttgctacttttaaaaggtgtccagtgtgaggtgcaggtaggtgggaggtccgggggaggtctttagttcaggccgtggggacgtccctgagactctcctgtgtagtctcgtggaatctagtttcacgttaccttctggatgcacgtggtcccgaccaaacgtccgagggtagggcgtggtggtggtctacacgtatacactctgagtggactagttagtttaataaatttagcggtacggtaccgttccgggtagggacgggggtccgttaacgttcaacggctacgttcctaccgaaaggtacgaaaccgtaaaccgggaactaaacgggtaacgttaacttacgttacggtaacttacggtaaaggtaaactaaggtaaacctaagttacgttaagggaacggtaacgggttaccggaacggttaacggtaaccggttcttacggttaacttagttaccgtttaagtttcgggttttacggtttttccgtaacggtttcccggtccccggttttacgggtccccgggttacggggttcccgtttaccgggggtaccgggggtcccggtaaccggggttaaccccggg

SEQ ID NO: 163484 - DNA, 674 bp, Homo sapiens
  misc_feature: GYAE6OF01BVK0R.47.55.E11.1.454.CMB.1.raw
  modified_base (304)..(304): a, c, t, g, unknown or other
  misc_feature (304)..(304): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggttttccttgttgcttacttttaaaaggtgtccagtgtgaggtgcgaggtagtgggaggtccgggggagcttagttcaggccgtggggagtccctgacgtactctcctgtgtagtctcgtggaatcagtttcagttaccttctggatgcacgtgggtccnccaaactccgaagggtaaggggctgggtcgtgggtctcgacgtactctaactccgtgactcggacgtagttagttaacgttaaacttacgtggaccggtaccgttccggtggacggggtccgtagttcgacgctactccgtaccgtaagacggaccgaacggacaaggtacgtacgttacgtagtaactacgtaacggaaattcggaactaagtaccgtaggtaacgtacggtaccggtaacgtagtaccggtcgttacgtaccttaattcgtatttggtttacgacgttccgtaccggttccgggtccccggtacgggttaccgttcgggtccgggtacccgtacggggtaaccccgtcgggtaacccg

SEQ ID NO: 163485 - DNA, 601 bp, Homo sapiens
  misc_feature: GYAE6OF01BK766.47.55.E11.1.454.CMB.1.raw
  modified_base (345)..(345): a, c, t, g, unknown or other
  misc_feature (345)..(345): n is a, c, g, or t
  modified_base (367)..(367): a, c, t, g, unknown or other
  misc_feature (367)..(367): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggtttttccttgttgctcttttaaaaggtgtccagtgtgaggtgcaggtagtggagtccgggggaggcttagttcagcctggggagtccctgagactctcctgtgtagtctctaggatcagtttcagtaccttctggatgcacgtgggtcccaccaacgtccgagggtaacggggctggtgtgggtctcacgtatcaatccngatggctagtagtaataaattntgcggtctcggtaggacggggtcgattcagctatcctccagacgaacgacggacaagagtactacgttgtactacgtagaatagaactaagtctagagtagtcgaacgtagtacggtctgtacttatcgttatttcggtttacgatttcggtcccgtttccggggtcccggtaccggggttacctttccgggaccggggtacccggtaaccggggtaaccccgttgggtaccgg

SEQ ID NO: 163486 - DNA, 614 bp, Homo sapiens
  misc_feature: GYAE6OF01DVBEI.47.55.E11.1.454.CMB.1.raw
  modified_base (268)..(268): a, c, t, g, unknown or other
  misc_feature (268)..(268): n is a, c, g, or t
  modified_base (539)..(539): a, c, t, g, unknown or other
  misc_feature (539)..(539): n is a, c, g, or t
  modified_base (563)..(563): a, c, t, g, unknown or other
  misc_feature (563)..(563): n is a, c, g, or t
tcagagctcacgtacacgaccggtgctcgatttagcactcgcacgttgggttttccttgttgctcttttaaaaggtgtccagtgtgaggtgcaggtagtggagtccggggaggcttagttcagcctggggagtccctgagactctcctgtgtagtctctggaatcagtttcagttaccttctggatgcacgtgggtccaccaaactccgagggtaagggctggtgtgggtctcacgtatcaatcctgatggctagtgttaataaattntggcgtactccggtgacggggccattcagcatcctaccagacgacgaacggacaaaggtagtaatacgtgtatacgtaggaaatagaaacatactggaagtacgtcgaacgtagtacgcttgtactatctatttgttagtttcgattcgtccgttccgggtccggcggttacttcgggtcgggaccgtaacgggtacccgtggtacacggtccgttctcccgcacgtccctaccgacccgacgggccctacgttccggtccccttccccgnggccctccctgccctacgacggcncccgacctccggatcgcacgccggccgccgtggctcggccgtggctaacgg

SEQ ID NO: 163487 - DNA, 630 bp, Homo sapiens
  misc_feature: GYAE6OF01ENQXX.47.55.E11.1.454.CMB.1.raw
  modified_base (520)..(520): a, c, t, g, unknown or other
  misc_feature (520)..(520): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggaggtccgggggaggcttagttcagcctggggagtccctgagactctcctgtgtagtctctggaatcagtttcagtaccttctggatgctacgtcgggtcccgaccaaacgtccgagggtaaggggcgtggtggtgggtctcacgtatcaatcctgatggctagttagttaataaagttatggcggtacgtccgtaggacggggtccgtattcgagctagtcctaccgaagacggaacgaaacggcaaaggagttaactacgttggttaattacggtaaggtaaactgaaactattagtaagaaggaaggtcgaacgtagttacgntacgtactatcttagtttgtttcggtttacgagttccggtcccgtttccggggtcccgtccggggttactttcccgggtacggggcccgtaacggggtaccccgttcggg

SEQ ID NO: 163488 - DNA, 695 bp, Homo sapiens
  misc_feature: GYAE6OF01CX0S9.47.55.E11.1.454.CMB.1.raw
  modified_base (673)..(674): a, c, t, g, unknown or other
  misc_feature (673)..(674): n is a, c, g, or t
  modified_base (676)..(676): a, c, t, g, unknown or other
  misc_feature (676)..(676): n is a, c, g, or t
  modified_base (678)..(678): a, c, t, g, unknown or other
  misc_feature (678)..(678): n is a, c, g, or t
  modified_base (683)..(684): a, c, t, g, unknown or other
  misc_feature (683)..(684): n is a, c, g, or t
  modified_base (686)..(686): a, c, t, g, unknown or other
  misc_feature (686)..(686): n is a, c, g, or t
  modified_base (688)..(688): a, c, t, g, unknown or other
  misc_feature (688)..(688): n is a, c, g, or t
  modified_base (690)..(691): a, c, t, g, unknown or other
  misc_feature (690)..(691): n is a, c, g, or t
  modified_base (693)..(695): a, c, t, g, unknown or other
  misc_feature (693)..(695): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggaggtccgggggaggtcttagttcagccgtggggagtccctgagactctcctgtgtagtctctggaatcagtttcagttaccttctggatgcacgtcgggtccgaccaaacgtccgaaggggtaacggggccgaacggggaaacccttggtcacggtccgtcctccgtcacgtccctaccaacccgaacgggccccacgttcccggttacccttcccccgtcggtcccggccccttcggccccttcccgaacgggtacgacccgtacccgttccgggaacgaccgccgaaccgaccgggcccgggtcccccgtgggggtccttccgggcccgttacgggtaccgaaaacgggttacccttaaccccgtttcccgttaacgggttacgaacggttccgttaccgttacggggaccgggtcccggggggtaccgttcggggaacccgtaaacggggccgtaaacgtaacgttacggcacgnngngngcgcnncncncnncnnn

SEQ ID NO: 163489 - DNA, 608 bp, Homo sapiens
  misc_feature: GYAE6OF01A9PPE.47.55.E11.1.454.CMB.1.raw
  modified_base (206)..(206): a, c, t, g, unknown or other
  misc_feature (206)..(206): n is a, c, g, or t
  modified_base (364)..(364): a, c, t, g, unknown or other
  misc_feature (364)..(364): n is a, c, g, or t
  modified_base (381)..(381): a, c, t, g, unknown or other
  misc_feature (381)..(381): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctcgggacccccggnaggacggtcaccatctcttgttctggaagcagctccaatatacggaaatgataatgtatactggtaccagcaacgtcccaacggaacccggacccccaaactcctcactctaataacatgatcacgccggccctcgacgggtcctggcctattctcgngcctcaagtctcggccncctcacgccctaccgtcggacctactcgacggtcgggcccgtcccgggaccggaaggacgtcgggacggtccttagtactttagttacgttggttgggttaacgggtttgggacgtccggacgtacgtccgttagtaccgtcgtacttacggtcggttcgggacgtcggtaccgggactacgggtcctaccggtccgtaggccacggacccgacgcccacccgtacg

SEQ ID NO: 163490 - DNA, 722 bp, Homo sapiens
  misc_feature: GYAE6OF01B61B1.47.55.E11.1.454.CMB.1.raw
  modified_base (187)..(187): a, c, t, g, unknown or other
  misc_feature (187)..(187): n is a, c, g, or t
  modified_base (208)..(208): a, c, t, g, unknown or other
  misc_feature (208)..(208): n is a, c, g, or t
tcagagctcacgtacacgaccggtgctcgatttagcactcgcacggttgggtttggggagcttcagctgtggtagagaagacaggattcaggacaatctccagcatggccggcttccctctcctcctcaccctcctcactcactgtgcagggtcttcggcccagtctgtgctgactcagccaccctnacgcgtcgtcgggaccccggnagacggtccacgtatctcttgttacgtaggagcagcctaccgaattacgtacggaaatggtaataatgttatacgtaggtaccagaccaaccgtcccaacggaaccccggaccccaaacgtccctacactacctaactaaacgactacggtaactcgaacggcccggtacccgtacgacggggttcccgtcggtacccgtaatttcccgtcggtaccggtcccttaccggtaacgtcgtacggtcccggtccgtacgacccgtacccgtacccgtacgggtaccctacgttaccggtacgggtcgggtacccggtacccggggaccggtaacggtacggtacggacggtctacgggtactttacgtaacgtggttacggttagggtcggtaacgtccgaccgtcgtccgtacgacgtcgtcgttacgtcgtcggacgtccggtacggtaacctacggtcccgacccggttcgtacggtaccgacccgtacccgaacggaccccctaccgtaccg

SEQ ID NO: 163491 - DNA, 807 bp, Homo sapiens
  misc_feature: GYAE6OF01CVYA0.47.55.E11.1.454.CMB.1.raw
  modified_base (197)..(197): a, c, t, g, unknown or other
  misc_feature (197)..(197): n is a, c, g, or t
tcagagctcacgtacacgaccggtgctcgatttagcactcgcacgttgggttttccttgttgctcttttaaaaggtgtccagtgtgaggtgcaggtagtggagtccggggaggcttagttcagcctggggagtccctgagactctcctgtgtagtctctggaatcagtttcagtaccttctggatgcactgggtccnccaaactccgaggtaggctggtggtcggtctcgacgtatacaactccgtgagtggactaggttagttaataaattgtcggccggtaccttccggtagggacggggcctattcgagctactcctaccgagacgaacgaacggcaagtgtatactgtactcgtaaggtaaatacgaaactatcgtagaagtacgtacgaacgtacgtacggtcttagtactactacgttagtttggttttacgtttacgagtttccggttcccggtttaccgggtcccgggtaccgggttaccgtttccgggggtaccgggggtacccgtaaacccggggttaacccgttggggtaaccgtacggttccccgttacccttcccgtaccgacccggtcccccttaaccgaacccgggtaacccgggtccccttaacgggtttcccccggttccccccgtttcccccggtcgggtccccccgtcccgttaccggtccccgttaaccgggaacgggtcccaccccgttaccccggtaccgggacgaccgcccgtaaacccgggccgggtccccggtcccgggtgggtcccttacgggccccggttagggtaacccgtaaaccggg

SEQ ID NO: 163492 - DNA, 515 bp, Homo sapiens
  misc_feature: GYAE6OF01C5UZR.47.55.E11.1.454.CMB.1.raw
  modified_base (427)..(427): a, c, t, g, unknown or other
  misc_feature (427)..(427): n is a, c, g, or t
  modified_base (448)..(448): a, c, t, g, unknown or other
  misc_feature (448)..(448): n is a, c, g, or t
  modified_base (462)..(462): a, c, t, g, unknown or other
  misc_feature (462)..(462): n is a, c, g, or t
  modified_base (470)..(470): a, c, t, g, unknown or other
  misc_feature (470)..(470): n is a, c, g, or t
  modified_base (472)..(472): a, c, t, g, unknown or other
  misc_feature (472)..(472): n is a, c, g, or t
  modified_base (501)..(502): a, c, t, g, unknown or other
  misc_feature (501)..(502): n is a, c, g, or t
  modified_base (505)..(515): a, c, t, g, unknown or other
  misc_feature (505)..(515): n is a, c, g, or t
tcagagctcacgtacacgaccggtgctcgatttagcactcgcacgtagggtcttgggcccagtctgtgctgactcagccaccctcagcgtccgggacccccggcagacggtcaccatctcttgttctggaagcagctccaatatcggaaatgataatgtatactggtaccagcaagtcccacgaaccgcccccaaactcctcatctataacaatgatcagcggccctcgacggggtcccctggccgattctctggctccaagtctggcgcctcacgcccaccctggcccatcaggtgggctccgggcccgagggactgacggctggattattactgtgttaggttgggatcgcagcctgactgtcttacgtcttcggagcgtgggaccaggtcaccgtctaggtcacgaccccaaggcccaaccccnctcgtccactctcgttccccnccctcctctacgtnacgctcgngnggccgggtctgggcaaggccgacagagcnncgnnnnnnnnnnn

SEQ ID NO: 163493 - DNA, 586 bp, Homo sapiens
  misc_feature: GYAE6OF01BRFW6.47.55.E11.1.454.CMB.1.raw
  modified_base (205)..(205): a, c, t, g, unknown or other
  misc_feature (205)..(205): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccggnagacggtcaccatctcttgttctggaagcagctccaatatcggaaatgataatgtatactggtaccagcaagtccccaacgaaccggcccccaaactcctcatctataacaatgatcagccggccctcgacggggtccctggcccgtattctcgtggcctccaagtctggccgcctcacgcccacctggccatcgaggtcgggcctcccgggcccgaggacgtggacggtctagtattacttacgtggttaggttagggttgggattcgcgtacgtcctgacttgtcctttacgtcgttcgggagtcggtcgggaacctaacgggtccacccggttccgtacgggtccaccgaccccgaacggtcccccaaaccccgtacg

SEQ ID NO: 163494 - DNA, 572 bp, Homo sapiens
  misc_feature: GYAE6OF01CTCDX.47.55.E11.1.454.CMB.1.raw
  modified_base (184)..(184): a, c, t, g, unknown or other
  misc_feature (184)..(184): n is a, c, g, or t
  modified_base (228)..(228): a, c, t, g, unknown or other
  misc_feature (228)..(228): n is a, c, g, or t
  modified_base (338)..(338): a, c, t, g, unknown or other
  misc_feature (338)..(338): n is a, c, g, or t
  modified_base (342)..(342): a, c, t, g, unknown or other
  misc_feature (342)..(342): n is a, c, g, or t
tcagagctcacgtacacgaccggtgctcgatttagcactcgcacgttgggtttggggcagcttcagctgtggtagagaagacaggattcaggacaatctccagcatggccggcttccctctcctcctcaccctctcactcactgtgcaggtcttgggcccagtctgtgctgactcagccacctnagcgtctcgggaccccggcagacgtcacatctcttgtctggaancagctacaatatcgaatgataatgtaatactaggacagcaacgtccaacgaaccggcccctaaactcctcatcaataacaatgactcagcgcctcgacggtctgcgatcntgcncaagtctgcgctcacgtcccacctggccatccgaggtcggcgtccggaccggacggatcggaggctagtatttaacttacgtgtaggttaagggttgggacgtcggtcaacggtcctacggactggtacgtttaccgtcgttacgggaggtccgtaggggtaaccctaaagggttccctaacccggtacgtttacgggacaccggaacccgaacggccccgtaaaccccg

SEQ ID NO: 163495 - DNA, 714 bp, Homo sapiens
  misc_feature: GYAE6OF01DKYJ6.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagtcttgggtttttccttgttgtcttacttttaaaaggtgtccagtgtgaggtgcgaggtagtggaggtccgggggaggtcgttagttcaggccgtggggacgtcccgtgacgactctcctggtgtagtctctggaatctagtttcagttaccttgtggatgcacgtcgggcccactaacgtccgaagggtagggtcgtggtggtcggtctacgtacgtatacaactccgtagagtggtactaggttagtttaaataaagttgtcggtaccggtacgttcgggacgggtacggggaccttattcgacgtacaaccgtacccgaggaaaccggaaccgaaacgggtaacgtaacggtaagttaacgttaccgttaacggttattacggtaaaggtaaaagttacgaaactaacgttgtaaggacgtacggtaaccgacgtaggtaccgtagtcgttactaattacttgtttaggtttcgtttacgtacgttccggtttcccggttcccggtacccggggttcggtacccggtttcggggtaccccgggtacggtaaacccgggtccgttcggtaccgg

SEQ ID NO: 163496 - DNA, 548 bp, Homo sapiens
  misc_feature: GYAE6OF01BSF9D.47.55.E11.1.454.CMB.1.raw
  modified_base (482)..(482): a, c, t, g, unknown or other
  misc_feature (482)..(482): n is a, c, g, or t
  modified_base (499)..(499): a, c, t, g, unknown or other
  misc_feature (499)..(499): n is a, c, g, or t
tcagagctcacgtacacgaccggtgctcgatttagcactcgcacgttgggttttccttgttgctcttttaaaaggtgtccagtgtgaggtgcaggtagtggagtccggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctaggaaatgaacaatctgagagtcgacgatacggctgtctatcattgtgttttcgatgccttcggtccgcgggtacttcgtcggggccagggaaccctggtcagcgtctcctcacgccctcaccaagggcccaagtccggtccttcccccgtggccnccctgcctccgaggacnccaaccctccgagacgcacgcgccggcctgggctggccctggctaacgg

SEQ ID NO: 163497 - DNA, 642 bp, Homo sapiens
  misc_feature: GYAE6OF01BA24K.47.55.E11.1.454.CMB.1.raw
  modified_base (218)..(218): a, c, t, g, unknown or other
  misc_feature (218)..(218): n is a, c, g, or t
  modified_base (231)..(231): a, c, t, g, unknown or other
  misc_feature (231)..(231): n is a, c, g, or t
  modified_base (243)..(243): a, c, t, g, unknown or other
  misc_feature (243)..(243): n is a, c, g, or t
  modified_base (248)..(248): a, c, t, g, unknown or other
  misc_feature (248)..(248): n is a, c, g, or t
  modified_base (339)..(339): a, c, t, g, unknown or other
  misc_feature (339)..(339): n is a, c, g, or t
  modified_base (351)..(351): a, c, t, g, unknown or other
  misc_feature (351)..(351): n is a, c, g, or t
  modified_base (395)..(395): a, c, t, g, unknown or other
  misc_feature (395)..(395): n is a, c, g, or t
tcagagctcacgtacacgaccggtgctcgatttagcactcgcacgttgggtttggggagcttcagctgtggtagagaagacaggattcagggacaagtctccagcatggccgcttccctctcctcctcaccctcctcactccacgtgtcgcagggtcttgggcccagtctggtgctagactcacgcctaccctcagtccgtcgtcggggacccccggnacgccggtcacgntctcttgttcgnggacncgagctaccgaattagacggtaaatgaattaacgtgtactacgtcggtaccaggcaaacgtcccgacgtaacccggacccctaaactccanacgttacctaanaaccaagtcgactcgaacggccgtaccctcggacggggttcccncggtcctacttcgtcgtcggcctaccgtaagttcgtcggaccgtcccttgacggccctaccgtcggacctagtcgaggtcggacccgtccggacccggtagactcgggactcgtgtattacgtgttcggtagttacgggtgactccggactacgtccgtacggtctggtacccttaggtcgtacggagtcggtacggacgtacgtccgtaccgtcgtacgtccacgaccgaaccgcctaacccgtcg

SEQ ID NO: 163498 - DNA, 883 bp, Homo sapiens
  misc_feature: GYAE6OF01CJORY.47.55.E11.1.454.CMB.1.raw
  modified_base (222)..(222): a, c, t, g, unknown or other
  misc_feature (222)..(222): n is a, c, g, or t
tcagagctcacgtacacgaccggtgctcgatttagcactcgcacgttggggtttggggagcttcagctgtggtagagaagacaggattcaggacaatctccagcatggccgcttccctctcctcctccaccctcctcacctcactgtgcgtagggtcttcgggcccagtctgtgcctgactcacgcccaccctcgacgccgttccgccggggacccccgggnaacggaccggtccacctattcgttctttggttcgaggaacgctagcctaactaattagtacggaaatgaaattatagtaatacgttacggaaccaggactaaccgacccgaaccggaacccgacccccaaatcctacactaacctaataaacgtaatcgtaacacgacgggtcccggtacccgttaccgggaccggggtttccccacggtacccgttaactttccgtcgttacggcctaaccgtaacggttcgtacgggcctacccgtcgacccgtaccccgtacccgtacggacccttaagtccgggtacggggttcccgggaccccggtacccgggaaccccgggtaaggtacggttacgggaaccgttcgggtttaaactacgtttttaaacggtttccggttacgggtttaggggttacggggttttaacgggaccgttaccggtaccggtaaaccgtttcccggttacggttaaccgggttacccgtttccggtttaaaccggttccgggtttaaccggggcgttacccgggtaaacggggtaaccccggttaaacgggttcccccggttaccggtttaccccgggttaaaccgggcccgggaaaccccgtaaccccgggtaaccggaaacccccccttaacccgttaaccccggg

SEQ ID NO: 163499 - DNA, 691 bp, Homo sapiens
  misc_feature: GYAE6OF01AD0Q0.47.55.E11.1.454.CMB.1.raw
  modified_base (266)..(266): a, c, t, g, unknown or other
  misc_feature (266)..(266): n is a, c, g, or t
  modified_base (521)..(521): a, c, t, g, unknown or other
  misc_feature (521)..(521): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagcgttggttttccttgttgcttacttttaaaaggtgtccagtgtgaggtgcaggtagtggaggtccgggggaggtcttagttcgagccgtgggggtccctgagactctccgtgcgcacgcctctggtntttccttcgttttagttagttactcgcctagttcgtacgttcggggtcccgccgacgggccgtaccggaaggggaacgggtcgtgggaggttcgggtctcgaggtctagttgggtggtagtcggtcgaccgaggacagtacgttaacgtaacgtcctgacgacggtcctactttctttactcctacgacgaactaccgtaagttccgaaaggaactaagtactagttacttcgtacgtcgtacggtaccaaccgnggtacgtagaaggtacggtacggacggaaccgtccggtaacgttagttaattacgtttaggttaagtaaggttgggtagttggggttacgacggttacgtcggtttccggggtacccgggggaccccgggttaccggttcggtacccggtcccgttcgtttcgtacccgg

SEQ ID NO: 163500 - DNA, 734 bp, Homo sapiens
  misc_feature: GYAE6OF01EG8EF.47.55.E11.1.454.CMB.1.raw
  modified_base (277)..(277): a, c, t, g, unknown or other
  misc_feature (277)..(277): n is a, c, g, or t
tcagagctcacgtacacgaccggtgctcgatttagcactcgcacgttgggttttccttgttgctcttttaaaaggtgtccagtgtgaggtgcaggtagtggaggtccggggaggcttagttcagccgtggggagtccctgagactctcctgtgtagtctctggaatctagtttcagttaccttctggatgcacgtcgggtccgaccaaactccgagggtaagggctggtgtggtctcgacgtatcaatccgtgatggctagttagttaattaaattntggtcggacctccggtggaacgggtaccctaattcgagcctaacttccgtaccaaggaacgtaaccgaaacggacaaaggtaacgttactacggttagtaacttacggtaaggtaaaatagaaactaatcgtagaagtacgtacgaacgtacgtacggcttgtactatctagtttgttacgtttaggacttccgttcccggtttacgggtccggtcggtaccgttccgggtcggggtacccgtaacggtacccgtgggtaacctcggtaccgtcctcctacgtacccgaccctaccgaaccggtaccgcccgttacgtcccgttcccccgtcccggtcgcccgtacccgtcgtaccgtccgaacggtccgacccgtacccgtaccgaacggacaccggaccgcccggcccggtacccggtcggcccgttaccgcccggttggaaccgtaaacccggg

SEQ ID NO: 163501 - DNA, 595 bp, Homo sapiens
  misc_feature: GYAE6OF01BRWPS.47.55.E11.1.454.CMB.1.raw
tcagagctcacgtacacgaccggtgctcgatttagcactcgcacgttgggtttgggggccgcagccctgggattcccaactgtttctgcttgctgatcaggactgcacacagagagctcaccatggagtctgggctgagctgggttttccttgttgctacttttaaaaggtgtccagtgtgaggtgcaggtagtggaggtccgggggaggcttagttcagccgtggggacgtccctgagactctcctgtgtagtctctggaatctagtttcagtaccttctggatgcacgtcgggtccgaccaaactccgagggtaagggctggtgtgggtctcacgtatcatccgtgagtggcgtagttagttaataaattgcgtacggtactcggtaggacggggctagtcgagtcactcctcgaagagaacgaacggacaagtagtatacgtagtattacgtaggaaactagaaactatcgaggagagtacgacgagtcgtactgtactagtctagtttgttacgagtcgttccggttccggtccggtcgggtaccgttcgggtacggggcccgtaaacgggtcccgttggtccgtaccggg

SEQ ID NO: 163502 - DNA, 758 bp, Homo sapiens
  misc_feature: GYAE6OF01BU55M.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgtcttacgttttaaaaggtgtccagtgtggaggtgcgaggtagtggaggtccgggggagtcgttagttcagccgtggggacgtcccgtgagactcctccgtgtgtagtctcgtaggatcgtagtttctacgttaccttgtggtatgctacgtcgggtccacctaacgtcgagggtacgggtcgtggtgtcggtctacgacgtatacgtactccgtgtacgtggactagttagttaaattaaagttgtcggaccggtacgtcccgggtagggaccgggtccgtattccgacgtaccgtacttaccgtaccgaagggtaacgaaacccggaacgggtaacctaaggtaacgttaactacgttaagttacgtacgtaaagggaactaacggtaacctaagttcggtaaggtacgtacggtaccgtaacggtaaggtttaacccggtgttaacggttccttaacggttacgtttagttttcgggttttacggtttttaccggacgtttccccggttcccgggtttccggggtaccccggttaccgggttaccgtttaccgggggtacccgggggaccccggttaaaccgggggtaccccgttcgggg

SEQ ID NO: 163503 - DNA, 589 bp, Homo sapiens
  misc_feature: GYAE6OF01AFJ09.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaggtgtccagtgtgaggtgcaggtagtggaggtccgggggaggcttagttcagccgtggggagtccctgagactctcctgtgtagtctctggatcagttcagtaccttctggatgcacgtcgggtccgacccaaactccgaagggtaaggggcgtgggtggtgggtcctcacgtatcgaatccgtgagtggctagtagttaataattagtgcggtactcggtgacgggtcgattcgagcatctacgagacacgaacggacgaagtagtatacttgtatcgtaggaaatgaacagtcgtagaacgacgtacgaacgtacgtacggtcctagtacgttatacctagttgttagtttcgtacgttcgtcccgttccgggtcccggcggttaccttcgggacggggtccgtacgggtaaccgttcggg

SEQ ID NO: 163504 - DNA, 769 bp, Homo sapiens
  misc_feature: GYAE6OF01AFRJJ.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagtcgttgggttttccttgttgcttacgttttaaaaggtgtccagtgtggaggtgcgaggtaggtggaggtccgggggaggtcttagttcgacgccgtggggacgtcccgtgacgtctctccgtgtgtagtctcgtaggtatcgtagtttcacgttaccttcgtaggtagtcgacgtacggtcggggtaccccaacccgtaaaccgtaccggtaagggtacggggtcgttacgggtggttcggttcctaccgtacgttacgtactaacgtccgtagtacgtggtactagtttaagttaattaaagttacgtcgtaccggtacgtccgggtacgggtaccggggtacctacgttaccgacggtactacgtaccgtacccggtaagaaccggtaaccgaaacggacgtaaagtacgtttaactacgttgttaacgttacgtaaggtaaactacggtaactaagtacgtaggtaagtcggtaacgtaacggtacggttaccggactttcgtaacgttaacttggtttaacgttcggtttttacggtcgttacgttcccggttccggttcccgggtaccggtcgggttaccgttccggggttaccggggaacccgttaccggggtcccggttacgg

SEQ ID NO: 163505 - DNA, 678 bp, Homo sapiens
  misc_feature: GYAE6OF01BGA46.47.55.E11.1.454.CMB.1.raw
  modified_base (207)..(207): a, c, t, g, unknown or other
  misc_feature (207)..(207): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctcggggacccccggnagacggtcaccatctcttgttctggaagcagctaccaatatacggaatgataatgtatactggtacagacacgtaccccaacggaacccggacccccaaactcctacactactaataacaatgatcgacgccggccctcggacgggtcctcggccgtattctcgtgcctacctaagtcgtcggccgtcctcgaccgtaccctacccgtcggccctaatccgtaacggtcggggacccgtcccgggacccggtagggacgtcgggacggtcgttacgtaacgtttacgttacgttgggttagggttcgggttagggtacttccggacgtacggtcccttagtccgttacggttacctttccggttcggttacgggacgtccgggtaacgggaacccggttaacggtcccgacccggttacccgtacggtacccgaccggtaccccgaaccggtacccccgaaccccgttacg

SEQ ID NO: 163506 - DNA, 757 bp, Homo sapiens
  misc_feature: GYAE6OF01B2BMU.47.55.E11.1.454.CMB.1.raw
  modified_base (192)..(192): a, c, t, g, unknown or other
  misc_feature (192)..(192): n is a, c, g, or t
tcagagctcacgtacacgaccggtgctcgatttagcactcgcacgttgggtttggggagagaagacaggattcaggacaatctccagcatggccggcttccctctcctcctcaccctcctcactcactgtgcagggtcttgggcccagtctgtgctgactcagccaccctcagcgtcgtcgggacccccggnagacggtcaccatctcttgtctggaagcagctccaatatcggaaatgataatgtatactggtaccagcaagtcccacgaaccggccccaaactcctacatactaataacaatgatcagccggccctacgacggggtccctggtcccgattcctcgtcggccttaccgaagtccgtcgggccgacccttcgaaccggtcccctaaccccgtcgggacccctaagtcccggtacgggttcggggccccgttacccccggggacccggaaggggtactcgggaacgggttccgttaaggttaacgttttaacttttaaccggttgggtttagggtttacggggttacgggggttaactcgggtaccgtaacgtcccgttagtaccgttacggtacccgtttaaccgggttccgttaccgggtaacgtccggttaccggggaacccgtaacggggttccctaccccggttaccggttacgggtcccgaaccgggacccgtaaaccgggacccctaaaccccgtacgttacgtaccctaccgttcccgttacccgtccccccttaccccg

SEQ ID NO: 163507 - DNA, 575 bp, Homo sapiens
  misc_feature: GYAE6OF01EO2S3.47.55.E11.1.454.CMB.1.raw
  modified_base (554)..(554): a, c, t, g, unknown or other
  misc_feature (554)..(554): n is a, c, g, or t
  modified_base (556)..(575): a, c, t, g, unknown or other
  misc_feature (556)..(575): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggttttccttgttgcttacttttaaaaggtgtccagtgtgaggtgcaggtgtggaggtccgggggagtcttagttcaggtccgtgggggactccctgacgtacttcctccttgtgttagtcctcgtaggaattcgtagttttcacgttaccttcgtaggatgctacgtcgggtacccgaccaaactccgacgtccctacccgaaccgaccgggccctacgtcccggttcccttcccccgtggcccgtcccgtgccctccgaggacgacccacccgtaccgagacgaccgaccgacggcccggccgtcgggcctcggcccgtcggtaccgaacggttacccttaccgttccgtacggtcgtacggtccttcgtacgggaccggcggggtccgtggacgacgggccgactagngnnnnnnnnnnnnnnnnnnnn

SEQ ID NO: 163508 - DNA, 730 bp, Homo sapiens
  misc_feature: GYAE6OF01COU65.47.55.E11.1.454.CMB.1.raw
  modified_base (208)..(208): a, c, t, g, unknown or other
  misc_feature (208)..(208): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcacgccaccctcagcgtcgtcggggaccccggnagacggtcacctatctcttgtctggaacgcagcctacaatactacggaaatgactaatgtaatacgtaggtaccagacaacgtccgaacgaacccggacccccaaacctcctctaactactaataacaatacgatcgaacggccggtccctaaccggtcgggtaccccgtaggtaccggtaactttccgtcgtcggtacctaccaacggttcgtacggccgtaccacctaccgacccgtacccgtcggaccctacgtccgtaacgggtcgggtaccccgtccgggtacccggacggggtacgtacgggaaccgggtcgtttaaaccgggtacttttaacgttttacgggttacgtttaacggggttaacggggttttcggggacgtttacgggaccgtacgtcccgttagttaaccgtcggttacccgtttacgtcggttacggtaccgtcggtacgggaccgtaacggtcccgtaccggttacgtacgtaccgacggaccctacggaccctacccgtaccg

SEQ ID NO: 163509 - DNA, 736 bp, Homo sapiens
  misc_feature: GYAE6OF01AW8X2.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctggctgagcttgggttttccttgttgcttacttttaaaaggtgtccagtgtgaggtgcgaggtagtgggaggtccgggggaggtcgttagttcgacggccgtggggtacgtccgtcgagactcctcctgtgcacgtcctcgtggtacttcctaccttttacgttccttcgttggtatagtaagttcgggtccgccgtacgacgtccgaggggaaggggcgtgggtagggtgggttacggactaaacaataaacgtaccgagtagtaggaacgtaacgaaacgtaaaaccgttagtacgtacggactcgttacgtaggtaaacgggtcgtaacgttaccaaccgtactaccgtaccgaaggaacgaaccaaaccggaccaaacggtaaccttcttacgtttgtttaccagtaacgaaacgtcggactacggcctagggaacaacgggtaaccgaaacgtaccgacgggttcttaggttacttaacgttccgtggttaccgttgttcccgttaccggtacggcccggttccccggtacggggtaccccggttcgtttcgggtccctttcggggtaccgggggccccttaacgggggtacccccttggg

SEQ ID NO: 163510 - DNA, 956 bp, Homo sapiens
  misc_feature: GYAE6OF01CAHBQ.47.55.E11.1.454.CMB.1.raw
tcagagctcacgtacacgaccggtgctcgatttagcactcgcacgttgggtttggggagcttcagctgtggtagagaagacaggattcaggacaatctccagcatggccgcttccctctcctcctcaccctcctcactcactgtgcagggtcttgggcccagtctcgccccgactcacgcctgcctccgtgtcctgggtctccgtggacagtcgatcaccatcctcctgctacgtcggaaccaggtagtgtacgttggctagttctgtattctactctccgtacggtaaccaacaaccacccaggaccaaacgaccccctaaactactaattaactttatacgacgtactaagttcgttcccgaccccttcgtacgggtttcctacgtaacgttccggttccttacgttcgtacggtacccttaacctaaacgttccgttacggaaccgaaacccggtaccgtccccttacccgtaccgaccctaacttccccgttacgggtcgggtaccccgttacggtaacggttccgtaggggtaacggggtacccggtaacgggttaccgtttaacggtttaaccgttttttaaacccgtttcggtttttaccgggttttaccggtaccccgtttttacggggttttaacccggggtaaccccttttaaaaccggttttaacccggttttcgggggttttttaaccggggtttttcggggggtttaccgggtttttaacccgggggggtaccgggggtaaacccgggggttaaaccccgtttaaaacgggggttttcccggttaaaccccccggggttttaccccgggtttaaacggggttacccccgggtaaaaccccggttaacccccgggtttaaaaccgggggttcccccggtttaacccccccgggttccccccccgggttttaacccgggtttaaccccgttttaacccccccggg

SEQ ID NO: 163511 - DNA, 856 bp, Homo sapiens
  misc_feature: GYAE6OF01ECWO0.47.55.E11.1.454.CMB.1.raw
tcagagctcacgtacacgaccggtgctcgatttagcactcgcacgttgggttttccttgttgctcttttaaaaggtgtccagtgtgaggtgcaggtagtggaggtccggggaggcttagttcagcctggggagtccctgagactctcctgtgtagtctctggaatctagtttcacgtaccttctggatgcacgttcgggtcccgacctaaaacgtccgagggtaacgggcgtgggtgtgggtctcgacgtatacaatcctgatggctagttagttaattaaattacgtggaccggtaccgttcccgggtagggtaacgggggcctaaagttccgaacgtacctactacctacccgaaggaaacgaacccggaaaaccggacgtaaaggtaacgttaacgtacttaacggttaacgtacgttaaagggaaataacgaaaacgtaagtaccgtaagggaaacgtacgggtaacggaacggtaacggtaccggttacgtacgttacgttaacttaccgttaggttttacggtttcggttttagtaccggtttccggttcccggtttccgggtacccggggttacggttacccggtccgggtaccgggggtaacccgtaaccgggttacccgtggtccgaacggttcccgtacctcctaccgaccgtacccgaccctaaccgggacccgtccctacccggttcccggttaccccgtccccggtcggccctacccgttcggacccgttcgacccggtacctccccgtaacccgtaccggaacggaccgtcccggaacgggacccgggtccccgccggtaccgggtcctacccgggtcccgtaacggaccgggttaacccgg

SEQ ID NO: 163512 - DNA, 855 bp, Homo sapiens
  misc_feature: GYAE6OF01BPZ3U.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcacagtggagtcgtggctgagtcgttgggttttccttgttgtacttacgttttaaaaggtcgtccgtaggttgtggaggtgacgtagggttaggtcgggtacggggtccgggggtagtcgttagttcgacggtccggtggggtacgtccgtggacgtaccttcgtccgttggttgtacgttctacggtaggtaacttcgttacgttttacctacgtttccgttggtggagttcgaccgtaccggttccgggtacccgtaacccgtaaacggtacgggttaacgggggttaacggggtcggtttcgggttggttccgggttacctacggtaacgttatactaacgttcgtagtcggtagtagtttaggttaacgtttaaagttaacgttggtcggtaccggtacgtcgggtagggacgggtcttacgtacgcgtacctacgtcggtacgaaggaacgaacggtaacgaagtagttaacgtaacgttacttaggttaaactcggttaaaaggtaattaacgggtaaactaccggttaggtacggaaacgggttcgtaaacggtaccggtacggtttacgtacgttagttacgtttaacgttcgtttagggtttaacgttttccgggtttacgtaaccggtttcccgggttaccgggtttcccgggggttccgtaaacggggtttccccggttaccggggtaccggggaaccccgggtaaaggggttccccgttaccggg

SEQ ID NO: 163513 - DNA, 695 bp, Homo sapiens
  misc_feature: GYAE6OF01D8V7W.47.55.E11.1.454.CMB.1.raw
tcagagctcacgtacacgaccggtgctcgatttagcactcgcacgttgggtttgggggccgcagccctgggattcccagcttgtttctgcttgctgatcaggactgcacacagagagctcaccatggagtctgggctgagtcttgggttttccttgttgtcttacttttaaaaggtgtcctagtgtgaggtgcgaggtagtggaggtccgggggagtcgttagttcgagccgtggggacgttcccgtgacgtaccttctccgtggtgtagtctcgtaggaacttctagtttcagttaccttgtgatgctacgtcggtaccgacaaacgtccgtaagggtacgggtcgtgggtggtcggtctcgtacgtatacaactcgtgtatggactagttgttaataattagtcgtacggtacgtcggtagggcgggtctaagttcgacgactactcccgtaacgaagacgtaaaccgaacgaacgtaaaggtcttaagttacgttagtaactacgtaaaggtaaatacgtaaatactgtaagggaacgtacggacgtaaacggtacgttaccggacgtttatacgttaacgtgttacggttttgtttacggtttacgaccgtttcccggttacccggttcgggtacccggtccgggttacctccggggttacgggaccccggttaacgggtcccggttacgg

SEQ ID NO: 163514 - DNA, 807 bp, Homo sapiens
  misc_feature: GYAE6OF01CHGOI.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgcttcttttaaaaggtgtccagtgtgaggtgcaggtagtggaggtccgggggagcttagttcagccgtggggacgtccctgagactctcctgtgtagtctcgtggaatcgagtttcagttaccttcgtggatgcacgtcgggtaccaccaaactccgagggtaacgggcgtgggtgtgggtctcgacgtatacaactccgtgagtggactagttagttaaataaagttagtcggtaccggtacgttcgggtacgggacggggtaccgtagttacgacggtactacgttcctacccgaaggtaacgaaccgaaacggtacgtaaaggtacgttaacgttacgttagttaacgttaaccggtaaaggtaaacgttacggaaaaacccttaaagttaccggtaaaggtaacgggtaaccgggttaacccgggtaaacgggttaaccggttacccgggtacgtttacgggttaacctttaacgtttaccgtttacggtttttacgggttttacccgtaacggtttcccggttaccccgggtttttacccggggttccccggggtaacccggggttttaccggtttacccgggggtacccgggggggtaaccccgttaaacccggggggttacccccggtttggggttaacccccgg

SEQ ID NO: 163515 - DNA, 617 bp, Homo sapiens
  misc_feature: GYAE6OF01C0XG2.47.55.E11.1.454.CMB.1.raw
  modified_base (414)..(414): a, c, t, g, unknown or other
  misc_feature (414)..(414): n is a, c, g, or t
  modified_base (499)..(499): a, c, t, g, unknown or other
  misc_feature (499)..(499): n is a, c, g, or t
  modified_base (530)..(530): a, c, t, g, unknown or other
  misc_feature (530)..(530): n is a, c, g, or t
  modified_base (558)..(558): a, c, t, g, unknown or other
  misc_feature (558)..(558): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggttttccttgttgcttacttttaaaaggtgtccagtgtgaggtgcgaggtagtggaggtccgggggagtcttagtcaggccgtggggatccctgacgacctctcctgtgtagtctcgtggaatcgtaagttttccagttaccttcgtaggatgctacggtcgggtcccgaccaaactccgaagggtacgggtcgtgggtgtgggtctcgacgtatctaatccgtgagtggactagttagttaataacttgtggaccggtaccgttccggngggtacggggcctagttacacgtcgtactccgaccgaagaacgaacgaacggagaagtacgtatacgtagtactcgtaagaatanaactaatgtagagtagtacgacgtagtacgntcgtactattctagtttgttagtttcgnttccggttccgttccgggtccggttcggtaccgttcgggtgggacccgcggtccggtcg

SEQ ID NO: 163516 - DNA, 832 bp, Homo sapiens
  misc_feature: GYAE6OF01CBAEP.47.55.E11.1.454.CMB.1.raw
  modified_base (187)..(187): a, c, t, g, unknown or other
  misc_feature (187)..(187): n is a, c, g, or t
  modified_base (209)..(209): a, c, t, g, unknown or other
  misc_feature (209)..(209): n is a, c, g, or t
  modified_base (243)..(243): a, c, t, g, unknown or other
  misc_feature (243)..(243): n is a, c, g, or t
tcagagctcacgtacacgaccggtgctcgatttagcactcgcacgttggggtttggggagcttcagctgtggtagagaagacaggattcaggacaatctccagcatggccgcttccctctcctcctcaccctcctcactcactgtgcagggtcttgggcccagtctgtgctgactcacgccaccctnagccgtcgtcgggacccccggnaggacgtcacccattcctcttgttctagggaacncagctaccaatatacggaatgactaagtgtatacgtgtacagacaagtcccacgaacccggaccccaaacgtccctacactactaacaactaagtcgtataccgaggcccggacctacggacggggttcccctggtacccgtactttccgtaccgtcgggtcctacccgaaggttcccgtagggccccggtccttacccgaaccggttccccgaaccccgttccgggaaccctaacgttccgggtaacggggtccggggtaccccgttaccccgggggaaccccggtaaggggttacgtcgggtaacgggttcccgtaaggtttaacttttacggttaccgtttaggggttacgggtttaacggggttcgggaacgttcccggaacgggtaccgtccccggtttaggtacccgtttacggttacccggttttacccgggttaccgggttaccggggaacgggttaccccgggttaaacggggtaaaccttaacccgggggttaccctaaccccggtttacccggtaaccggggttaccctaaacccggacccccggtaaaccggggacccccctaaacccggtacccgg

SEQ ID NO: 163517 - DNA, 764 bp, Homo sapiens
  misc_feature: GYAE6OF01DY5UR.47.55.E11.1.454.CMB.1.raw
tcagagctcacgtacacgaccggtgctcgatttagcactcgcacgttgggtttgggggggggaagctcagcttcagctgtggtagagaagacaggattcaggacaatctccagcatggccggcttccctctcctcctcaccctcctcactcactgtgcagggtcttgggcccagtctgtgctgactcagccaccctcagcgtctcgggacccccgggcagacggtcaccatctcttgttctggaagcagctcaatatcggaaatgataatgtatacgtggtaccagcaacgtccccaacggaaccggacccccaaactcctacattactaataacaatgatcgacgccggccctcggacggggtccctggccgtacgtttcctcgtcggtacctaccgtaaacggttccttacgggcccgtcccttacgaccgtaccccgtaacccccgttcgggacccctacgttacccgaacgggttccggggtcccgttccccggggacccccgggtaagggtacgttacgggacgggtccttagggtaactttttaacgtttaacggttgggtttacgggttacggggtttacggggtacgttaccggaccgttaacggtcccgttacgtaaccgttcgggtacccgttttaacccggtttccggttaccggggtaggtacccgggttacggggaaaccccgtaacgggttaccccgtaccccggttaccggttaggttaccccgaaccgggtacccccgtaaaacccgg

SEQ ID NO: 163518 - DNA, 644 bp, Homo sapiens
  misc_feature: GYAE6OF01CNL6L.47.55.E11.1.454.CMB.1.raw
  modified_base (206)..(206): a, c, t, g, unknown or other
  misc_feature (206)..(206): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctcgggacccccggnagacggtcaccatctcttgttctggaagcagctaccaatatcggaaatgataatgtatactggtaccagcaagtccccaacgaaccgcccccaaactcctcatctataacatgatcagccgcctcgacgggtccctggccgtattcgtcgtggcctccgaagtctggccgcctcgacgaccctacccgtcggcctacgtcgtacggtcgggcccgtcccggcccggacgggactggacggtcgtagtacgtttacgttacgtgttacgggttagggttcgggtacgtcggtcgtacggtccgtacgtaccgttcgtaccgtttaccgttccgttacgggtacgtaccggtacgggtaacccggtaacgggtcccgtacccggttcccgtacgggtacccgaccggaccccggaaccggccccgtaaacccccgtaccg

SEQ ID NO: 163519 - DNA, 822 bp, Homo sapiens
  misc_feature: GYAE6OF01BKQKQ.47.55.E11.1.454.CMB.1.raw
  modified_base (267)..(267): a, c, t, g, unknown or other
  misc_feature (267)..(267): n is a, c, g, or t
  modified_base (277)..(277): a, c, t, g, unknown or other
  misc_feature (277)..(277): n is a, c, g, or t
tcagagctcacgtacacgaccggtgctcgatttagcactcgcacgttgggttttccttgttgctctttaaaaggtgtccagtgtgaggtgcaggtagtggagtccggggaggcttagttcagcctggggagtccctgagactctcctgtgtagtctctggaatcagtttcagtaccttctggatgcacgtgggtccgccaaactccgagggtaagggctgggtgtgggtctcgacgtatcaatcctgatggcagtgttaataaattngcgtactcgnggacgggcatcgagctactctccagacgacgaacggtacaagtagtactacgtagtactacgtaaggaaatacgaaactaagtacgtaggaacggtaacggtacggaaacgtaacggttaaccggtcgtttacggtacttaactacgtttaagttttcgtttacggacgttccggtacccggttcggggtaccggtacgggtaccgtttcgggacgggggtaccgaacgggtacccgtcgggtaccacgggtccttcccgttcccgtacggtaccccggtacccccgttaaccccgaaaccgggtaccgggtacccccgtacggtttcccccccgggttcccttccccccgggtacggggtcccccttacccggtcgtaccccgtaccggtaacgggacccgtaccccgtaccccggttaccggagggtaacccgaccccgaaacccgggtcccggggacccccggggtttacccggtccgggttacccgtaccccgggtacccggtttaacggggtaaaccccggtaaacgggtttaacccccg

SEQ ID NO: 163520 - DNA, 784 bp, Homo sapiens
  misc_feature: GYAE6OF01D3CQW.47.55.E11.1.454.CMB.1.raw
  modified_base (180)..(180): a, c, t, g, unknown or other
  misc_feature (180)..(180): n is a, c, g, or t
  modified_base (200)..(200): a, c, t, g, unknown or other
  misc_feature (200)..(200): n is a, c, g, or t
  modified_base (222)..(222): a, c, t, g, unknown or other
  misc_feature (222)..(222): n is a, c, g, or t
  modified_base (238)..(238): a, c, t, g, unknown or other
  misc_feature (238)..(238): n is a, c, g, or t
  modified_base (377)..(377): a, c, t, g, unknown or other
  misc_feature (377)..(377): n is a, c, g, or t
tcagagctcacgtacacgaccggtgctcgatttagcactcgcacgttgggtttggggagctgtggtagagaagacaggattcaggacaatctccagcatggccggcttccctctcctcctcaccctcctcactcactgtgcagggtcttgggcccagtctgtgctgactcagccaccctnagcgtcgtcgggaccccggnagacgtcaccatctcttgttcnggaagcagctacaatnacggaaatgataatgtatactggtaccagcaacgtaccaacgaaccgaccccaaatcctacatactaataaacaatgatcgacgcgccctcgacgggtccctggccgatttcgcgtcggactaccgaagtccgtggccnccgtacaccggccccacccgtggaccctaataccgtagggtaccggggtcccgtaccccgggaaccccgggtagggtaaacgttcgggaacgggtaccgttaagggttaactttttaaacgtttaaaccggtttggtttacggggtttaaaggggttttaccggggaaagtttcccggaacccggtaacggttccccgttaacggttaaccggtttacccgggttacgtttttaaccgggttaccgttttaccggggaacggttacccggttaggggaaaacccccggttaaaggggtttaccccccaaccgggtttacccggttaaccgggtaccggttaaacccgaaccccccggtaaaacgggcccccctaaaaacccccgacgtttccggtaacccttacccg

SEQ ID NO: 163521 - DNA, 741 bp, Homo sapiens
  misc_feature: GYAE6OF01DXQVI.47.55.E11.1.454.CMB.1.raw
  modified_base (214)..(214): a, c, t, g, unknown or other
  misc_feature (214)..(214): n is a, c, g, or t
tcagagctcacgtacacgaccggtgctcgatttagcactcgcacgttggggtttgggggagcttcagctgtggtagagaagaaaggattcaggacaatctccagcatggccggcttccctctcctcctcaccctcctcactcactgtgcagggtcttgggcccagtctgtgctgactcacgcccaccctcagccgtcgtacggggacccccggnacggacgtcaccatctcttgttctggaagcacgcctaccaatagtacggaaatgaattaatgtaactacgtaggtaccagacaacgtcccaacggaacccggaccccaactcctacactctaataacatgatcgacgccgccctcggaccggggtcctggccgtacttcgtcgtcgcctacaacggtcgtacggcctcctaccaccgtccctacccgtcggacctacgtccggtacgggtccgggcccgtccccgggaccggaggtacgtacgggtaacggtcgttaaggttaacgttttactttacggttgggtttacggttacggggttacggtacgttaccggtaccgtacggtcccgtacggttaccttacggttccggtttaaccgtccggttacggtacggtaccggttaccggggtaacccggtaaccgggttccccgtaacccgggtttacccggttacgggacccgtaacccggaccccgtaaacccgggaacccccctaaaccccgtcgttaccccg

SEQ ID NO: 163522 - DNA, 665 bp, Homo sapiens
  misc_feature: GYAE6OF01AYNBB.47.55.E11.1.454.CMB.1.raw
  modified_base (187)..(187): a, c, t, g, unknown or other
  misc_feature (187)..(187): n is a, c, g, or t
  modified_base (410)..(410): a, c, t, g, unknown or other
  misc_feature (410)..(410): n is a, c, g, or t
tcagagctcacgtacacgaccggtgctcgatttagcactcgcacgttgggtttggggccgcagccctgggattcccagctgtttctgcttgctgatcaggactgcacacagagagctcaccatggagtctgggctgagcgtcggtttctgtagctctttaaaggtgtcagtgtgaggtgcaggtagnggaggtccggggagtcttagtcagccgtgggtactcctagacgctcctctgtgtacgtctgtaggattcgtagtttcagttacctgtaggactgcctacggttcggtcccgaacccgtaaaccgtccggtaagggttaagggcgttcgggtggtcgggttcctaacgtagttaactacaacttccgaggtacgtgacgtaaggttatttaaagtaaacgtttnacgggtaccggtacccggttcggtacgggtacgggtaccgttagtcgtacgactacgtacctacgaacggacgaccgtaaacgacgtaacgagttaacgtacgtaggtactacggtaagtaagtaactaactaagtacgtaggaacgtcggtaaccggtactaacggttcggtctagtactaagttcgtagtttacgttgtcgacgttcgccgttcgggaccgttcgtacgtcggcggaccgtaccgggtctcgg

SEQ ID NO: 163523 - DNA, 774 bp, Homo sapiens
  misc_feature: GYAE6OF01DTB3O.47.55.E11.1.454.CMB.1.raw
  modified_base (172)..(172): a, c, t, g, unknown or other
  misc_feature (172)..(172): n is a, c, g, or t
  modified_base (194)..(194): a, c, t, g, unknown or other
  misc_feature (194)..(194): n is a, c, g, or t
  modified_base (369)..(369): a, c, t, g, unknown or other
  misc_feature (369)..(369): n is a, c, g, or t
tcagagctcacgtacacgaccggtgctcgatttagcactcgcacgttgggtttggggagagaagacaggattcaggacaatctccagcatggccggcttccctctcctcctcaccctcctcactcactgtgcagggtctcgggccagtctgtgctgactcacgcccaccctnagcgtcgtacgggacccccggnagaccggtcaccatctcttgtctggagcagctacaatagtacggaaatgaataatgtaactactaggtaccagacaacgtcccaaccgaaccggtaccccaaactcctacatactaactaaacgatacgatacacggccggccctcggaccgggtcccgtcgccgtattcgtcgnggcctaccgaagtcgtcgccgcctcaccgccgtacccgtcggcctacgtcgacggtccgggccgtcccgggcccggtaagggtacgtcggaacggggttaccttaggttaacgtttaacgtttacgttcgggtttagggttaacggggtttcgggaacgttccgggaccgtacggttaccccggtagtaacccggtttacggtaccgtttttaccgggttaccggtttaccggggtaccgtaccgggttacggggaaaccccgttaaaccggtcccggtaaccccggttccggtaccgggtttaccgaacccccggtaacccccggtaaacccggacccccgtaaacccccgtacgttacccggtcccttaacccgttccgttaccccgttccccccggttcccc

SEQ ID NO: 163524 - DNA, 667 bp, Homo sapiens
  misc_feature: GYAE6OF01DZMNP.47.55.E11.1.454.CMB.1.raw
tcagagctcacgtacacgaccggtgctcgatttagcactcgcacgttgggtttggggggaagaggaagactgacggtcctgccacaggtggtgctgggcacggtgggcactcgacacaacatttgcgctcaactgtcttgctcaccatggagtctgggctgagcttgggttttccttgttgctcttttaaaaggtgtccagtgtgaggtgcaggtagtgggagtccggggggagtcgttagttcagccgtggggagtccctgagactctctgtgtagtctctggaatctagtttcacgttaccttcgtggtatgcacgtcgggtccgccgtaaacgtccgagggtaacggggctgggtgtgggtctcgacgtatacaatcctagatggactagttgttaataaattgtgcggtactcggtaggacgggtacgtattcgagtactacttctaccgaagacgaacgaacggtacgaaagtagtaatacgttatacgtacgtaaggaaactacggtaaactaacgtacgtaggtaacggacgtaccggtaacggtaacggtaaccgggtcttacgggttacttaacttcgttaacgtttcgtttcggtttacggttaacgtttcggttaccccggtttaccgggttccccgggtccggggtttacccggg

SEQ ID NO: 163525 - DNA, 793 bp, Homo sapiens
  misc_feature: GYAE6OF01EHKK3.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccagtggagtcgtgggctgagtcgttgggttttccttgttgtcttacttttaaaaggtgtccagtgtgaggtgcgaggtaggtgggacggtccgggggaggtcgttagtcgagccgtggggtacgtcccgtgacgtactctctgtgtagtctcgtaggtatcgtagttctacgttaccttcgtggtagtcgccgtacgtcgggtaccccgtaaccgtaaaccgtccggaaggggtaacggggcgttagggtggtcgggtcctacgtacgttatactaacgtccgtagtagtcggtactaagtttaagtttaaagttaaagtttagtaccgggtaccggtaccgttaccgggtacgggtacggggtaccgtagttacgacggtaccttaaccgttccgtaacccgaaaggaaccggtaaaccgaaacgggtaacgtaaaggttaacgttaacgttaacggttacgttaactaacggtaaaggtaaaacttacggtaaactaacgttacgaagggtaaacgtacggtaaccggtaacgtaacgttccggtattacgttacttagttacgttagttttcgtttacggttaccgtagttcccggttcccgggttacccggtccgggtcggttaccgttccggggtaccgggtaccggtaaccggtacccgttacggg

SEQ ID NO: 163526 - DNA, 622 bp, Homo sapiens
  misc_feature: GYAE6OF01ETP1V.47.55.E11.1.454.CMB.1.raw
  modified_base (264)..(264): a, c, t, g, unknown or other
  misc_feature (264)..(264): n is a, c, g, or t
  modified_base (340)..(340): a, c, t, g, unknown or other
  misc_feature (340)..(340): n is a, c, g, or t
  modified_base (534)..(534): a, c, t, g, unknown or other
  misc_feature (534)..(534): n is a, c, g, or t
tcagagctcacgtacacgaccggtgctcgatttagcactcgcacgttgggttttccttgttgctcttttaaaaggtgtccagtgtgaggtgcaggtagtggaggtccggggaggcttagttcagcctggggagtccctgagactctcctgtgtagtctctggaatcagtttcagtaccttctggatgcactgggtccgccaaactccaggtaagggctggtgtgggtctcacgtatcaatcctgatggcagtgttataaattangcggactccgtgagggcattcagcatctaccagacgacacggcaagagtatactgtatcgtaggaaatgaacatcngagagtacgacgagtacggctagtctatctatttgttagttttcgatcgtcccgttcgggtccgcgggtacttcggcggggccgaggtaacccgtggcacggtctcctcctcaccgtccctaccaccgaccggccctagttccccggtcccttccccggcggtcccgtccccgtgccgtcccgaacgggtaccncccgaacccgtccggaagtaccggacctacggaccggcccggtccccggtacgggccttacccggcccggtaggtcccgtaaaccggg

SEQ ID NO: 163527 - DNA, 715 bp, Homo sapiens
  misc_feature: GYAE6OF01EWSN2.47.55.E11.1.454.CMB.1.raw
  modified_base (277)..(277): a, c, t, g, unknown or other
  misc_feature (277)..(277): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggttttccttgttgctcttttaaaaggtgtccagtgtgaggtgcaggtagtggagtccgggggagcttagttcagccgtggggatccctgagactctcctgtgtagtctctggaatctagtttcagttaccttntggatgcacgtcgggtcccgaccaaactccgaagggtaacggggcgtgggttgtgggtctacgacgtatcaatccgtagtatcggtactaggttagtttaaattaaagtttagtcggtacgggtaccttcccggtagggaccgggggtaccgtagttccgaaggtcctaacgttcccgtacccgtaaggaacgtaaaccgaaacgggaactaaaggtaagttaacttaacgtaggttaacttaccggtaagggtaaaagtaacgtaaactaagttaccgtaggaacggtaacggtaccgaaggtaacgttaccggcttacgttacttactacgttagtttcggttttacggttttcgattcggtccccgttttacgggtcccgttaccggggttaccgtttcgggtaccggggtcccgtacggggtaaccccgttggg

SEQ ID NO: 163528 - DNA, 666 bp, Homo sapiens
  misc_feature: GYAE6OF01BCNCI.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggttttccttgttgcttacttttaaaaggtgtccagtgtgaggtgcaggtagtggaggtccggggagcttagtcagccgtggggacgtccctgacgactcctccgtgtgtagtctcgtaggaatcgtagttttcacgttacctttcgtggatgcctacgtcgggtcccaccaaacgtccgagggtacgggcttggtggtggtcctacgacgtatactaatccgtgacgtggacgtagttagtttaataaagttagcggaccggtaacgttccgagggtacggggacctagttccgacgtactatccgtaccgagaaccgacgaaacggacgtaagaagttacgtacgtagttaactcgtaaaggaactacgaactaagtcgtaaggacgtagtacgtaaacgtacgtacggtactacgtacttagtcgtttagttccgtttgtttcgtacgttcgttcccggttccgggtccggtcgggttaacccgttcgggtaccggaccggtaaccgggtcccgttcggg

SEQ ID NO: 163529 - DNA, 638 bp, Homo sapiens
  misc_feature: GYAE6OF01BKSO6.47.55.E11.1.454.CMB.1.raw
  modified_base (516)..(516): a, c, t, g, unknown or other
  misc_feature (516)..(516): n is a, c, g, or t
  modified_base (557)..(557): a, c, t, g, unknown or other
  misc_feature (557)..(557): n is a, c, g, or t
  modified_base (574)..(574): a, c, t, g, unknown or other
  misc_feature (574)..(574): n is a, c, g, or t
tcagagctcacgtacacgaccggtgctcgatttagcactcgcacgttgggtttggggagccgcagccctgggattcccagctgtttctgcttgctgatcaggactgcacacagagagctcaccatggagtctgggctgagcttgggttttccttgttgtcttcttttaaaaggtgtccagtgtgaggtgcgaggtagtggaggtccgggggaggtcttagttcagccgtggggacgtcccgtgagactctcctgtgtagtctctggaatctagtttcagtaccttctggactgctacgtcgggtccgaccaaacctccgaagggtaacggggctgggtgtgggtctcgtacggtactacaagtcctgagtggctagttagttaaattaaatttagtacggacgtacgtaccgtggacggggtaccgtattcgagctattcctacgagaacgaaccgaacggacaaagtagtaacttacgtagttacgtacgtaaggaaaattcgaaactaagtagngtaacgacggttaccgaacgtacgacggtctgtctacgttntagttttgtacgttttnaggttccgtccggtttccgggccggtaccggtacgttccgggaggggtcccgaacgggtacccg

SEQ ID NO: 163530 - DNA, 688 bp, Homo sapiens
  misc_feature: GYAE6OF01D6M9A.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggttttccttgttgcttacttttaaaaggtgtccagtgtgaggtgcaggtagtggaggtccgggggagtcttagttcagccgtggggagtccctgagactctcctgtgtagtctctggaatctagtttcagtaccttctggatgcacgtcgggtccgaccaaactccgagggtaaggggcgtggtgtggtctcacgtatacaactcctgagtggctagttagtttaaataaagttagtacggtacggtacgtccggtagggacggggtccgtaattacgagtctactcctaccgaagacgaacgaaaccggacgaaacgtaagtaactacgttagttaacgttacgtaggtaaaatacgtaaactaagtcgtaaggaacggtaacggtaaccggtaacgtaacgttaccggtacgttagttacttaacgttcgttagtttgtttacggttttacgtagttccggtcccggtttaccgggtcccgggtaccgggttaccgtttccgggtacggggtaacccgtaacgggggtaacccgttacgggg

SEQ ID NO: 163531 - DNA, 846 bp, Homo sapiens
  misc_feature: GYAE6OF01DPUEW.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccagtggagtcgtgggctgagtcgttcgggtttttcctttgttgtcttacggtttttaaaaggtcgtccgtagtggtgtaggtgacgtagggtaggtgggaggtccggggaggtctttagttcgaggtccgtggggacgtccgtgagtacctccgttccgtgttgtacgttcttcgtaggtaacttcgttagtttccgtaacgtttaccgttcgtaggtacgtcgccgtaccggttccgggaccccgtaacccgtaaaccggtccggtaagggggttaacgggggtcgttaggggttcgggttacggttccgtaccgtacgttacgtaacctaacgtccggtagtacgtcggtacgttaaggtttaagtttaaattaaagtttacggtcggtaccggtaccggttccgggtagggaccggggtacctacgttacgacggttacaccgtttaccgtaccggaaggtaaccggaaaccggtaaccgggaacgtaagttaagttaacgttacgttagttaacgttagtaaggtaaactacgtaaacttagtagtaggtaacggacgttaccggaacgttaaccgtcggttaccgttgtaactttacgttactttacggttttcgtttacggtccgttcccggtttacccggttccggggtccggttaacccgggtttccgttccggggtacccgggacccgggttaacggtccccggttaggtacccgg

SEQ ID NO: 163532 - DNA, 690 bp, Homo sapiens
  misc_feature: GYAE6OF01C3U0I.47.55.E11.1.454.CMB.1.raw
  modified_base (371)..(371): a, c, t, g, unknown or other
  misc_feature (371)..(371): n is a, c, g, or t
tcagagctcacgtacacgaccggtgctcgatttagcactcgcacgttgggtttgggggccgcagccctgggattcccagctgtttctgcttgctgatcaggactgcacacagagagctcaccagtggagtcgtgggctgagtcgttggttttccttgttgacttacttttaaaaggtgtccagtgtgaggtgcgtaggtaggtgggacggtccgggggagtcttagtcagccgtgggatccgtagacgactctctgtgtagtctcgaggtaatcgtagtttctacgttaccttgtgagtgccgtacgtcgggaccccaacgtaaccgtccggagggtaaggtcgtggtcggtaggtcctacgtaacgttanaccgtaaacgtccgtaggtaagtcggtaacgtaaggtttaattaaattaaaattccggtacgggaccggtaaccgttccggggtagggacgggtacctaagtttcgagtactaccgtccgtaacgaacggaacgaaacggaacggaactaaaggtacttaagtaccgttagtaacgttaagtaaggaaagtacaaacgtaaagtttcgaggaaacgtagtaccggtaagtacgtacggtctagtacctagttcttagtttgttaccgtgaccgttcctcgggcggtacgtcgtacggcggaacggtacgtacgtggacg

SEQ ID NO: 163533 - DNA, 688 bp, Homo sapiens
  misc_feature: GYAE6OF01BVSZZ.47.55.E11.1.454.CMB.1.raw
  modified_base (210)..(210): a, c, t, g, unknown or other
  misc_feature (210)..(210): n is a, c, g, or t
  modified_base (241)..(241): a, c, t, g, unknown or other
  misc_feature (241)..(241): n is a, c, g, or t
  modified_base (330)..(330): a, c, t, g, unknown or other
  misc_feature (330)..(330): n is a, c, g, or t
  modified_base (385)..(385): a, c, t, g, unknown or other
  misc_feature (385)..(385): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctccaccctcctcactcactgtgcagggtcttgggcccagtctgtgctgactcacgccaccctcacgcgtcgtcgggacccccggnacgacggtccaccatctcttgttctggaacncagctaccaatagtacggaaatgaattaatgtaactactacggtacagactaacgtaccccaagaacccggaccccctaaactccctanactcgtaactaacaatacgataccgacggccgtccccgtacgacggggttccccnggtacctacttcctcgtacgcctacgtaacgtcgtccgcgtccctacgacgtcccaccgtcgcctacgtccgaaggtccggggacctccgggcccgaaaggtcgtaggtacgccgttagtaacgtttattacgttgggtaggtttacgggttaggtaacttacggccgtaacggtccttacgacgtttagtacccgtttaccgtcgtttaccgggacgttccgggtaaacgggacccttacgggtactacccgttaccggtacgtacctaaccggccctaaccggacccctaacccgtaccgg

SEQ ID NO: 163534 - DNA, 943 bp, Homo sapiens
  misc_feature: GYAE6OF01DB9R1.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagtcgttgggtttttccttgttgtcttacgtttttaaaaggtgtccagtgtgaggtgcaggtagtggaggtccgggggagtcttagttcagccgtggggtactccctgacgtactctccgtggttgtagtctcgtaggtaacttctagtttccagttacccttacgtggaatcgacctacggttccgggtcccctaacctaaaaccgtccggaaggggttaacggggcgttaggggtcggttcggggttcctacgtaacgttatacctaacttcccgtaggtacgtcggtacgttaaaggtttagtttaaaagtttaaaacgtttacggtacggtacccgggtaacccgtttcccggggtagggggtaaccgggggtaaccccgttaagtttacccgaacggtacccgttaaccgttaccccgttaaccggaaaacgggtaaaccggaaacccggggtaaaacccgggtaaaccgtaaaaggggttaaacgtttaaaccgtttacggtttaaacggtttaaaccggtttaaccggttaaacgggtaaaactttaacggaaaacccgttaaagttacggtaacgggtaaacgggtaacggttaaccgggaaacggttacggttaccgggttacgttacgtttaaccgttaatttaccgttaggtttttcggtttacggtttttaaccggaccggttttcgggttcccccggtttaccggggttaccccgggtttaccggggttaccggttttacccggggttaccgggggtaaccccggtaaaccggggttaaccccggttccgggg

SEQ ID NO: 163535 - DNA, 655 bp, Homo sapiens
  misc_feature: GYAE6OF01CAWQ6.47.55.E11.1.454.CMB.1.raw
  modified_base (295)..(295): a, c, t, g, unknown or other
  misc_feature (295)..(295): n is a, c, g, or t
  modified_base (301)..(301): a, c, t, g, unknown or other
  misc_feature (301)..(301): n is a, c, g, or t
  modified_base (312)..(312): a, c, t, g, unknown or other
  misc_feature (312)..(312): n is a, c, g, or t
  modified_base (318)..(318): a, c, t, g, unknown or other
  misc_feature (318)..(318): n is a, c, g, or t
  modified_base (327)..(327): a, c, t, g, unknown or other
  misc_feature (327)..(327): n is a, c, g, or t
  modified_base (487)..(487): a, c, t, g, unknown or other
  misc_feature (487)..(487): n is a, c, g, or t
  modified_base (550)..(550): a, c, t, g, unknown or other
  misc_feature (550)..(550): n is a, c, g, or t
  modified_base (584)..(584): a, c, t, g, unknown or other
  misc_feature (584)..(584): n is a, c, g, or t
  modified_base (619)..(619): a, c, t, g, unknown or other
  misc_feature (619)..(619): n is a, c, g, or t
tcagagctcacgtacacgaccggtgctcgatttagcactcgcacgttggggtttcgggggccgcagccctgggacttcccagctcgtttctgcttgctgatcaggactgcacacagagacgcttcgaccagtggagtcgtcgggctggtgccggttcggttttccgttcggttacggcgtttaacgttttaaaaggtgtaccgtgttgtgggaggtgtacgtagggtaaggtgggacgggtccgggggagtcgttagttcgaggtcgtcgggacgtccgtgtcgactctctggtntacgtntgtgtatcgtnttacgntcgtgtagngtacgcgtcgtcggacactaacggcgtaggggtacggtgtggtaggtcggtactacgtaccttaagtacgttacgcgttaagagtacgtagttagttagttaaagttaacttggacgaccggtacggttccggaggtaccgacgttcaggactcgtaacncgacgacggaactaagacgaagtagtacgtaagtctagtacgtagaaagtctaagaactgtangtagtacgacgtgactcgtagttcgtaattcgtnttaggtttagttgtacggtagtcccgttgtccggngtttaccgtcgtccggagtaccggtagtccgtacgg

SEQ ID NO: 163536 - DNA, 747 bp, Homo sapiens
  misc_feature: GYAE6OF01CJ1JF.47.55.E11.1.454.CMB.1.raw
  modified_base (188)..(188): a, c, t, g, unknown or other
  misc_feature (188)..(188): n is a, c, g, or t
  modified_base (209)..(209): a, c, t, g, unknown or other
  misc_feature (209)..(209): n is a, c, g, or t
  modified_base (227)..(227): a, c, t, g, unknown or other
  misc_feature (227)..(227): n is a, c, g, or t
  modified_base (230)..(230): a, c, t, g, unknown or other
  misc_feature (230)..(230): n is a, c, g, or t
tcagagctcacgtacacgaccggtgctcgatttagcactcgcacgttgggtttggggagcttcagctgtggtagagaagacaggattcaggacaatctccagcatggccgcttccctctcctcctcaccctcctcactcactgtgcagggttcttgggcccagttctgtgctgactcacgccaccctnacgcgtccgtcgggaccccgnagcgtcacatctctgtcngancagtcacatagtacgaatgaatatgtaatacgtacgacacgacaacgtcccaacggtaacccgacccctaaatccctactaattcctaaagtaaaccatacgactcgacggccgacccgtcggacgggtccctggtaccgtacttcttcgacgtcctaaccgtaaggtctcgggacctccgtcacgcccctacgtcggacctagttaccgacggtcgggtacccgtcccgggaccggtacggtacgttaggacggtacgtacgttaaagttttacgtttaacggttagggttaaggggttttacgggtacggggtacttaccggaacgtccgttacccggtagttaaccgttacggttaacccggttttaacggttcccgggttaacggaaccgggttaccgggtaacccggggtaaccgttaaccgggttaccccgtaacccggttacccggtttaacgggaccccgtaacccgggaacccggtaaccccggaaaccccgtaaccccgttaaccgg

SEQ ID NO: 163537 - DNA, 810 bp, Homo sapiens
  misc_feature: GYAE6OF01B0UCJ.47.55.E11.1.454.CMB.1.raw
  modified_base (234)..(234): a, c, t, g, unknown or other
  misc_feature (234)..(234): n is a, c, g, or t
  modified_base (337)..(337): a, c, t, g, unknown or other
  misc_feature (337)..(337): n is a, c, g, or t
tcagagctcacgtacacgaccggtgctcgatttagcactcgcacgttgggtttgggggagcttcagctgtggtagagaagacaggattcaggacaatctccagcatggccggcttccctctcctcctaaccctcctcactcactgtgcagggtcttgggcccagtctgtgctgactcagcccaccctcagcgtcgtcgggaccccgggcagacgtcaccatctcttgtctggancagctcaatatacggaaatgataatagtatactaggtaccagacaacgtcccaaccggaacccggacccccaaaactcctactactacctaataaacaactanatacgacggccggtccccgtcggtaaccggggtcccgttccgggaccgtaactttccgtccgtcggtaccttaccgaacggttccgtacgggtcccgtcccgtcctaccgccccgtaccccgtcggtaccctacgttaccgacgggttaccgggtcccggttccccggggaccccgggtacgggtacggttcgggaacgggtccggtttaggttaacgttttaacgttttaccggtttacgggtttagggtttaacgggggtttacgggtaaccggttaccgggtaccgtacccggtccgtttacgtaaccgggttcgttacccggtttaaccggtttccggttaccggggtcggttaaccgggtccggggtaaacccgttacgggtccccgtaacccgggttcccggtaaacggttaccggacccggtaaccccggaacccggtacccccctaaaccccgtccggttacccg

SEQ ID NO: 163538 - DNA, 310 bp, Homo sapiens
  misc_feature: GYAE6OF01A433U.47.55.E11.1.454.CMB.1.raw
  modified_base (252)..(252): a, c, t, g, unknown or other
  misc_feature (252)..(252): n is a, c, g, or t
  modified_base (254)..(254): a, c, t, g, unknown or other
  misc_feature (254)..(254): n is a, c, g, or t
  modified_base (257)..(257): a, c, t, g, unknown or other
  misc_feature (257)..(257): n is a, c, g, or t
  modified_base (259)..(310): a, c, t, g, unknown or other
  misc_feature (259)..(310): n is a, c, g, or t
tcagagctcacgtacacgaccggtgctcgatttagcactcgcacggttggggtttgggggggaagaggaagactgacggtccccccaggagttcaggtgctgaggaagagatggaggtggacgtgtcagcacccggctggggcctggtccctgggatgcaggctactctagggcacagccggccctgggctgcctaggtacaaggtacctacttcctacgtgagctcgtgagcgggctggcaggcgcatagntncanannnnnnnnnnnnnnnnnnnnnnnnnnnnnnnnnnnnnnnnnnnnnnnnnnnn

SEQ ID NO: 163539 - DNA, 698 bp, Homo sapiens
  misc_feature: GYAE6OF01E2KSQ.47.55.E11.1.454.CMB.1.raw
  modified_base (208)..(208): a, c, t, g, unknown or other
  misc_feature (208)..(208): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcacgccaccctcagcgtcgtcgggacccccggnacgaccgtcaccatctcttgttcgtggaagcagctaccaatatacggaaatgaataatgtatacgtaggtaccagacaacgtcccaaccggaacccgacccccaaactcctacactactaataaacatcgatcgacgtccggaccctcggacgggtccctcgggtcctattccgtcgtcggcctaccgaagttcgtcggccgtcctaccgacgcccctaccgtggaccctacgtaccgtagggtccgggcccgttacccgggccggaaggtacgtacgggacgggtcccttaagttacgtttaacgtttacgttcgggttagggttaacggggttgggacttccggacgtaccggtctacggtacttccggttaacccgttacggttccgttaccgggacgttaccgggtaacgggtacccgtaacggttcccgtaccggttacccgtacggtaccaccgtaccccggaacccgtaccccaacccgttcg

SEQ ID NO: 163540 - DNA, 739 bp, Homo sapiens
  misc_feature: GYAE6OF01B61WI.47.55.E11.1.454.CMB.1.raw
  modified_base (608)..(608): a, c, t, g, unknown or other
  misc_feature (608)..(608): n is a, c, g, or t
  modified_base (711)..(711): a, c, t, g, unknown or other
  misc_feature (711)..(711): n is a, c, g, or t
tcagagctcacgtacacgaccggtgctcgatttagcactcgcacgttgggtttggggccgcagccctgggattcccagctgtttctgcttgctgatcaggactgcacacagagagctcaccagtggagtcgtgggctgagtcgttggttttccttgttgtcttacgttttaaaggtgtcctagtgtgaggtgcgtaggtaggtggaggtccgggggtagtcgttagtcgacgccggtgggtacgtcccgtgacgtactccgtccgtgtagtacgtctacgtaggtaactcgttagtttaccgtacgttaccttcgtaggtatcgtaccgtaccggtccggtaccccgtaaccgtaaaccgtccggtaagggttaacgggtcgttagggtcggtcggtacctacgtacgttacgtacgttacgtaccgtcgtagtaggtacgtaaggtttacttaaagttaaagttacgtacggtaccggtaaccgttcggggtaggtaccgggtacctacgttacgacgtacctacgtccgtacgaacgaacgaacggtaacgactaagtaacgttatacgtagtacgttagaaacgtaagaacgtaactacgtacgnggtaacgtagtacgtacgtagtacgtctatacgtatcgttagttcgttacgttcgtacggttccggttcccggtcggtaccggtaccgttacgttacccgggnggtaacccggtaccggttacgttccggg

SEQ ID NO: 163541 - DNA, 811 bp, Homo sapiens
  misc_feature: GYAE6OF01CTHTB.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggttttccttgttgcttacttttaaaaggtgtccagtgtgaggtgcaggtagtggaggtccgggggagcttagttcagccgtggggatccctgagactctctgtgtagtctcgtggaatctagtttcagttaccttcgtggatgctacgtcgggtcccacctaaacgtccgagggtaacgggcttggtgtcgggtctacgacgttatactaatccgtgagtcggacttaaggttagtttaaattaaagtttagtcggtaccgggtaaccgtttcccgggtagggtaccgggggtacccgtagtttacccggacgtaccgtaccgttcccgtaaccccggaagggtaaaccggaaacccggaaaaccgggtaccgtaaaagggttaaacgtttaaccgttaaccgtttacggtttaaacgttaaccggtaaagggtaaaaccgttaacgaaaacgttaacgtacgttagggaaacggttaacggtaccggtaacggtaacgttaaccggtacgtttacgttaacttacgttacgtttacgtttttacggttttaccgacgttcccgggtttaccccggtttccggggttaccccgggtacgggtttacccgtttaccggggaccgggggtaccccgtaaaccgggggtaccccgttcggggttacccgg

SEQ ID NO: 163542 - DNA, 747 bp, Homo sapiens
  misc_feature: GYAE6OF01DA0EA.47.55.E11.1.454.CMB.1.raw
  modified_base (193)..(193): a, c, t, g, unknown or other
  misc_feature (193)..(193): n is a, c, g, or t
  modified_base (219)..(219): a, c, t, g, unknown or other
  misc_feature (219)..(219): n is a, c, g, or t
tcagagctcacgtacacgaccggtgctcgatttagcactcgcacgttgggtttggggagcttcagctggtggtagagaagacagaattcaaggacaatctccagcatggccgcttcccctctcctcctcaccctcctcactcactgtgcgagggtctcgggcccagtctgtgctgactcacgaccctaccctnaggccgttccgcgggaccccccgggnaggacgtacaccattcttacttgttctaggaagcacgtctaccgaaatacgtaacggaaatgtaaataatagtaatacgtacgtaacagactaaccgtacccgaacggaacccgaacccccaaactcctactaactactaataaccaagtcgaactcgacggcccgacccgtacggtacgggtcctacggaccgtattccgtcgtcggacctaccgaacgtcgtacggcctccctacgacgacccctaccgtacgacctacgtaccggtacggtaccgggtccccggtacccgggaacccggtaagggtacgtacggtaacggttacgttaaggtaacttttaaccgtttacgttagggttaggtttaaggggtacgggtacgtaccggacgtaccgtccgtacgtacgtcgttaccttacggttacgtccggtagtaccggtaaccggaaccggtaccgttacccgtaacccggttcgtaaccggtaccgaaacccgacccgaaacccggcccctaaaccccgtacg

SEQ ID NO: 163543 - DNA, 551 bp, Homo sapiens
  misc_feature: GYAE6OF01ASILI.47.55.E11.1.454.CMB.1.raw
  modified_base (363)..(363): a, c, t, g, unknown or other
  misc_feature (363)..(363): n is a, c, g, or t
  modified_base (406)..(406): a, c, t, g, unknown or other
  misc_feature (406)..(406): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggaggtccgggggaggcttagttcagccgtggggagtccctgagactctcctgtgtagtctctggaatcagtttcagtaccttctggatgcacgtcgggtccgaccaaacgtccgaggtagggctggtgtgggtctcgacgtatcaatctgatggcagtgttataaattntgcgacgtcgtgagggctatcagcatcctcagacgacaacggnaagtagtatactagtatcgtaggaatgaatatcgtagagagtcgaacgagtacgctgtactatctagttgttagtttcgagttcggtcccgtttcgggtccggtaccgggtactttccggaggggccctaacggggtcccgtggg

SEQ ID NO: 163544 - DNA, 573 bp, Homo sapiens
  misc_feature: GYAE6OF01EAHQ2.47.55.E11.1.454.CMB.1.raw
  modified_base (378)..(378): a, c, t, g, unknown or other
  misc_feature (378)..(378): n is a, c, g, or t
  modified_base (470)..(470): a, c, t, g, unknown or other
  misc_feature (470)..(470): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagccgtggggagtccctgagactctcctgtgtagtctcgtggaatcagtttcagtaccttctggatgcacgtcgggtcccgacccaaacgtccgagggtaaggggctgggtggtgggtctcgacgttatcaactccgtgagtggcagttgttaataaagttncggcggtactccgtaggacgggcctattcgagctatcctaccagacgacaacggacaaggtagtatagtgtaatctaggaaatgaactaatntagagagtcgaatagtacgctgtactatctattgttgtttcgattccgtccgtttcgggtccgacgggtacttcggtaggggtcccaaggggtacccgtcggg

SEQ ID NO: 163545 - DNA, 533 bp, Homo sapiens
  misc_feature: GYAE6OF01AYA3Q.47.55.E11.1.454.CMB.1.raw
  modified_base (282)..(282): a, c, t, g, unknown or other
  misc_feature (282)..(282): n is a, c, g, or t
  modified_base (393)..(393): a, c, t, g, unknown or other
  misc_feature (393)..(393): n is a, c, g, or t
  modified_base (398)..(398): a, c, t, g, unknown or other
  misc_feature (398)..(398): n is a, c, g, or t
  modified_base (445)..(445): a, c, t, g, unknown or other
  misc_feature (445)..(445): n is a, c, g, or t
  modified_base (514)..(514): a, c, t, g, unknown or other
  misc_feature (514)..(514): n is a, c, g, or t
  modified_base (517)..(518): a, c, t, g, unknown or other
  misc_feature (517)..(518): n is a, c, g, or t
  modified_base (520)..(522): a, c, t, g, unknown or other
  misc_feature (520)..(522): n is a, c, g, or t
  modified_base (525)..(533): a, c, t, g, unknown or other
  misc_feature (525)..(533): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtgggaggtccgggggaggtcttagttcagccgtggggacgtccctgagactctcctgtgtagtctctggaatctagtttcagttaccttntggatgcacgtcgggtccaccaaactccgaagggtaacggggccaacgggtacctggtcacgtcgtctcctcacgcctaccaccgaacggcctacgtcgtcccttccccgnggccnccctgcctccgacggcgacacctccgagacgcgacgcggccgcccgnggcctcgcctggtacaacggtcctacttccacgtgcgctcgagcggcgggtctacggcacggcagatgncgnngnnngcnnnnnnnnn

SEQ ID NO: 163546 - DNA, 588 bp, Homo sapiens
  misc_feature: GYAE6OF01D4HZY.47.55.E11.1.454.CMB.1.raw
  modified_base (562)..(562): a, c, t, g, unknown or other
  misc_feature (562)..(562): n is a, c, g, or t
  modified_base (565)..(565): a, c, t, g, unknown or other
  misc_feature (565)..(565): n is a, c, g, or t
  modified_base (568)..(568): a, c, t, g, unknown or other
  misc_feature (568)..(568): n is a, c, g, or t
  modified_base (579)..(581): a, c, t, g, unknown or other
  misc_feature (579)..(581): n is a, c, g, or t
  modified_base (583)..(584): a, c, t, g, unknown or other
  misc_feature (583)..(584): n is a, c, g, or t
  modified_base (586)..(586): a, c, t, g, unknown or other
  misc_feature (586)..(586): n is a, c, g, or t
  modified_base (588)..(588): a, c, t, g, unknown or other
  misc_feature (588)..(588): n is a, c, g, or t
tcagagctcacgtacacgaccggtgctcgatttagcactcgcacgttgggtcttgggcccagtctgtgctgactcagccaccctcagcgtctcgggacccccgggcagacggtcaccatctcttgttctggaagcagctccaatatcggaaatgataatgtatactggtaccagcaagtcccacgaaccggccccaaactcctcatctataacaatgatcagcggccctcgacggggtccctggccgtattctctggctaccaagtctggccgcctcacgcccaccgtggccagtcaggtcgggccgtccggccgaggatggaggctgatttattacgtggttgtagggttggactcgcgacgctgactgtacctttacggtcttcgggacgtcgtcgggaaccaggtccaccggtcgtaggtccaacggccccaaacgggccccaaaccctcgttcgtacctaccgttccgtccgtttccccccgcccttcccgtacgtacggtgaccgtcttcgacggacgggtccgggtctcgggaaccgacgggtccacgtaagtcgntcngtnacgtgactgannnanngngn

SEQ ID NO: 163547 - DNA, 578 bp, Homo sapiens
  misc_feature: GYAE6OF01EBPEF.47.55.E11.1.454.CMB.1.raw
  modified_base (188)..(188): a, c, t, g, unknown or other
  misc_feature (188)..(188): n is a, c, g, or t
  modified_base (208)..(208): a, c, t, g, unknown or other
  misc_feature (208)..(208): n is a, c, g, or t
  modified_base (233)..(233): a, c, t, g, unknown or other
  misc_feature (233)..(233): n is a, c, g, or t
  modified_base (366)..(366): a, c, t, g, unknown or other
  misc_feature (366)..(366): n is a, c, g, or t
  modified_base (381)..(381): a, c, t, g, unknown or other
  misc_feature (381)..(381): n is a, c, g, or t
  modified_base (386)..(386): a, c, t, g, unknown or other
  misc_feature (386)..(386): n is a, c, g, or t
  modified_base (432)..(432): a, c, t, g, unknown or other
  misc_feature (432)..(432): n is a, c, g, or t
  modified_base (464)..(464): a, c, t, g, unknown or other
  misc_feature (464)..(464): n is a, c, g, or t
tcagagctcacgtacacgaccggtgctcgatttagcactcgcacgttgggtttggggagcttcagctgtggtagagaagacaggattcaggacaatctccagcatggcccggcttccctctcctcctcaccctcctcactcactgtgcagggtcttgggcccagtctgtgctgactcagcccaccctnagcgtctcgggacccccggnagacgtcacatctcttgtctggaancagctaccaatactacggaaatgaataatgtaatacgtggtaaccagacaacgtccccaacgaaaccggacccccaaacctcctacaatctaataaacaatgatcagccgccctgacgggtcctggccattcnctggctacgagtcgnggccncctcacgcccacctcggccactcagtcggcgtccggcccggaggangagctgattattctgtgtaggttggactcggnacgcgtgtctgtccttaacggtcgttacggacgtacgtcggggtaacaacgggttcccaacccggttccgtaacggtaccgaccgaccccgaaacggccccaaaccccgtacgg

SEQ ID NO: 163548 - DNA, 783 bp, Homo sapiens
  misc_feature: GYAE6OF01CWV6J.47.55.E11.1.454.CMB.1.raw
  modified_base (254)..(254): a, c, t, g, unknown or other
  misc_feature (254)..(254): n is a, c, g, or t
tcagagctcacgtacacgaccggtgctcgatttagcactcgcacgttggggtttgggggccgcagccctgggattcccagctgtttctgcttgctgatcaggactgcacacagagagctcaccatggagtctgggctgagctgggttttcctgttgcttacttttaaaggtgtccagtgtgaggtgcaggtagtggaggtccgggggagtcttagttcagccgtggggactcctgagactctctgtgtagtctntgaatcgagtttcagttaccttcgtaggatgcgtacgtcgggtacccgacctaaaccgtccgtaagggtaggggctgggtgtgggtactcgacgtatcatcgtgactggctaggtatttaataaatttagtggaccggtaccgttccgggtagggacggggtacccgtagttccgaagtacctacgtaccgtacccgaaggaacgaaaccggtaaacggactaaacggtaagtaactttacgttaagtagttaccgtaaaggtaaaactacgaaaccgttaagtacgtaggtaaacgggtaacgttaaccggggaacttaaccggttacgggtaccttaggttaactttaacgttccttaaggtttttccggtttaccgggtttttaacggtaccgtttacccgggttttcccccggttttacccccggggggttacccggtttaccccggggggttaacccgttttacccgggggtacccgggggggtaaccccttaaaacccgggggggtaacccccgtttcggggg

SEQ ID NO: 163549 - DNA, 700 bp, Homo sapiens
  misc_feature: GYAE6OF01BTF2J.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggttttccttgttgcttacttttaaaaggtgtccagtgtgaggtgcgaggtagtggaggtccgggggagcttagtcagccgtggggatccctgagactctcctgtgtagtctcgtggaatctagtttcagttaccttcgtggatgcacgtgggtcccacctaaactccgaaggggtaagggtctgggttgtgggtctcacgtatctaatccgtagactggactaggttagttaacttaaatttagcgacggtactccgggtaggacggggtcctaagtcgaagtctactcgtaccgaaggtaacgaaccgaaacggtacaaaggtagttaactaagttacgtaataaccgttaaggtaaatacggtaaaactaagtacgttaggaagtaacggtaccggtaacgtaacggtaaacggtccgttagtaacgtatacgttagttttacggttacggttttacgagtttaccggtcccggtttcccgggttaccccggggacggtttacccgttccgggttacgggggtaccccgtaaaggggggttacccccgtagggg

SEQ ID NO: 163550 - DNA, 698 bp, Homo sapiens
  misc_feature: GYAE6OF01A3CBD.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggttttccttgttgcttacttttaaaaggtgtccagtgtggaggtgcaggtagtggaggtccgggggaggtcttagttcagccgtggggacgtccctgagacctctccgtgtgtacgtctctggaatctagtttcacgttaccttcgtggatgctacgtcgggtacccgaccaaacgtccggaagggtaaggggtcgttgggtggttgggttctacgtaacgttctactaacttccgtagtacgtcggacgtaggttagtttaaattaaagtttacgtaggtaccggtacgtaccgggtacgggacgggggtaccgtacgttacgacgacctacgtccgtaccgtaacggaacggaacccgaaacgggacgtaaaggtaacgtttaacgttacgttacggttaagttacgtaagggaaacttaacgaactaagttcgtaggaacggtagtacgtaacgagttacggtcttagtcctatcgttatttagttcgtttctagttcgtcccgttcgggtccggtcggtaccgtcggtacgggaccgtacgggccggtcg

SEQ ID NO: 163551 - DNA, 819 bp, Homo sapiens
  misc_feature: GYAE6OF01COT1Q.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtcgtgggctgagtcgttgggttttccttgttgtcttacgttttaaaggtgtcctagtgtggtaggtgcgtagggtaggtgggagggtccgggggtaggtcttagttcgagtccggtggggtacctcccgtgacgtactccttcgtgtgtacgtctcgtaggacttcttacgtttcgacgttaccttgtggtatcgaccgtacggtcggtacccaaccgtaacgtcggaggggtacggcgttgggtggttcggttctacgacgttactactacgttcgtagtaacggtcggtacgtaggtttaacgtttaaattaaacggttgtcgggtacccggttaccggttacggggtacgggtaaccggggtaccgtaacgttacggacgtactaccgttaccgtacgaacggtaaccgaaccggtaaacggacgtaaggtaacggttaattacgttaacgggtaacttacggtaaacggtaacttaaaggaaactaacgggtttcgaaggtaacggttacggtaacgtacgggttaacgttaccggtacgttcgttaacgtagttcgtttaaacgttttcggttacggttttacgtcggtttccgggttcccgggttacccgggttacccggtttaccggggttaccgttccggggtaccggggaaccggttacccgggggtaacccgttaccgggg

SEQ ID NO: 163552 - DNA, 844 bp, Homo sapiens
  misc_feature: GYAE6OF01EKG0G.47.55.E11.1.454.CMB.1.raw
tcagagctcacgtacacgaccggtgctcgatttagcactcgcacggtttgggtttggggagccgcagccctgggattcccagctgttctgcttgctgatcaggactgcacacagagagctacaccagtggagtcgtggctggagtcgtttcggttttccttgttcgtacgtttacgttttaaaaggtcgtcgagttggtggtaggtgacgtagggtaggtgggtacgggtccgggggagttacgttaggttccgacggtccgggtggggtaccgttccgtaggtaccgtaccgttccgtccgttggttacgttaccgttcgttcgtagtaacttcgttacgtttacgtaccgttaccttcggtaggtacgtcgtccgtacggtccggtacccgtaaccgtaaaccgtaccgggtaggggttaaccgggtggttacgggttcggtaccgggttaccgttaccgtaaccggttactacccgtaacgttccggtaggtacgtacggtacgttagttacgtttaaattaacgttcgtacggtaccggtacgttaccgggtacgggtaccggtacgttcgtaccgactaccgttacctaccgtaacgtaaggaacccgaacggaaacggtactaaacggttaacgttacgttaccgtaagttacgtacgttaaaggaacttaacgaacttgtaacgtaacgggacgttaccggtaacgtacgtacgttacggtcttacgttaacctgtttaccgtagttttcggtttaccgttcgtacgttccggtttcccggttaccgggccggtttccgttaccgggtaccgtaccgggttccgtacggggttcccg

SEQ ID NO: 163553 - DNA, 868 bp, Homo sapiens
  misc_feature: GYAE6OF01CBCT7.47.55.E11.1.454.CMB.1.raw
  modified_base (706)..(706): a, c, t, g, unknown or other
  misc_feature (706)..(706): n is a, c, g, or t
tcagagctcacgtacacgaccggtgctcgatttagcactcgcacgttgggtttgggggccgcagccctgggattcccagctgtttctgcttgctgatcaggactgcacacagagagctcaccagtggagtctgggctgagtcttggttttctttgttgtcttacgttttaaaggtgtccagtgtgaggtgcaggtagtggacggtccggggagtcgttagttcgacggtccgtaggggacgtcccgtgacgtaccttccgtccgttgtgtacgttcgttacgtaggtaacttcgttagtttccgtacgttaccgttcgtaggtatccggacgtaccggttcgggtccccgtaaccgtaaaccggtccggtaaacggggttacggggtccgttggggttccggttacgggtacccgttaccgtaacgttagtaccctaaacgttccgtagtacgtacggtacgtagtttaacggtttaaattaaaggtttcgtacggtaccggtaccgttacgggttacgggaccggggttacctacgttacgacggtccttacgtaccgtaaccgaagggttaaccaaccgggaaccggtaagtaaacgggaactttaacgttccgttaaacggttattaaaccggttagtaaaacgtacgtaaacttacgtacgtaacggtaacggtacggtaccgtaaggtacgttaacccggngtttcgttaacgtacgtttacggttacggttttggttacccggtttactaccgggttacccgttttcccccggggtttacgggtaccccggggttaacccggtttcgggtttacgggaccccccgggggttaacgtccccggggttttaaaccgtcccgggg

SEQ ID NO: 163554 - DNA, 885 bp, Homo sapiens
  misc_feature: GYAE6OF01BA1LG.47.55.E11.1.454.CMB.1.raw
  modified_base (551)..(551): a, c, t, g, unknown or other
  misc_feature (551)..(551): n is a, c, g, or t
tcagagctcacgtacacgaccggtgctcgatttagcactcgcacgttgggtttgggggaagaggaagactgacggtcctgccacaggtggtgcgtgggcacggtgggcactcgacaacaactatttgcgctctaactgtcttgctcacagtggagtcgtggctgagtcgtttcgggtttttcttgttcgtacttaacgttttaaaggtcgtaccgtaggttggtggtaggtggtacggtagggttagggtggggtaccggggtccgggggtaagttcgtttaggtaccgtacggtccgggtacggggtccgttaccgtaggtaacgtccgttcgttccgtggttcgttacgttcgtaacgtacgtaacttcgttacgtttaccgttacgttaccgttcggaggttacgtaccggtacccgtaccgggttacccggtaccgtaaacccggtaacggggttaccggtaagggggtacgggtttcggtgggttccgggttacgtaaccgttacgtaacgttaacctacgtaccgttacggtgtaacgttaggtntaaagttttaactaaacgttagtcggtaacccgggtccgtacgggtaccggtagggtaaccgtctaaccgtacgaccgttacgtacctaaacccgggtaacggaaaggttacccgaaagtaacgggaaataacggtttagtaccgttaaattacccgggtaattaaacggaacaaggttaaccgaacgtttaggcgggttaaacgtaccgggttagtaaccgtaggttaacctccggtttattaaacttcggtttattacggttaacgttttccgtaggtttcgccccggggtttaccgttaggtacccgggggttcgtaaccgggttcccggg

SEQ ID NO: 163555 - DNA, 661 bp, Homo sapiens
  misc_feature: GYAE6OF01DT7E4.47.55.E11.1.454.CMB.1.raw
  modified_base (180)..(180): a, c, t, g, unknown or other
  misc_feature (180)..(180): n is a, c, g, or t
  modified_base (351)..(351): a, c, t, g, unknown or other
  misc_feature (351)..(351): n is a, c, g, or t
  modified_base (378)..(378): a, c, t, g, unknown or other
  misc_feature (378)..(378): n is a, c, g, or t
  modified_base (407)..(407): a, c, t, g, unknown or other
  misc_feature (407)..(407): n is a, c, g, or t
  modified_base (415)..(415): a, c, t, g, unknown or other
  misc_feature (415)..(415): n is a, c, g, or t
  modified_base (437)..(437): a, c, t, g, unknown or other
  misc_feature (437)..(437): n is a, c, g, or t
  modified_base (457)..(457): a, c, t, g, unknown or other
  misc_feature (457)..(457): n is a, c, g, or t
  modified_base (471)..(471): a, c, t, g, unknown or other
  misc_feature (471)..(471): n is a, c, g, or t
tcagagctcacgtacacgaccggtgctcgatttagcactcgcacggttggggtttgggggagcttcagctggtggtagagaagacaggattcaggacaatctccagcagtggccgcttccctcctcctcctcaccctcctcacctcactgtgccgtagggtcgttcgggccagtctgtgntcactccacgccctacctcacggcgtaccgccggggaccccggacgcggacgtccaactacttctcttgttcgaggaacgctagctaccgaataacgacggtaaatgtaataatacggtatacgttacggacaagacgaccgtacccaacggaccccgaacctaaactccnctaacattaacaaagaatcgaactcgnggaccggcctacgggcggttccgaacggnactttcgngtccggctaaccagtcgcgccnctacgcaccgacctcgctancgtacgcggtaccnccggtacggacggaagtcggagtaccgttaagttaccgttagtacgtttgggtggtaacggtcgggtaacgtcgacgtaaccgtcgtaccgtaagtcgttaccgtcgtacggtcggtacgtacggtccggtaacgacccggtttacgccctagtaccggtcaaccggtacccacccgacgaacccgtacg

SEQ ID NO: 163556 - DNA, 759 bp, Homo sapiens
  misc_feature: GYAE6OF01DYNVH.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggttttccttgttgtcttacttttaaaaggtgtccagtgtgaggtgcgaggtagtggaggtccgggggaggtcttagttcgagccgtggggacgtccctgacgtactctcctgtgtagtctgtggtaatctagtttcagttaccttctggtatgcacgtcggtcccaccaacgtccgagggtagggtcgtggtggtggtctctacgtatactaatccgtgtagtgacgtagttagttaacttaaagttgtacggtacggtaccgttccggtagggtacggggtaccgtacgtttacgaacggtcctaacgtacccgtacccgaaaggtaccgaaaaacccggtaaccgggtactaaaagggttacgttaaccgttaaccggttaggtttaaaccgtacgggttaaagggtaaaacttacgggtaaaacctagttcggtaaggaacgggtaccgttacggaaaccgttagttaccggctttacggtaccttagttacgttacgtttcggttttcggtttaacgtacggttcccggttccccggttttaccggggtcccgtaacggggtttcccttacggggtacccggggtacccgtaaacggggtcccgttacggg

SEQ ID NO: 163557 - DNA, 764 bp, Homo sapiens
  misc_feature: GYAE6OF01BH9QK.47.55.E11.1.454.CMB.1.raw
  modified_base (321)..(321): a, c, t, g, unknown or other
  misc_feature (321)..(321): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtcgtggctgagtcgttgggttttccttgttcgtcttacgttttaaaaggtcgtacagtgtggaggtgcgaggtaggtgggacgggtccggggaggtcgttagtcgacgtcggtggggacgtccgtgacgtactccgtcgtgtgtacgtctacgtaggtaacttcgtacgtttacgtagttaccttagtaggtntacgcgtaccgtacgggtaccctaaccgtaaacgtacgggtaacgggtaaggtccggtggttcggtcggtaccgtaccgtaaggtactaaccgtacttacgtagtaggtcggtacgttaagtttaagttaaattaagttagtcggtaccgtacggtaccgggttacgggacgggtaccgttaacgtcgtactcgtaactccgtaacggaagaacggtaacggaaccgagtaaacggttagttaaagtacgtaagttaagtaacgttaaaggaaacgtacgtaaataccgttagtaaccggtaaggtaacgtacggtaaggtacgttacgtcgttacagttactaggttgtttaggtttacgttacgtacgttccgttccggttccgggttacccggtacgggttccgttacgggtaggggaccccttaacgggaccgttacgg

SEQ ID NO: 163558 - DNA, 826 bp, Homo sapiens
  misc_feature: GYAE6OF01A06HL.47.55.E11.1.454.CMB.1.raw
  modified_base (178)..(178): a, c, t, g, unknown or other
  misc_feature (178)..(178): n is a, c, g, or t
  modified_base (650)..(650): a, c, t, g, unknown or other
  misc_feature (650)..(650): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagtcgttgggttttccttgttgtacttacgttttaaaggtntcgtaggtgtgaggtgcgtagggtagtgggacgggtcgggggagtcgttagttcaggcgtgggctcctgacgctctctgtgtactctgtagatctagtttcagttaccttgtagatcgactacggtcgggtacccaacgtaacgtcggagggttacgggtcgttggtcggtcggtcctacgtacgttatacgtaacttccgtggtacgtcggacttaaggtttagtttaaactaaagtttcgacggtaccggtacggttcggtagggtacgggtacctaacgttcgacgtctactaccgtacggaacgtaacgtaacggaacggtacgtaagtaagtttacgttaaccgttaggttaactaccggttaaaagtaacgttaacggttaaactaacggttcggtaacgagggttaaacccggtaacgtaacggttaaccgtccgggtttaagttacggttacttaaccggtttntttaacggggtttttacggttttacccggtttaaggtccccggtttttccccggggttacccggggtttaccccgggggtttaacccggggtaccccgggggtttttaccgttacccgggggggtaacccggggtaaccccccggggttaaaggggtttcccccggggttaacggg

SEQ ID NO: 163559 - DNA, 842 bp, Homo sapiens
  misc_feature: GYAE6OF01CMDU6.47.55.E11.1.454.CMB.1.raw
  modified_base (215)..(215): a, c, t, g, unknown or other
  misc_feature (215)..(215): n is a, c, g, or t
  modified_base (260)..(260): a, c, t, g, unknown or other
  misc_feature (260)..(260): n is a, c, g, or t
tcagagctcacgtacacgaccggtgctcgatttagcactcgcacgttggggtttggggagcttcagctgtggtagagaagacaggattcaggacaatctccagcatggccggcttccctctcctcctcaccctcctcactcactgtgcgagggtcttcgggcccagtctgtgctgactcacgccaccctcagccgtcggtccggggacccccggnacggaccggtccaacctattccgttcgtttcgttcgtagggaacnccgacgcctaacctaagtacgtaacggtaaatagtaattaagtgttaactacgtacggtaccagacgtaaccgtcccgaaaccggaacccgtacccctaactcactaatactaactaacatgacgtcgacgaccgtcccgtacggtaccgggtccgtcggtaccgtacttccgtcggtacgcctaccgtagttcggcggtccgtacctccgaccgtccccgaccgacggtcctaacgtccgggtaacggggttcccgggacccgttaccccggggaccggtaacgggtacggtacggggtaaccgttcggtaaacgtttaccgtttaacggttttccgggtaggggttttaacggggttacggggtttaccgggtaccgttaccggtaccggttaaccggtccggttaacgttccggttaccggttaaccggtttccgggtttaccggtaccggggtccggtaaccggggttaacccgggtacccggttaaacccgggtccccgtttaaccggtacggttaccccgggaacccgtacccggtaaccccgggaaccccggtacccccgttaaacccggttccg

SEQ ID NO: 163560 - DNA, 894 bp, Homo sapiens
  misc_feature: GYAE6OF01C2NV8.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtcgtgggctgagtcgttggggtttttccttggttgtaccttacgttttaaaagggtgtacctagtgtggaggtgcgaaggtaggtggacggtccgggggagtcgttagttcgagccgtggggactccaggacgactctccgtgtggtacgtctcgtaggtaactcgtagtttaccacgttaccttgtagagtcgacctcggtacgggtaccccgaccgtaaaccgtaccggtaaggggtaacggggcgtttagggtgggttcggttactaccgtacgttaacaccgtaacgttccgtaggaggttcggacgttaggttaaagttttaaagtaaactttcggttacgggacccggtaacggttaccgggtaggggtaacggggttacccgtaaattccgggtaacggcctttaaccttaccccggacggtaaaacgggtaaaccggaaacccgggaaaacggtaaccggtaaaaggttaacggtttaaccttaaccggtttaggtttaaccggttaaaggtaaagggttaaaaccgggtaaacaaaacggtttaacgtttacgggtaaaacggtaacgggtaaaccgttaccgggtaaacgttaaccgggttacgttaccggttacgtaactttacgttacgtaggtttttacggttcggttttaaacgtcggttacccggtttcccgggttacccgggttccgggtacccggttaccgggtttacccgggacggggtaaccccggtaacggggttcccgtacgggg

SEQ ID NO: 163561 - DNA, 696 bp, Homo sapiens
  misc_feature: GYAE6OF01EEE5Q.47.55.E11.1.454.CMB.1.raw
  modified_base (518)..(518): a, c, t, g, unknown or other
  misc_feature (518)..(518): n is a, c, g, or t
tcagagctcacgtacacgaccggtgctcgatttagcactcgcacgttgggtttggggccgcagccctggattcccagctgttctgcttgctgatcaggactgcacacagagagctcaccagtggagtcgtgggctgacgtcgttgggttttccttggttcgtacttacgttttaaaaggtcgtaccgagttgtggtaggtgcgtaggtacgtggacggtccggggagtcgttacgttcgagtccgtgggacgtccgtgacgtactctcgtgtgtagtctacgtggtaactcgtacgttacgtacgttccgttcgtgtactcgccgtacggtcggtaccgtaaccgtaacgtacggtaaggtacgggtcgtcgggtggtcggtcgtactacgtactacacttccgtgtagtcgtgtaacgttagttaaacttaaagtcgtcggtacgtacgtcggtacgggacggtacgtagtcgtaccgactaacgtccgtaacggaacgtaacggaccgtaaacggntaaaacgtgtttaaccttagttacgtacgtaacgtaaagtaacttaacggaacttagtcgaaggtaccgtaaccggtagtccgtaaacgtcgttcctaaagtctaagttagttttgtttaacgtcgaagttcccgttcggcggtcggacgttctcgggacgtcggaactccgtgtccg

SEQ ID NO: 163562 - DNA, 782 bp, Homo sapiens
  misc_feature: GYAE6OF01CACG0.47.55.E11.1.454.CMB.1.raw
  modified_base (646)..(646): a, c, t, g, unknown or other
  misc_feature (646)..(646): n is a, c, g, or t
  modified_base (669)..(669): a, c, t, g, unknown or other
  misc_feature (669)..(669): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtcgtgggctgagcttgggttttccttgttgcttacttttaaaaggtgtccagtgtgaggtgcgaggtaggtgggacggtccgggggaggtcttagttcgacggtccggtggggacgtcccgtgacgtacctcctcctgtcgtacgtctcgtaggaatctagttcacgttaccttcgtggtactcgtctaccggtccgggtacccgaaccgtaaacgtccggtaagggtaacggggcgttacgggtggtcggttctacgtacgtaactacctaacgtccgtagtagtacggtacgttaaggttaatttaaagttaaagtttacggtcggtaccggttaccgtccgggtacggggtaccgggtaccgttaacttacgacgtacctacgttaccgtacccgaaagacggtaaaccgaaggtaactaaaacggtagttaaccgttagtttacggttaacgttaccggtaaaaggaaaacttacgaaacctaagttcgtaaggaacgtccggtaaccgggtanaaccggttcgtacttgttaactnttacgttaggttttcggttaactttggtaacttcccggttcccgggttaccggttcccgggacggtttacccggttcggggaccgggaacccgttaaccgggtcccgtacggg

SEQ ID NO: 163563 - DNA, 765 bp, Homo sapiens
  misc_feature: GYAE6OF01B6N4W.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtcgtgggctgagtcgttgggtttttccttgttgcttacgttttaaaaggtgtccagtgtgaggtgcgtaggtaggtgggacggtccgggggagtctttagttcgacggtccgtggggtacctcccgtagacgtaccttccgtccgtggttgtagttccgtacgtaggtaattcgtagtttacacgttaccttcgtggatgcctacggtcggtaccccacctaaacgtccggaagggttacgggtcgttaggtggtcggtcctacgtaacgtactactacgtccgtagtagtggtacttaggttagtttaaagttaaacgttgtcgggtaccgtaccggtccggggtacgggacgggtaccttagtaccgaacgtcctaacgtcccgtaacggaaggtaaccgaaaccgtaacggaacgtaagtaacggttaacttacgtagttacgtagtaagaactacgtaatacgttagaggtaacggtacggtaccgtaacggtaacgttcggtctacgttacttagttacgtttaggtttcgtttacgtttcggagtttaccccggtcccgggtttaccgggccccggttaggtttcccggttaccggggtaaccgggtaccgtacccgggtcccgttacggg

SEQ ID NO: 163564 - DNA, 812 bp, Homo sapiens
  misc_feature: GYAE6OF01CP3PT.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcacagtggagtcgtgggctgagtcttgggttttccttgtgtacttacttttaaaaggtgtccagtgtgtaggtgcgaggtaggtggaggtccggggagtcttagttcagccgtggggactccgtagagactcgtcctgtgtagtctcgtaggtatctaagtttcacgttaccttgtagacgtgacgacgtcggtccgaaccctaaacgtccgtaagggtacgggcgtggtggtcgggttactacgtaccgtataccaagttccgtagtagtacggtagttaagttaaggtttaaactaaaggttacgtacggtacccggaccggtttaccggggtacggaccggggtacttaacgtacgaccgtacttaccgtcccgtaaccgaaggtaacgtaaaaccggaaacgtaaagtaaaacgttacgtaaaccttagggttaaccgttagtaaaggtaaagttaaacgtaaacgtaaaaccgtagtacggtaacggaaccgttaagggaaacccgttaacgggtaagtaacccgggtttacttaacgtttaaccggtaacctttaggttaaaccgttttggggtttaacgttcggttaaccggtttccccgtccgggttttaacccggggcggtttacccgggtttaggtacccgggggtaccgggtaaaccccgggttaaccgggaccttacggggg

SEQ ID NO: 163565 - DNA, 693 bp, Homo sapiens
  misc_feature: GYAE6OF01EQIGZ.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccagtggagtcgtgggctgagtcgttgggtttttccttgttgtcttacgttttaaaaggtgtccaggttgtggtaggtgcgtaggtaggtggaggtccgggggagtcttagtcgagccgtgggacgtcctaggacgtactctcgtgtgtagtctgtgaatctagttctacgtacttgtggatgctacgtcggtccgactaaccgtcggaggtaagggtcgtggtacggtcggtcctcgtacgtactacgtaacttccgtagtacgtgtacctaaggtttaagttaagttaaagtttacggtcggacggttaccgttcggggtagggtaaccgggccgttaagtcgtaacgtctacgtccgtaccgaagtaacgaaccaaggactaaagagtttaacgacttggtaacgtacgttaagaaagtacgaaactagtaccgtaaggaacgtacgtaggtaacgacgttacgtcgttacgtactagtcgttagtttggtttcggttctagttccggttccgttaccgggtccgtacgggttaccgttcggtacgggaccccgtacggtaccgttccgg

SEQ ID NO: 163566 - DNA, 714 bp, Homo sapiens
  misc_feature: GYAE6OF01AVR25.47.55.E11.1.454.CMB.1.raw
tcagagctcacgtacacgaccggtgctcgatttagcactcgcacgttgggttttccttgttgctcttttaaaaggtgtccagtgtgaggtgcaggtagtggagtccggggaggcttagttcagcctggggagtccctgagactctcctgtgtagtctctggaatcagtttcagtaccttctggactggcacgtgggtccaccaaactccgaggtaagggctggtgtggtctcacgtatcaactcctgactggctagtgttaataaacttatggacggactccggtggacggggccgtattcgagtcatcctcagagtaacgacggtacaagagtatacgtgtatctaggtaaatgaaactactcgtagacgtagtacgagacgtacggctgtactatctattcggttgttttcgagttccgtaccgtttccgggtccggtcgggtacttccgggtacgggtaccgaacggggttaaccctgggtaccgacggtcccgttccctaccgttcacccgtcccgtaacccaacccgggtaacccggcccctaacgtccccggttccccgttacccccggtcgggcccctccccggtccgcccgttacccgagggaacccgccccgtaacccgtaccgggacgaccgacccgtaccgaccgggcccgggaccccgttgggggtaccctccgggccggtagggtaccccgtaaacccggg

SEQ ID NO: 163567 - DNA, 895 bp, Homo sapiens
  misc_feature: GYAE6OF01B021U.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccagtggagtcgtggctgagtcgttgggttttccttgttgtacttacgttttaaaggtgtccgtagtgtggaggtgcgtagggtaggtgggacgggtccgggggaggtcgttaggttcgacggtccggtaggggtacgtcccgtgacgtactcctccgttgtgtagtctcgtaggtaattcgttagtttcgtaacgtttaccgttgtaggtacgtcgaccgtaccggttccgggtaccccgacccgtaaaccggtccgggtaaggggttaacggggtcgttagggttcgggttcgggttacctaccggttaacgttacgttaaccttaacgttccgtaggtacgttacggacgtttaaggtttaagttttaaaacgttaaaggtttacgtacgggttacccgggttaccggttacccgggtaggggtaccgggttaccgtaacggtttaccgacggtcctacgtaccgtaaccggaagtaacgaacccggtaaacggaaactaagggtaagttacgttaacgtaggtttaataacggtaacgtaaagttaacgaaacttaacgttcggtaacggaacgggttaacgaccggtaaccggtaacgttaccggtattacggttaacttacgttaacgtttaggttttcggttttaccggttttacggtaccctttcccggggttacccgttccccgggggttacccgggttaccgggtttacccggttaccggggtaacccgggtaccgggttaaacccggggttacccgttacgggg

SEQ ID NO: 163568 - DNA, 618 bp, Homo sapiens
  misc_feature: GYAE6OF01A76PY.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggttttccttgttgctacttttaaaaggtgtccagtgtgaggtgcaggtagtggaggtccgggggaggtcttagttcagcgtggggacgtcctgagactctcctgtgtagtctctggaatcagtttcagtaccttcgtggatgactacgtcgggtccgacctaaactccgaagggtagggcgtggtgtggtctcgtacgtatacaactcgtagatggctagttagttaataaacttagtcggtacggtacgtcggtacggacgggtacgtagttacgagactacgttcctaccgaaggacgaaccgaaacggtacgtaaagtagttaactacgttagtaactacgtaaggtaaactagaaactaagtcgtagaacgtagtacgaagtagtacgtcgtagtctagtcttagttgttagttcgagttcgtcccgttcggcggacggtacttcggagggacccgtagggcccttcggg

SEQ ID NO: 163569 - DNA, 699 bp, Homo sapiens
  misc_feature: GYAE6OF01A76JB.47.55.E11.1.454.CMB.1.raw
  modified_base (187)..(187): a, c, t, g, unknown or other
  misc_feature (187)..(187): n is a, c, g, or t
  modified_base (210)..(210): a, c, t, g, unknown or other
  misc_feature (210)..(210): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagcccaccctnacgcgtcgtcggggacccccggnacggacggtcaccatctcttgtctggaagcacgtctaccaatagtacggaaatgaataatgtatactggtaccagacaacgtcccaacggaacccgaccccctaaactcctacactactaataacatgatcacgccgtcctaggacgggtcctggccgtattcgtcgtcggtctaccgtaagtccgtcggccgtccctacgaccgtcccctaacccgtcggaccctaacgtccgacgggtccgggcccgtaccccgggacccggtaaggtacgtcgggacggtccgttagtaactttacgtacgttaggtacggttaggggtcggtactccgacggtacgtccctaggtaccttcggtaccgtttacggtcgttacggggtaacctcggggtaaccgggtaaccgtaaccggggttccaacccccgggttggttacggtaccccgtaaccgaaccccggtaaccggtaaccccctaacccgttaaccgg

SEQ ID NO: 163570 - DNA, 785 bp, Homo sapiens
  misc_feature: GYAE6OF01DCUDY.47.55.E11.1.454.CMB.1.raw
  modified_base (221)..(221): a, c, t, g, unknown or other
  misc_feature (221)..(221): n is a, c, g, or t
  modified_base (572)..(572): a, c, t, g, unknown or other
  misc_feature (572)..(572): n is a, c, g, or t
tcagagctcacgtacacgaccggtgctcgatttagcactcgcacgttgggtttggggagcttcagctgtggtagagaagacaggattcaggacaatctacagcatggccgtcttccctctcctcctcaccctcctcactcactgtcgcgagggttcttcgggcccaggtctgtcgctacgactcacgccaccctgacgtcgtccgtccggggacccccggnaacggaccggtacaccacgttccttcgtttacgttcgtagggacacacgtcctaaccgaattacggtaacggaaatagtaattattagtactacgttaggacacgacacgtacccgaacggtaacccgaccccgtaaactcctactactacctaactaaacgacgtctacgtacgccggtacccgtacccgtccggtaacgggttccgtacgggtaccttacgtttccacggttcccgtaccgttaccgtaacggttcgaccgggtccgtaccgtaccgaccgtaccccgtacccgtacgacccgtacgtccggtagggtccgggccccggtacccggggaccgtacgggngtacgggtacggtcgttaattacgtttaagttaaggttgttacgggtttacgggtacgttacgtccggtacgtaccgtcgttaacgtcgtttacgtcctaaccggtttcgggtaccggtaccgtacgggtaccggaaccggttaccgtcccggtaacccgtcggttacccgtaaccgaccggtacccaacccggaacccgtacccgttaccgg

SEQ ID NO: 163571 - DNA, 997 bp, Homo sapiens
  misc_feature: GYAE6OF01E1JTY.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggttttccttgttgcttcttttaaaaggtgtccagtgtgaggtgcaggtagtggaggtccgggggaggcttagttcagccgtggggacgtccctgacgactcctccgtgtgtagtctctggaatctagttttcacgttacccttcgtaggtactgtccgtaccgtcgggggtacccctacccgaaaaccgtcccggtaagggttaaacgggggtccgttaggggttggttcgggggttacccttaccgtaaccggttaattaccgtaaaacgttcccgtaggtaactttcgggggacctaaggtttacgtttaaagtttaaaacgtttacggttacggacccgggttaaccgttccccggggtttagggaaaccggggggttaccccgtaagttttacccgaacgggtacctaacgtttccccgtaaccccggaaagggtaacgaacccgaaaaccgggtaccgaaaagggttacgttaaacgttacccgttagggttaaacttaccgtaaacggtaaaacgttacggtaaaaccttaaacggttccgttaagggaaacggtttaaccgggtaacccggggtaaaccgttaaaccgttaaacccgggtccgttttaaccggtttccggttaaaacttttacccgttaaaggttttttacccggggtttttaaagggttttttccccggtaaagggttttccccggtttaaccccccgggttttccggggggtttaaaacccccccggggttcgggggttttaaacccccggttttaccccgggggttacccgggggggggtaaacccccccgttaaacccggggggttaaccccccccggttttaaccgggggg

SEQ ID NO: 163572 - DNA, 718 bp, Homo sapiens
  misc_feature: GYAE6OF01EIT16.47.55.E11.1.454.CMB.1.raw
tcagagctcacgtacacgaccggtgctcgatttagcactcgcacgttaggtttgggggccgcagccctgggattcccagctgtttctgcttgctgatcaggactgcacacagagagctcaccatggagtctgggctgagcttgggttttccttgttgcttacttttaaaaggtgtccagtgtgaggtgcaggtagtggaggtccgggggaggcttagtcagccgtggggacgtcccgtgagactccgtcctgtgtagtctctggaattcagtttcagttaccttctggatgcacgtgggtcccaccaactccgagggtacgggcgtggtgtggtctcagtatcaatcctgacgtggactagtttagttaaattaaagttagtggtacggtacgttccggtagggacggggtcctagtcaagctacttccgtacgaagacggaaacgaaccggacgaaagttacggttaacttacgtggttaaatccggtaaaggtaactacgaaactaacgttacgaagggtaacggtaacgtaccgaacggttaacgttaccgggaccttttagtaccctttaaggtacctttaggtttttacgggttttacggttttaccgttacgtttcccgggttccccggttttcccgggggttacccggttccgggttacccggtttcccgggttacggggccccgggttaaacgggtaccccggttcgggg

SEQ ID NO: 163573 - DNA, 851 bp, Homo sapiens
  misc_feature: GYAE6OF01BOZB4.47.55.E11.1.454.CMB.1.raw
  modified_base (209)..(209): a, c, t, g, unknown or other
  misc_feature (209)..(209): n is a, c, g, or t
tcagagctcacgtacacgaccggtgctcgatttagcactcgcacgttgggtttggggagcttcagctgtggtagagaagacaggattcaggacaatctccagcatggccgcttccctctcctcctcaccctcctcactcactgtgcagggtcttgggcccagtctgtgctgactcacgcccacctcgagcgtcgtcggggacccccggnacggacggtacacctacttcctttctttttcgaggtaacgccagtcctaccgaaattacgtacgggaaattgtaataattgttaatacgttacggttaaccaggactaaacgtccccgaaccgaaccccgggaccccctaaaccgtcctacctacttaccttaaactaaacaagtacgtactacgaacggtcccgggtacccctaccggtaaccggggttcccctacgggtacccgttactttccgtaccgttccggtaccttacccgaaacggttcccggtcggcccgtacccgttccgaacccgcccgtaaccccggttccggtaccctaacgtaccggtacggtaccggggcccggttaccccggaccccgggtaaggtaaccggtcgggaaccggtcgtttacggtaacgttttaacgttacgtttacgggttagggttacgggttacgggtacgtaccggtacgtaccggtaccgttacgttacgtaccggttaccttaccggttcggttaccggtaccggttccgggtaaccggtaccggttaaccggtacccggttacccggttacccgttagggttacccaaccgggtaacccccggtaacccggacccctaaacccccgttgttaaccccggg

SEQ ID NO: 163574 - DNA, 799 bp, Homo sapiens
  misc_feature: GYAE6OF01DDPQV.47.55.E11.1.454.CMB.1.raw
  modified_base (233)..(233): a, c, t, g, unknown or other
  misc_feature (233)..(233): n is a, c, g, or t
tcagagctcacgtacacgaccggtgctcgatttagcactcgcacgttggggtttgggggccgcagccctgggattcccagcttgtttctgcttgctgatcaggactgcacacagagagctcaccagtggagtcgtgggctgagtcgtttgggtttttccttgttgtacttacgttttaaaaggtcgttccagtggtggaggtgcgtaggtaggtgggacggtccgggggagtnttagtcgaggtccgtggggtaccgtccgtagagtaccgtcctcgttggtagttacgtcgtcgtaggtaattctaagtttcctacgttaccttcgtaggtatcgtacgtaccggtcggtaacccgacctaaccggtaccggaggggtaacggtcgtaggtcggtcggtcctacgaacgttactacgactcgtgacgtggacgtagttattaataagttcgacggtcgtaccgtcgggtacggacgggtacgtattcgacgtaccacttaccgacgtaacgaacggaacgaaacggtactaaaggtagttaacgttacgtagttaacttaaccggtaaggtaaactaacggtaattacgtaggttaacggaacggtacggtacggaacggttactaccgggtattacttaccgttaattcggtttacgttttacggttttacgtttacggttaacggtttcccgggttcccgggtttaccccgggtaccggttaaccgggggtttcccgttaaaccggggttaccccggggggaacccgttaacccgggggttccccggttaaccggg

SEQ ID NO: 163575 - DNA, 765 bp, Homo sapiens
  misc_feature: GYAE6OF01BQL50.47.55.E11.1.454.CMB.1.raw
tcagagctcacgtacacgaccggtgctcgatttagcactcgcacgttgggtttggggccgcagccctgggattcccagctgtttctgcttgctgatcaggactgcacacagagagctcaccagtggagtcgtgggctgagtcgttgggttttccttgttggtcttacgttttaaaaggtcgtccgagtgtggaggtgcgtaggtaggtggacggtccgggggagtcgttagttcgacggtccgtaggggacgtcccgtgacgtactcgttccgttggtggtacgttcgttacgtaggtaacttcgtaacgtttccgtaacgttaccgttcgtaggtacgtcgaccgtaccggttccgggttaccccgaacccgtaaaaccggttccggaacggggttaacgggtccgttgggtcggttacgggtacctacgtacgttactacgaacgtcgtagagtcggacgtagttagttaataaagtgtcggacgtacgtcggtaggacggtacgtagttacgacgtactacgttccgaccgaaggaccgtaacgaaaggacctaaggtaagttacctagtacgttagtaacgtaaagaagtacgtaacaagtacggtaagacggtaacgtacccgtaaaggcgttaacccggtgttaccgttactagttccgttaaggttttggtttacgttcggtaccgttcccgtccgggtttccgggccgtacgggttacccgttcgggtaccgggaaccgtacgggtacccggttcgg

SEQ ID NO: 163576 - DNA, 700 bp, Homo sapiens
  misc_feature: GYAE6OF01A8S2L.47.55.E11.1.454.CMB.1.raw
tcagagctcacgtacacgaccggtgctcgatttagcactcgcacgttgggtttgggagccgcagccctgggattcccagctgtttctgcttgctgatcaggactgcacacagagagctcaccatggagtctgggctgagcttgggttttccttgttgcttacttttaaaaggtgtccagtgtgaggtgcgaggtagtggaggtccggggagtcttagttcagcgtggggactcctgagactctctgtgtagtctctggatcgtagttcagttaccttcgtaggatcgctacgttcgggtacccgacctaaacgtccgaaggggtaacgggtccgtgggtcgtcgggtctacgtacgttagtacctaaagttccgtaggtacgtcggtacgttaaggttagtttaaagtaaactttagtcggtaaccggtaccggttcgggtacgggtaacggggtacctaagttcgagactactccgtacgagaacgaacgaaacggagaaacgtagtatacgttagtatacgtaaggaaattagaactagtacgtagaacggtagtaccgaacgtacgtacggtattggtacttacgtagttagtttggtttacgtttacggacgtttcggtacccggtttccgggtacccgggtaccgggtttacccggttcgggtaacccggggtccggttaacccgggtaacccgg

SEQ ID NO: 163577 - DNA, 633 bp, Homo sapiens
  misc_feature: GYAE6OF01EHYT8.47.55.E11.1.454.CMB.1.raw
  modified_base (185)..(185): a, c, t, g, unknown or other
  misc_feature (185)..(185): n is a, c, g, or t
  modified_base (190)..(190): a, c, t, g, unknown or other
  misc_feature (190)..(190): n is a, c, g, or t
  modified_base (303)..(303): a, c, t, g, unknown or other
  misc_feature (303)..(303): n is a, c, g, or t
  modified_base (378)..(378): a, c, t, g, unknown or other
  misc_feature (378)..(378): n is a, c, g, or t
  modified_base (392)..(392): a, c, t, g, unknown or other
  misc_feature (392)..(392): n is a, c, g, or t
  modified_base (398)..(398): a, c, t, g, unknown or other
  misc_feature (398)..(398): n is a, c, g, or t
  modified_base (405)..(405): a, c, t, g, unknown or other
  misc_feature (405)..(405): n is a, c, g, or t
  modified_base (454)..(454): a, c, t, g, unknown or other
  misc_feature (454)..(454): n is a, c, g, or t
tcagagctcacgtacacgaccggtgctcgatttagcactcgcacgttgggtttgggggagccgcagccctgggattcccagctgtttctgcttgctgatcaggactgcacacagagagctccaccatgggagtcgtgggctggagtcgttggtttcgtgtgtcttactttaaagtgtcagtgtgnggtgngtaggtagtggacggtcggggagtcgttagtcgagtccggtagggtactccgtgacgtctcgtcgtgtagtcgttcctagtgtaactcgttagtttacacgttcctgtaggtntcgacgtcgtaccgggtacccacctaaacggtcggtaacggggtgggtcttggggtgttcggtctacgtaacgtntactacgtcgtagngtcggntaagttnttaaataagttggacgtcggtacgttcggaacgggtgaccgtatgtacntacgtcaacgagtacagaacgtaatagtacgttactagttcgatacggtaagtaataacgaactatgacgtaggcgaaccgtaggctacggtctgttaatgttacgtgttttcgttggttactcggtcccggttcgtcccggtcgtcgggttcccaggggtccgacgggtaccgtccgg

SEQ ID NO: 163578 - DNA, 739 bp, Homo sapiens
  misc_feature: GYAE6OF01AEP1R.47.55.E11.1.454.CMB.1.raw
  modified_base (662)..(662): a, c, t, g, unknown or other
  misc_feature (662)..(662): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagtcgttgggtttttccttgttgtcttacttttaaaaggtgtccagtgtgaggtgcgagggtagtgggaggtccgggggagtcgttagttcgaggtccgtggggacgtccctgacgtctctccgtgtgtagtctcgtggaactcgtacgtttcacgttaccttgtggtatcgcgtaccgttcgggtcccgaacccgtaaaccgtccggaaggggttacgggccgttgggtcggttcggtcgtcgtaacgtactactaacgtccgtaggtagtcggacgttagttagtttaaagttaaacgttagtacggtccggtaccgttccgggtagggtaccggggtaccgtagttaccgacgtcctacgtccgtaccgaaggaaccggaaaccggtaacggacgtaaaggtattaacgtacgtttagtaattaccggtaaagtaaactacgtaactaagttcgtaggaagtacggtacgtaacgtacgtaccggtcttagtacttagtcttaggtttgtttacgtttacgngtttccgggttccgttacccgggtcccggtcgggttacctttccggggaccgggaccgtaccgggttcccgtccggg

SEQ ID NO: 163579 - DNA, 903 bp, Homo sapiens
  misc_feature: GYAE6OF01B5R4B.47.55.E11.1.454.CMB.1.raw
tcagagctcacgtacacgaccggtgctcgatttagcactcgcacgttgggttttccttgttgctcttttaaaaggtgtccagtgtgaggtgcaggtagtggagtccggggaggcttagttcagcctggggagtccctgagactctcctgtgtagtctctggaatcagtttcagtaccttctggatgcactgggtccgccaaactccgaggtagggctggtggtggtctcacgtatacgtaactccgtgagtgggcgtagttagttaataaattagtcggcggtaccgttccggtaggggtacggggccctaattccgagcctactccgtaccgaagacgacgaacgggtaccgaagtagtaacttacgtaggttactacgtaaggaaaatacggaaaaactattacgtacggaaggtaacggtaccgaacgggtaacctaccggggtcttacgttaaccctagtttacgtaagttttggttttacggttttacggtacgttcccgggttccccggtttccggggttccccgggtaccgggttacccggtttccggggtaccgggggtacccggttaacccgggggtaacccggtttcgggtaccggtaaccggtccccggtttcccgttaccccggtaccgaccccggtaccccgttaccccgaaaccccgggtaaccccgggtaccccgttaaccggtttcccccggtttccccgttcccccccggggttccggggccccgttcccccggtccggttacccgtaacccgggtaccgggtaaccgccccgtaaccccggtccggaaaccgggaccgaacccggaccgggacccgggtccccgggtacccggtccggggtcccgttaccgggtcccgggttacggtaaccggttaaaccccggg

SEQ ID NO: 163580 - DNA, 720 bp, Homo sapiens
  misc_feature: GYAE6OF01BY7R7.47.55.E11.1.454.CMB.1.raw
  modified_base (172)..(172): a, c, t, g, unknown or other
  misc_feature (172)..(172): n is a, c, g, or t
  modified_base (191)..(191): a, c, t, g, unknown or other
  misc_feature (191)..(191): n is a, c, g, or t
  modified_base (221)..(221): a, c, t, g, unknown or other
  misc_feature (221)..(221): n is a, c, g, or t
  modified_base (233)..(233): a, c, t, g, unknown or other
  misc_feature (233)..(233): n is a, c, g, or t
  modified_base (342)..(342): a, c, t, g, unknown or other
  misc_feature (342)..(342): n is a, c, g, or t
  modified_base (532)..(532): a, c, t, g, unknown or other
  misc_feature (532)..(532): n is a, c, g, or t
  modified_base (577)..(577): a, c, t, g, unknown or other
  misc_feature (577)..(577): n is a, c, g, or t
  modified_base (617)..(617): a, c, t, g, unknown or other
  misc_feature (617)..(617): n is a, c, g, or t
tcagagctcacgtacacgaccggtgctcgatttagcactcgcacgttggggtttggggagcttcagctgtggtagagaagacaggtattcaggacaatctccagcatggccgtcttcctctcctcctccacctccttcacttcacgtgtcgcgtacggttcgtcgggacccngtctggtgctgactcgacncctacctcgagccgtcggccgggacccggnacggacgtcacnttcttcgtgttacaggaacgctagcctacagtacgtaggaatagtataacgtgtacacgttacgaaccacacaaccgtaccgaacggtacccgacccctaaacttccanaaccttacaaacgtaacagacgtactacgccggtcccggaacctcgggtaacgggtccgtacgaccgttatttcggaccgtcgtacccgtacgttacgtccggtcggaccctctacgcccaccgttaccgtcggaccttagtccggtcgggtccggtcccgccgggtaccgagggtaccgttggacgttntagtttaattacgttcggtaggttcggtacggttcggcttaccgngtaccgtacgttacgtacgtcggtccgtttacggtaccgnggggtaccttaacggggtaccgaccggttacccggttccaacccgggtaccgtttacggaacccgacccgtaaccccggtaacccgccccgttaacccggtta

SEQ ID NO: 163581 - DNA, 821 bp, Homo sapiens
  misc_feature: GYAE6OF01EMMLF.47.55.E11.1.454.CMB.1.raw
  modified_base (257)..(257): a, c, t, g, unknown or other
  misc_feature (257)..(257): n is a, c, g, or t
tcagagctcacgtacacgaccggtgctcgatttagcactcgcacgttgggtttggggccgcagccctgggattcccagctgtttctgcttgctgatcaggactgcacacagagagctcaccatggagtctgggctgagcgttgggttttccttgttgtcttacttttaaaaggtgtccagtgtgaggttgcgaggtaggtggaggtccggggagtcttagtcagccgtgggctcctgagactctctgtgtagtctgngtatctagtttcagttaccttgtggtatcgtacgaccgttcgggtacccctaacccgtaaaccgtaccggtaaggggttaaacgggggtcgtttaggggttcggttacgggtccttacgtaacgttactacgtaacgttccgtaggtacgtcggtacgttaacgttagtttaaattaaagttacgtcgggaacccggtacgttaccgggtaggggaccggggtccttaagttaccgaacggtacctacgttaccgtaccgaacggacgtaaccggaaaccgagtaaacggtaaggttaactacggtttacgtacttacggaaagtaacgtagtaaactaccgttagaaggtaaccggtaacggtacccgtaacggtacgttacgggtacttacgttaaccgtagttaccgtttaggttttccgttttacggtttaccgttaaccggtttcccgggttttccccgggtttacccggggaaccccgggtttacccggggtttacggtttacccccgggggtaaaccggggtacccgggttaaaacccggggttccccgttccgggg

SEQ ID NO: 163582 - DNA, 786 bp, Homo sapiens
  misc_feature: GYAE6OF01C0NN8.47.55.E11.1.454.CMB.1.raw
  modified_base (230)..(230): a, c, t, g, unknown or other
  misc_feature (230)..(230): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagcgtggtttctgttagctactttaaaggtgtccagtgtgaggtgcgaggtagtggaggtccgggggagcttagttcagccgtgggactcccngagtactctcctgtgtagtctcgtagtaatcgtagtttcacgttaccttcgtggactgccgtacgtcggggtcccaacctaaacgttcccgaaggggtacggggtgttgggtcggtcgggtactaccgtaacgttaactaccgaagttccgtaggtaacgtcgggtataggtttaagttaaattaaaagtttcgtggtaccgggtaaccgtttccggaggggaccggggtaccgtaactttcgaacggtcctactttacccgaccggtaaaggaccgaaaccgggttaacggaaccgaaaaggggttaacctttacttaaccgtttacggtaaacgtttccgaaaggggttaaaattacggttaaaccaaaggtttccgtaaagggaaggtaacgggttaaccgacgttaagttaacccgggtcctttaggttcctaagttcctaggtttaggttttcggtttacggactttcccggttaaccgggtttccccgggtaccgggtcgggttaccttaccggggccggggttaacggaccggggttacccttacgggg

SEQ ID NO: 163583 - DNA, 752 bp, Homo sapiens
  misc_feature: GYAE6OF01DKR4Y.47.55.E11.1.454.CMB.1.raw
  modified_base (177)..(177): a, c, t, g, unknown or other
  misc_feature (177)..(177): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtcgtggctggagtcgttgggtttttccttgttgcttacttttaaaaggngtccagtgtgaggtgctaggtagtggaggtccggggagcttagttcagccgtggggactccctgacactctcctgtgtagtctcgtaggaattcgtagtttcaacgttaccttcgtggtatcgacgtacgtcggtacccgaccgtaaactaccggaagggtacggggtcgttagggtcggtcggtaccgtcaacggttactacaacgttccgtaggagtcggactaagttagtttaaaagttaagttacgtcgggtaccggtaccgtaccgggtaggtaccggggacttacggttacagtcctaacgtccgtaccgaaggtaacgaaccgtaaacggacgaaaggttaacgttacgttaacgtaggttacttaacgtaaggtaaaacgttacgaaacgtaataccggtagaagtaacggtaccgtaacggtacgttaacggtcgttacgttacgtaagttcttacgtttggtttacgttttacggtacgtttccggttcccgttcccgggttaccggtccgggttaccggtttacccgggtcggggaacccggttaaccgggtacccgttacggg

SEQ ID NO: 163584 - DNA, 824 bp, Homo sapiens
  misc_feature: GYAE6OF01AV39J.47.55.E11.1.454.CMB.1.raw
  modified_base (204)..(204): a, c, t, g, unknown or other
  misc_feature (204)..(204): n is a, c, g, or t
  modified_base (236)..(236): a, c, t, g, unknown or other
  misc_feature (236)..(236): n is a, c, g, or t
  modified_base (240)..(240): a, c, t, g, unknown or other
  misc_feature (240)..(240): n is a, c, g, or t
  modified_base (394)..(394): a, c, t, g, unknown or other
  misc_feature (394)..(394): n is a, c, g, or t
tcagagctcacgtacacgaccggtgctcgatttagcactcgcacgttgggtttggggagctgtggtagagaagacaggattcaggacaatctccagcatggccggcttccctctcctcctcaccctcctcactcactgtgcagggtcttggcccagtctgtgctgactcacgccaccctcagtccgtcgtccgggacccccggnacgaccggtcacctatcttcttgttctggaancgancctaccaatacgtacggaatgaattatcgtatacgtggtaaccagtccaaccgtcccaacgaaaccccgccccctaaactcctaactacgtactaacaaactagtagactacgccgacccgtccgtccgggtaacgggttccacgggtaccctnttaccgtcggtaccggtacctaccgtaacgggtccgtacgggcccgtaccctaccgaccgtccccgtaacgtcccggacgttaccgacggttaccggggtcccgggtccccggtaccccggaaccgggtaggtaaggtccgggttaacggttacgtaacgttttagttaaccggtcgtttacgggttaacgggttaacggggttcgaaccggtttacccgacggtacccgttcccgttaacggttacgttacggtttaacccggttccggtaccgggttacggtaaccggttccccgggttaaaccggaaccgggttaacccggtttaccccgtaaccccggggttacctaacccggggtaccccgaacccggtaacccgaaacccccgtttccccgacctttacccggtaccgttccccttaacccccg

SEQ ID NO: 163585 - DNA, 754 bp, Homo sapiens
  misc_feature: GYAE6OF01CYK21.47.55.E11.1.454.CMB.1.raw
  modified_base (635)..(635): a, c, t, g, unknown or other
  misc_feature (635)..(635): n is a, c, g, or t
tcagagctcacgtacacgaccggtgctcgatttagcactcgcacgttgggtttgggggctgcagccctgggattcccagctgtttctgcttgctgatcaggactgcacacagagagctcaccatggagtctgggctgagcgttgggttttccttgttgtcttacgttttaaaggtgtcagtgtgaggtgcgaggtaggtggaggtccgggggagtctttagtcgagccgtggggtacgtcccgtgacgcctcgtccgtgtgtagtctcgtaggtattcgtagtttcgtaacggttaccctttgtaggtatacgtccgtaccggtccgggttacccgaacctaaaccgtccggaaggggttaacggggccgttgggtgggttcgggtcctacgtacgttactacgtaacttccgtaggtacgtcggtacgttaaggtttaagttaaatttaaaacgttgttacgggtacccggtaccgtccgggttagggaccggggtactacgtttcgacgtacctacgtccgtaccgaaggacgaaccgaacggactaagtagttataacgtagtactaacgtaaggtaaactacgtaaacgtagtcgtaggtaagtacggtaccgtaaggtaacgttacggtnttaccgttattacgtacgttagtttcggtttacgtttggtacgtttccggttaccccggttccgggttaccggtcgggtttaaccgttccggggtcgggacccgttaaccgggtcccgg

SEQ ID NO: 163586 - DNA, 693 bp, Homo sapiens
  misc_feature: GYAE6OF01C5Y08.47.55.E11.1.454.CMB.1.raw
  modified_base (187)..(187): a, c, t, g, unknown or other
  misc_feature (187)..(187): n is a, c, g, or t
  modified_base (208)..(208): a, c, t, g, unknown or other
  misc_feature (208)..(208): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctccaccctcctcactcactgtgcagggtcttgggcccagtctgtgctgactcagccaccctnagccgtcgcgggaccccgggnagacggtcaccatctcttgtctaggaagccagctcaaatatacggaaatgataatgtaatagtacgtacaggactaacgacccgaacggaacccggacccccaaaactccctacaactactaactaaacctaagtacaactaccgaggccccgtacccgtcggaaccggggttccccgtacggtaccgtaacgttccgtcgttcggacccttaccggaagtccgtacggcccgtaccgtccaaccgcccgtacccgcggtccaacgttccgacgggtcggcccgtacccgggccgaaggttacgacgagggtctacggtacttagtaacgttgggtagttacgggttgacgtcgacgtacgacttggtacctggtaacctttcgttccggttacggaggtaccgttacggggaacctaacggtcccgacccggttcggtaaccgtccgaacggtaccccgtaaccggacccctaacccgtaccgg

SEQ ID NO: 163587 - DNA, 821 bp, Homo sapiens
  misc_feature: GYAE6OF01CTAVK.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggttttccttgtttgtcttacgttttaaaaaggtgtccagtgtgaggtgcgaggtagtggaggtccgggggaggtcttacgttcgacggtccggtggggtacgtcccgtgacgtactccgtccttgttcgtagtccgttcctaggtaacttacgtaagtttccaagttaccttcgttggtatcgctacggtcgggtccccaaccgtaaaccgtccggtaacgggtaaggggtccgtgggttacggttcgggttcctacgtacgttacgttaacccgtacgttacccgtggtaacgtcggtacgtaacggtttagttttaaaacgttaaaagtttacgttacgggtcccgggtaaccgtttacccggggtacggggtaacgggggtaccgttaaccgtttcgaacggtacctactttacccggacccgaaggaaaccggtaaacggaaacccgggtaacgaaaaggttaacgtacgttaacgttacggttaaactacggtaacgggtaaaacttaggaaaccgttaaacgtcggtaacggaggttaacgggtacgtacgttaacggtacgttcgtacgttacttatcgttagtttggttacgtttcgtacgttccggtttcccggtccggtacccggtacggttacgttcggaccgggtacccgtacgggtaccttcgg

SEQ ID NO: 163588 - DNA, 773 bp, Homo sapiens
  misc_feature: GYAE6OF01AD3MV.47.55.E11.1.454.CMB.1.raw
  modified_base (171)..(171): a, c, t, g, unknown or other
  misc_feature (171)..(171): n is a, c, g, or t
  modified_base (669)..(669): a, c, t, g, unknown or other
  misc_feature (669)..(669): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgcttcttttaaaggtntccagtgtgaggtgcaggtagtggaggtccgggggagtcttagttcagccgtggggacgtccctgagactctcctgtgtagtatcgtaggaatctagtttcaggttaccttcgtggatcgcgacgtcgggtacccgaccctaaaaccgtccgaggggtaacggggccgttaggggttcgggtacgggttccttacgtaacggttacttaccgaaacgtttccccgtaggtacgttcggggaccttaaggtttagttttaaattaaaagtttacggttacgggtacccgggttaccggttacccggggttgggtaaccggggggtacccgtaacgtttccgaacggtcctaacgttcccgtacccgtaagggtaacgaaccggtaaacggaaccgtaaagggtagtttaactaacggttgtaacggttccgtaaagggtaaacttacggaaacttaaggtcctaagggaaggtaccggtagtaaccgtagtaccggttnttacggttactactcgtttagttcggttgtttacgcggttcgtcccggttccgggtccggtccgggtaccttcggtaccggggccgtaaccgggtaccgtcggg

SEQ ID NO: 163589 - DNA, 701 bp, Homo sapiens
  misc_feature: GYAE6OF01DOC2F.47.55.E11.1.454.CMB.1.raw
  modified_base (269)..(269): a, c, t, g, unknown or other
  misc_feature (269)..(269): n is a, c, g, or t
tcagagctcacgtacacgaccggtgctcgatttagcactcgcacgttgggttttccttgttgctcttttaaaaggtgtccagtgtgaggtgcaggtagtggagtccggggaggcttagttcagcctggggagtccctgagactctcctgtgtagtctctggaatcagtttcagtaccttctggatgcacgtgggtccgaccaaactccgaggtaagggctggtgtgggtctcacgtatcaatccgtgatggctagtgttaattaaattntggacggaactccggtaggacggggccgtattcgagcattcctaccaaggacgaacgaaacggacaaaggatactacgtagtatcgtaggaaaatgaaactaatcgtaggaagtacggtcgaacgataccgggcttacgtacttacgtcttagtttgtttcgttttacgacttcggtccccgtttacgggtcccggtacgggtaccgtttcggtacggggaccgtaacgggtaccccgttgggtaccgacggtccgtccttccgtaccacgtcccctaacccgaccggtaaccgggccctacggttccccggtcccgttcccccgtaggccccgtcccgtacgcccgtccgaacgggccacccgtacccgtcgaacggacgaccgaccgacggcccggtacccgtggtcctcggccgtcggacgtaacccgg

SEQ ID NO: 163590 - DNA, 663 bp, Homo sapiens
  misc_feature: GYAE6OF01AKMXL.47.55.E11.1.454.CMB.1.raw
  modified_base (253)..(253): a, c, t, g, unknown or other
  misc_feature (253)..(253): n is a, c, g, or t
tcagagctcacgtacacgaccggtgctcgatttagcactcgcacgttgggtttggggcagcttcagctgtggtagagaagacaggattcaggacaatctccagcatggccggcttccctctcctcctcaccctcctcactcactgtgcagggtcttgggcccagtctgtgctgactcagccaccctcagcgtccgtcgggacccccgggcagacggtcaccatcttcttgttcgtggaagcacgctaccaatntacgaatgataatgtatacgtggtaccagacaacgtcccaacgaaccggaccccctaactcctacactctaactaactaatagacacgacgccggtcccgtcgacggggttcccgtacggaccgtacttcgtcgtcgtcctaccgaacgtccgtcggccgtccttccgaccgtccctacccgtcggccctacgtcgacgggtccgggtcccgtcccgggacccggtaacggtcgtacggacgggttcctaggttaacttttacgttcgggtacgtttcgggttagggtttcgggatccgggtacgacgtccgtgtaccgtcgttacggttacgtcgtacggcgtcgtacggtaccgtacggtccgtacccgtacgtacggaccacggacccctaaggccctaaacccccg

SEQ ID NO: 163591 - DNA, 739 bp, Homo sapiens
  misc_feature: GYAE6OF01BA1J1.47.55.E11.1.454.CMB.1.raw
  modified_base (169)..(169): a, c, t, g, unknown or other
  misc_feature (169)..(169): n is a, c, g, or t
  modified_base (667)..(667): a, c, t, g, unknown or other
  misc_feature (667)..(667): n is a, c, g, or t
tcagagctcacgtacacgaccggtgctcgatttagcactcgcacgttgggtttgggggagccgcagccctgggattcccagctgtttctgcttgctgatcaggactgcacacagagagctcaccatggagtctgggctgagcgtggtttctgtagctactttaaaggtntcagtgtgaggtgcgaggtagtggacggttccgggggaggtcttaggttcaggtccgtggggagttccccgtgtacgccttctccgttgtgtacgtctcgtaggaattcgtagtttcctaacggttacctttcgtggtaatcggctacgtcggtacccgactaaaccgttaccgagggtaacgggtcgttaggtggttcgggtctacgaacgttactactaacgttcctggtaagtccggtagtaagtttagtttaaattaaaggttacgtacgggtaccggtaccgtaccggttgggtacgggggtaccctattacgaccgtacgtactaccctacgaacggaacggtaaccgaaaccggtaagaaacgtaagttaacctagttagttacgtataaggtaaactacgaaataagtaccgaagtaaggtacggtaacgtaacgttacggtagtaccgttagttacccttagtaccgtttaggttagttaccgttttanacggttcccgttccggttaccggtccgggttaccggtcggttacgggtccggtacgggtccccggtaacggg

SEQ ID NO: 163592 - DNA, 987 bp, Homo sapiens
  misc_feature: GYAE6OF01BOI8O.47.55.E11.1.454.CMB.1.raw
tcagagctcacgtacacgaccggtgctcgatttagcactcgcacgttgggtttgggggccgcagccctgggattcccagctgtttctgcttgctgatcgaggactgcacacagagagctcaccagtggagtcgtggctgagtcgttggttttccttgttgtacgttacgttttaaaggtcgtccgtagttgtaggtaggtagacgtagggttaggtacgggtacggggttaccgggggtagtcgtttaacgttcgacggtccggttaggggtaccgttccgtacggtaacgtaccgttcccgttccgttaggttcggttacggttcctacgttaggtacgttacgttagttttacgtaccgtttacccttggtggtacgttcgtaccgtacggttccggtacccgtaacccgtaaacgtaccgggtacggggttaacggggtcgttacggggttcggttccggtacgttaccgtaagtttaaccgtacgttaaccgttccgtaagtacggttacggtaacgtaggtttaaagtttaactttaaaggttacgtaccggtaccgggttaccgttaccggggttacgggacgggtaccgtacgttacgcgtaccttaacgtaccgtaaccggaacggtaaccgaaaccggtaacgtaacgtaacggtaacgtttaaccgtacgttaacgtttaacggtacggttaaacgtaacgtaacgttaaccgaacggtttacgaacggtaggtaacccggttaaccggtaaaccggttaccgttaccgggttaccgttacggttaagttttacccgttacgggtttttacgttttaaccggggtttcctttaaccggggttccccggttttaccccgggggtttacccgggttaaccccgggttttcccggggtttacccgggtttaacccggggggttccgggttaaaacccccggggttaccggggtttaacccggttcccggttaccccgggg

SEQ ID NO: 163593 - DNA, 803 bp, Homo sapiens
  misc_feature: GYAE6OF01EWS8K.47.55.E11.1.454.CMB.1.raw
  modified_base (190)..(190): a, c, t, g, unknown or other
  misc_feature (190)..(190): n is a, c, g, or t
  modified_base (209)..(209): a, c, t, g, unknown or other
  misc_feature (209)..(209): n is a, c, g, or t
  modified_base (222)..(222): a, c, t, g, unknown or other
  misc_feature (222)..(222): n is a, c, g, or t
  modified_base (241)..(241): a, c, t, g, unknown or other
  misc_feature (241)..(241): n is a, c, g, or t
tcagagctcacgtacacgaccggtgctcgatttagcactcgcacgtttgggtttggggagcttcagctgtggtagagaagacaggattcaggacaatctccagcatggccggcttccctctcctcctcaccctcctcactctactgtgccagggtcttgggcccagtctgtgcgtgactcagccaccctnagcgtctcgggaccccggnagacggtcacctntcctcttgttcgtggaacncagtctaccaaagtacgtacggtaaatgtaagttaattagtaactacgttcggtaaccagtaccgtaaacgtaccccaaaccggaaacccggtaccccccaaaacgttcccctactaactacctaactaaacaagtgtaactcgacgtcccggtaccctacggtaccgggtccgtacggtccgtaagttcccgtctcgggtcctaacccgtaaacgtccgttacgggccgtcccgtaccgaccgtaccccgaaccgttcggccctaacgtccgtaggtccgggtcccgtccgggtaccggtaacgggacgttacgggacggttaccgtagttaacgtttaacgtttagttcggtacgaaccgtaaacgtaaggtacgggtaagttaacggtacggttaccgtagggtaacgttaggttcgggtttacggggttttaccggggaaccggggtaacgggtaaacccgttaaacggttaccgggtacccggttaccggtaacgggtacccgtaccgggtaccccgtaaaccgggttcccgtacccggtcccccggttaacccggg

SEQ ID NO: 163594 - DNA, 712 bp, Homo sapiens
  misc_feature: GYAE6OF01BDWLM.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagcgtggtttcctgttagctactttaaagtgtcagtgtgaggtgcgaggtagtggaggtccggggagtcttagttcagccgtggggactccgtagacgtactctccgtgttgtagtctacgtaggaactcgtagtttccagttacccttgtagggatcgacgtacgtcggggtaccccaacccaaaaccgtcggtacgggtagggtctgggtggtcggtctacgtacgtactacaagttccgtagactggacgtagtttaagtaattaaagtttcggtacggaccggtacgttaccggtagggaccgggtactagttaccgacgacgtacttccgtaccgaagtacggaaaccgtaacggaacgtaaaggtaacgttacgttaacgtacgtttaacgtacgtaaacggtaacttaacggtaactaacgttaccggaagtacggtaccggtacgtaacggttatacccgggtcttagtactagtacgttagttacggttttcgtcgtgttacccgtgttaccccgggtacggtccgggtaccgttcgggaccgggttccgtaacggtcccgttcgg

SEQ ID NO: 163595 - DNA, 676 bp, Homo sapiens
  misc_feature: GYAE6OF01BUJWF.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcacatggagtctgggctgagcgttgggtttttccttgttgtcttacttttaaaaagtgtccagtgtgaggtgcagcgtgggtggtaggtcgtgggggagtacgttagtacgacggtccggtcggggggttcccgtgtacgtacctcctccgtcggcgacgacgtccgtcttaggtactttcctttacttttaaggttaagtttactcgtacctaattcgtacggttcgggtacccgccgacggccgtaccggaaggggaaggggtcggtagggtaggtcgggttctcgaggtcgtagttcgggtagtacggttggcgacgaggaaccgattaacgttaacgtaacgtccgtggacgtacggtctatttctttacgtctacgagtacgactacgtcgaagtactatacgtacgtatctgactgtacacgacgtactagaggtacgtacggaacgacgtacgtagttacgttattagttgttaagttaggttaggtgtaggtcgtacgtacgtacggttcggttaccgggggaccgtaccggttcggtccgccgtttccg

SEQ ID NO: 163596 - DNA, 730 bp, Homo sapiens
  misc_feature: GYAE6OF01EBP7U.47.55.E11.1.454.CMB.1.raw
  modified_base (373)..(373): a, c, t, g, unknown or other
  misc_feature (373)..(373): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagcgtggtttctgtagctctttaaagtgtcagtgtgagtgcaggtagtggagtccggggagcttagttcagccgtgggagtccctgagactctcctgtgtagtctctggaatctagtttcagttaccttcgtggatgctacgtcgggtccacctaaacgtccgagggtaacggggcttagggtgtgggtctacgacgtatcaattccgtgactggactagttagttaattaaagtntcggtacggacctcgggtaggacggggtccctaagtttaccggagtaccgtactacgttaccgaacggaagaaccggtaaacggtaaccgaaggtaagttaacgtacgtagttaacgtacgtaggtaaacgtaagtaacctaaagtacgtaggaacggtaaggtaccgtaacggtacggttaaccggttcgtacgttaccgttaacgttacgttaacgtttggtttacggttttacggttaacggttaccggttcccgggttgggttaccccccccccccgggtacggggtttacccggtttaccgggtacccggggttaaccccgggtaccgggttaaccccgggttaacccgggg

SEQ ID NO: 163597 - DNA, 822 bp, Homo sapiens
  misc_feature: GYAE6OF01EP08A.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagcgttggttttccttgttgcttacgttttaaaaggtgtccagtgtgaggtgcgaggtaggtggaggtccgggggtaggtcgtttaggttcgacggtccgtgggggtacgttccccgtaggacgtaccttccttccgtaggttggttacgttcttcgtggtaactcgtagtttccgtacgttaccttcgtaggatgaccgtacggttcgggtaccccacccgtaaaccgtccggtaaggggtaacgggggtcgtcggggttaggttcgggtaccgtacgtaacggttacttaccgtaacgttccgtaggtaacgtcggtacgtaaggtttaagttaaagttaaagttagtacggtaccggtaccgttaccgggtacgggtaaccggggtaccgtacgttacgacggtcctaacgttacccgtaccggaaggtaacgaaccgaacggtaacgtaaggtaacgttactacgttaggtactacggtaagtaaacgacgtaacctaagttacgtaaggtacgtacggtaccgtaacgtacgtaccggtcgttacgtacttacgtcgtttaaacggttgttttaccgggttaccgtacgttcccgggttccccgtttccggggtaccggttacccgggttccgttaccgggtaccggggtacccgtaccggggttaaccccgttccgggg

SEQ ID NO: 163598 - DNA, 856 bp, Homo sapiens
  misc_feature: GYAE6OF01A858U.47.55.E11.1.454.CMB.1.raw
  modified_base (759)..(759): a, c, t, g, unknown or other
  misc_feature (759)..(759): n is a, c, g, or t
  modified_base (838)..(838): a, c, t, g, unknown or other
  misc_feature (838)..(838): n is a, c, g, or t
tcagagctcacgtacacgaccggtgctcgatttagcactcgcacgtttggggtttgggggccgcagccctgggattcccagctgtttctgcttgctgatcaggactgcacacagagagctcaccagtggagtcgtgggctggtagtcgtttcgggtttttccttggtttacgtcgttttaacgtttttaaaaagggtcgttaccgtaaggtggttaggaagggttgtacggtagggttaggtagggtacggggttaccggggggagttacgtttaaggttcgaacgggccggttagggggaccttcccgtagtaacgtaccttccgtccgttggtgttacgttcgtcgtaggtaactacgttagttacgtacgtacctttggtaggactcgaccgtcggtcgggttacccaaccgtaaacggtccggtaagggtacggggtcgtacgggttggtccgggttacttacgtacgttaactacgtaacttaccggtagttacgacggttacgtaagtttaagtttaaaattaaacgttagtaccgggtaacggtacccggttacgggtaggggtaaccgggttaccgtaacttacggaacgttacaacgtttccggaacccgaagggtaaacccaacggggtaaactcgttaaaggaaccgtttaagtcgttaagtaacttaaacgggaaagttaaacacggtaaactacgtttagacgggaagttacgacgggtaattaccgtacggtaatttcgtaaccnggtttatttacggttcgttttacgtagtccgttcggccggtttaacggtccgggtagttccggttaggaaccccgggtntaaacccggggcttacgg

SEQ ID NO: 163599 - DNA, 705 bp, Homo sapiens
  misc_feature: GYAE6OF01ETO80.47.55.E11.1.454.CMB.1.raw
  modified_base (689)..(691): a, c, t, g, unknown or other
  misc_feature (689)..(691): n is a, c, g, or t
  modified_base (693)..(705): a, c, t, g, unknown or other
  misc_feature (693)..(705): n is a, c, g, or t
tcagagctcacgtacacgaccggtgctcgatttagcactcgcacgttgggtttggggagccgcagccctgggattcccagctgtttctgcttgctgatcaggactgcacacagagagctcaccatggagtcgtgggctgagtcgttgggtttttccttgttgtcttacgttttaaaaggtcgtcctaggtgtggaggtgcgagggtaggtgggaggtccgggggaggtcgttagttcgacggtccgtgggggactcccgtagacgtaccttctccgtgtgtacgtctcgtaggaattcgtagtttcacgttaccgtttgaggactcgcgtacgtccggggtacccaaccgtaaaccgtccgggtaaaggggtaaccggggccgtaaccggggaacccgttgggtaccgtacggtccggttcctacccgtaccgaccgtccctacccgaaccggaaccggggtcccctacggttccccgttccctttccccgcggcccgtcccgtcgcccgttaccggaacggtaccgacccgtacccgtaccggaacgaccggaccgacccggtaccgggtccccggtcccctcggggccccttacggcccggttaggtaacccgtaacgttacccttacccgttccgtacggtcgctccggtgacggcgggtcggtcacgggacgtacggcatacggnnngnnnnnnnnnnnnn

SEQ ID NO: 163600 - DNA, 759 bp, Homo sapiens
  misc_feature: GYAE6OF01D2Y73.47.55.E11.1.454.CMB.1.raw
  modified_base (202)..(202): a, c, t, g, unknown or other
  misc_feature (202)..(202): n is a, c, g, or t
  modified_base (496)..(496): a, c, t, g, unknown or other
  misc_feature (496)..(496): n is a, c, g, or t
tcagagctcacgtacacgaccggtgctcgatttagcactcgcacgttggggtttggggagccgcagccctgggattcccagctgtttctgcttgctgatcaggactgcacacagagagctcacagtgggacgtcgtgggctggacgtcgtttgggttttccttgttgtacttacgtttaaaggtgtcgtagtgtggaggtgngtaggtaggtgggagggtccggggagtcttagtcgacgtcggtggggacgtcctgacgtctctcgtgtgtagtctcgtaggtaactcgtacgtttcacggttaccttgtcggtatcggaccgtacggtcgggtacccaacctaaaccggtcggtaaggggtacggggtcttgggtcggttacgggtaccttacgacggttaattaccgaagttccgtaggagttcggagtaagtttagttaaaattaacgtgtacggtacggtacgtaccggggtgggaacgggccttacgtanaccggtctacgtacctcgaaaggaccgtaaccgaacgtaaggtagtaaaggttactacgtaaggtaaccgtagtaacggtaaacgtaacgtagtaaacgttcggaacgggtacgaacggtttaccgaaacggtacgttaccgtagttacgtaacgttcttacgttaagggtttcggtttgtttaaccggcgttaccggttaccccggttccggtaccgggtacgttacggtacccggggttcggacccgggttaccggtaccg

SEQ ID NO: 163601 - DNA, 627 bp, Homo sapiens
  misc_feature: GYAE6OF01DWZI7.47.55.E11.1.454.CMB.1.raw
  modified_base (173)..(173): a, c, t, g, unknown or other
  misc_feature (173)..(173): n is a, c, g, or t
  modified_base (240)..(240): a, c, t, g, unknown or other
  misc_feature (240)..(240): n is a, c, g, or t
  modified_base (600)..(600): a, c, t, g, unknown or other
  misc_feature (600)..(600): n is a, c, g, or t
  modified_base (608)..(608): a, c, t, g, unknown or other
  misc_feature (608)..(608): n is a, c, g, or t
  modified_base (611)..(611): a, c, t, g, unknown or other
  misc_feature (611)..(611): n is a, c, g, or t
  modified_base (613)..(614): a, c, t, g, unknown or other
  misc_feature (613)..(614): n is a, c, g, or t
  modified_base (616)..(625): a, c, t, g, unknown or other
  misc_feature (616)..(625): n is a, c, g, or t
  modified_base (627)..(627): a, c, t, g, unknown or other
  misc_feature (627)..(627): n is a, c, g, or t
tcagagctcacgtacacgaccggtgctcgatttagcactcgcacgtagggtcttgggcccagtctgtgctgactcagcccaccctcagcgtcgtgggacccccgggcagacggtcaccatctcttgtctggaagcagctccaatatcggaaatgataatgtatactggtaccngcaagtcccacgaaccggcccccaaatcctcatctataacatgatcagccgccctcgacggggtccnggcctattcctcgtggcctaccgtaagtcctggccgtcctccgacgccccaccgtggcccctagtcgaggttcggccgtcccggcccgaggtatcggagtcctagtatttaacgtttatggttggttaagggttcggattcgacgtaggtcctagtaccgtgtcctttacgttcgttggacgtccgtagggaccctaggttccccaccgttcgtacggtccaaccgggacccaaccgggacccctaacccctagttcggttcccaccctttccggttcccttaccccccgtcccttacccgttaacgcgttacgtacgtcctaccgtggtacgggcccggttagcggaccgacggacgtntaacgcgntancnngnnnnnnnnnngn

SEQ ID NO: 163602 - DNA, 835 bp, Homo sapiens
  misc_feature: GYAE6OF01C5LIM.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcacatggagtcgtggctgagtcgttgggtttttccttgttcgtctttaacgtttttaaaaggtcgtccgaggtgtggacggtgcgtagggtaggtgggtacgggtccgggggagtcgttagttcgaggtccggtaggggaccgtccccgtagacgtacctccttccgttggttgtacgtcgttacgtaggtactcgtacgtttacgtacgtttaccttcgtaggacgttcgaccgtaccggtccggtaccccgtaaccgtaaccgtaccggtaaggggtacgggtcggttgggtcggtcgggttactacgtaacgttacgtactacgtccgtaggtagtacggtcgttaagtttaagttaaagttaacgtttagtaccggtcggttacccggttacgggtcggggtaacggggtacctacgttaacgtacgtacctaaccgttaccgaacggaacggtaaccgaaaccggaacgtaaacgaaagttacgttaacgttacgtaagttaacgtaacgaaaggttaaactaacgtaactaaggtcgtaaaggtaacggtaacggtaccggtaagtacggttcgtacgttacgtaacttacttgttacggttttggttacggttttacgcggtttcccggtcccggttacccgggtcccgggttacgggtaccggtttaccccggggtagggttaacccccggagggttaccccggtcggg

SEQ ID NO: 163603 - DNA, 914 bp, Homo sapiens
  misc_feature: GYAE6OF01AZ8D3.47.55.E11.1.454.CMB.1.raw
tcagagctcacgtacacgaccggtgctcgatttagcactcgcacgttgggtttggggggaagaggaagactgacggtcctgccacaggtggtgctgggcacggtgggcactcgacacaacatttgcgctcaactgtcttgctcaccatggagtctgggctgagctgggttttccttgttgctcttttaaaaggtgtccagtgtgaggtgcaggtagtggaggtccgggggaggcttagtacagccgtgggggtccctgagactctcctgcgcagcctcgtggtacttccttccttttagtagttatcgcctatggtacgttcgggtcccgccgacggccgtacccggaagggggtaacgggggcgtaggggtacgggttcggggttacctacggacgggtccgttaggtttggggttagggttaagggttcgggttacggaccccggaagggtaacctaacgttaaacgtttaaaccgggttaaaaccggttcccccggttaggtaccggaacgggggttacccgtttaatttttacccgttttaactcccggttaacccgaaagggtaaccgttaaaccctaaagttttaaccccgaaacgggtaaaaccttaacgttaacccgttggtaaccttttccgttaggtacccgtttaaggttaccgaaaccccgtaaggtacccgttaagggaacggtaaccgggttacgggaaacggtacccggtaaccggggtaacccgtttaaagtttaagtttttaacgggtttacggtttaaagggttttaaaagggttcgggggtttaacggtttacggggggttaacccgggttaccggtttaaacccgggttaacccgggtttcccggggggttacccgggggggggttaaaccccccgggggtttaaacccccggg

SEQ ID NO: 163604 - DNA, 605 bp, Homo sapiens
  misc_feature: GYAE6OF01D0KCA.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggttttccttgttgcttcttttaaaaggtgtccagtgtgaggtgcaggtagtggaggtccgggggaggcttagttcagccgtggggacgtccctgagactctcctgtgtagtctcgtaggaatctagtttcagttaccttctggatgctacgtcgggtcccgaccaaaccgtccgaagggtaggggcgttgggtggtggtctcacgtatacaatctgagtcggactagttattaataaattcgtcggaccggtacgtccgggtaggacggggtcctagttacgagtacacgttcctaccgaagtaacgaaccgaacggacaaaggtagtaacttactagttataccgtaagaaatagaaactatcgagaagagtacgacgacgtcggctagtcttatctagtttgttagtttcgattcgtccgtccggtcggcggtcttcggcggggaccacgggtcctcgg

SEQ ID NO: 163605 - DNA, 837 bp, Homo sapiens
  misc_feature: GYAE6OF01BN3RN.47.55.E11.1.454.CMB.1.raw
  modified_base (183)..(183): a, c, t, g, unknown or other
  misc_feature (183)..(183): n is a, c, g, or t
tcagagctcacgtacacgaccggtgctcgatttagcactcgcacgttgggtttggggagccgcagccctgggattcccagctgtttctgcttgctgatcaggactgcacacagagagctcaccagtggagtctgggctggactcgttgggttttacctgttcgtccttaacttttaaaagggngtacctaggtgtaggtcgggtgacggaaggttaacggtcgggtaacggtaccggggggtaaggtcgttttaacgttaccgaacggtccgttaggggggtaacttccccgtaggaacggtacccttcgtacccgtgttaggttactcgtacgttaggaacttccgtagtttacgacgttaaccgtgtagtgacgtacgtacggtcggtaccgtaacctaaacggttccgtaacgggtaggtctagggtgtacggtactaccggtaactacgtacaattccgtggacgttacgagttaacggtatttaaataaagtcggtacggtacccggttaacgtacgggtacgggtacgggtaccttacggtacacgggtaccgtaattaccccggaacgtaaacgggtaacctaaacccgggaaacgtaaacggttaacggttaactaaacgttacgtaaacgggttaaccttaaggtaacggtaaaacgtaacttaaaccgtaagtccggtaaggtaaccggaacgttaccggaacgttaacgtacgttactacgttaaccgttcttaaccgttagtttccctttaaggtccgtaccgttcggtacccggttgtaccggtccggtacggttaaccggcgggtaacccggtacgtaaccgg

SEQ ID NO: 163606 - DNA, 612 bp, Homo sapiens
  misc_feature: GYAE6OF01AVTBM.47.55.E11.1.454.CMB.1.raw
  modified_base (591)..(591): a, c, t, g, unknown or other
  misc_feature (591)..(591): n is a, c, g, or t
  modified_base (593)..(612): a, c, t, g, unknown or other
  misc_feature (593)..(612): n is a, c, g, or t
tcagagctcacgtacacgaccggtgctcgatttagcactcgcacgttggggtttgggggccgcagccctgggattcccagctgtttctgcttgctgatcaggactgcacacagagagctcaccatggagtcgtgggctgagtcgttgggttttccttgttgtcttacgttttaaaaggtgtccagtgtggaggtgcgtaggtagtgggacggtccgggggaggtcttagttcaggccgtggggacgtccctgacgactccgtcctgtgtagtctcgtggtaatctagtttcacgttaccttcgtggatgcctacggtcgggtcccgaccaaacctccacgccctaccaaccggacggcccacgttcccggttccccttccccggtcggccccgtccccgtcggtccctccggaacggacgtacccgtacccgtccgagaccgaccgaccgacgggccccggtcccggtcggggtacccgtcggtcccggttcgggtaaccgtaacgggttaacccttaccgttaccgtacggtcgtacggtcctacggtcgggacgggtcgggtacgtggaccgtaacggcgactagtcgngnnnnnnnnnnnnnnnnnnnn

SEQ ID NO: 163607 - DNA, 710 bp, Homo sapiens
  misc_feature: GYAE6OF01DTJW0.47.55.E11.1.454.CMB.1.raw
  modified_base (485)..(485): a, c, t, g, unknown or other
  misc_feature (485)..(485): n is a, c, g, or t
  modified_base (524)..(524): a, c, t, g, unknown or other
  misc_feature (524)..(524): n is a, c, g, or t
  modified_base (572)..(572): a, c, t, g, unknown or other
  misc_feature (572)..(572): n is a, c, g, or t
  modified_base (609)..(609): a, c, t, g, unknown or other
  misc_feature (609)..(609): n is a, c, g, or t
tcagagctcacgtacacgaccggtgctcgatttagcactcgcacgttgggtttgggggccgcagccctgggattcccagctgtttctgcttgctgatcaggactgcacacagagagctcaccagtggagtcgtgggctggagtcggttcgggttttccgttggttagtccgttaacttttaaaaggtggtcaggtgtgaggtgcgtagggtagtgggagggtccgggggagtcttagtcgacggccgtggggactcccgtgacgtctccttccgtggtagttgtcctagtaggtaactcgtagtttccacgttaccgttcgaggtatacgaccgtcggttaccgggtaccccaaccgtaacggtccggtaagggggtacgggtcgttggggtggttaccggtcttacgagttacacgtaactcgtagtacgtcggtattagttatttaaaagtaacgtttcgacgggtaaccggtcggtaacggnggggtacggtacctagtctacggctactccgaacgtaanacgaacgacggagtaagtagtacttgtaagttagtacgtaagaactanaacgtgttagaggtacgtagtacgacgttacgtcgtnttacgtcttaacgttgttagttgtttacccggtagttcgttaccggtccggttaccggtcggtcgttcgggtacggccgggtaaccgtacgggtctacggg

SEQ ID NO: 163608 - DNA, 734 bp, Homo sapiens
  misc_feature: GYAE6OF01B84EZ.47.55.E11.1.454.CMB.1.raw
  modified_base (718)..(723): a, c, t, g, unknown or other
  misc_feature (718)..(723): n is a, c, g, or t
  modified_base (727)..(727): a, c, t, g, unknown or other
  misc_feature (727)..(727): n is a, c, g, or t
  modified_base (729)..(730): a, c, t, g, unknown or other
  misc_feature (729)..(730): n is a, c, g, or t
  modified_base (732)..(732): a, c, t, g, unknown or other
  misc_feature (732)..(732): n is a, c, g, or t
  modified_base (734)..(734): a, c, t, g, unknown or other
  misc_feature (734)..(734): n is a, c, g, or t
tcagagctcacgtacacgaccggtgctcgatttagcactcgcacgttgggtttggggccgcagccctgggattcccagctgtttctgcttgctgatcaggactgcacacagagagctcaccatggagtcgtgggctgagtcgttgggtttttccttgttcgtcttacgttttaaaaaggtcgtccagtgtgaggtgcgaggtagtggaggtcggggagtcttagttcagtccgtgggacgtccgtgacgtactcgtccgtgtgtagtctcgtaggaactcgtagtttacgacgttaccgttcgtggtactcgaccgtacgttcgggtaccccgaccgtaaaccgtaccggtaacggggtaaccgggacccgtaaccgggtaaccccgtggtaccgaccggtccgttacccgtacccgtaccgaccgtccccctaccgaaccggtaaccggcccctaaccgttcccggttaccccgttccccgtcggccccgtcccgtcgtacccgtacccgacggaccgtacccgtacccgtacgacgtaaccgaccgtaccgccggtaccccggtccccgtcggtcccgtcggtacccgttacgggtaacccgtaacggttaccctttacccggttaccgttaaccggtacgtaacccggttcgtacggtacggtaccgggcgggtaccgtacgggaacgtacggccgacgtagtcggatcgagcgnnnnnngcgnanngngn

SEQ ID NO: 163609 - DNA, 759 bp, Homo sapiens
  misc_feature: GYAE6OF01BMCIU.47.55.E11.1.454.CMB.1.raw
  modified_base (127)..(127): a, c, t, g, unknown or other
  misc_feature (127)..(127): n is a, c, g, or t
tcagagctcacgtacacgaccggtgctcgatttagcactcgcacgttgggtttggggccgcagccctgggattcccagctgtttctgcttgctgatcaggactgcacacagagagctcaccagtggngtcgtgggctggagtcgtttcgggttttctttgttcgtcttacgttttaaaggtcgtcagtggtggaggtgagtaggtaggtgggacgggtccgggggagtcttagttcgacggtcgtggggtacgtcctgacgtacctccgttcctgttgtacgtctcgtaggtaatcgttagttactacgttaccgttcgtaggtacgtgaccgtacggtccgggtaccccgaacctaaacggttccgggtaagggtacggggtccgttgggttcgggttcggtaccgtccgtaacgttaacgtactaacgtccgtaggtgtcggactaggttaagttaactaattgtacggcgtttacggtacggtgggacgtacgtcttacggacgtacgtacgtaccgtacggtaagaaccgtacggaaacgtaacgaacgttaacgttattacgtagttacgttaacgtaacggtaataagtaaccgtagtacgtaacggtagtacggtaacgtaacgttacgtacggtccttagtaacttgttacgtttagtttccgttagttccggttccccggttcgggttacccgggtccggtaccggttcggttaccggtaccggggaccggtaccggtacggtcggtacg

SEQ ID NO: 163610 - DNA, 762 bp, Homo sapiens
  misc_feature: GYAE6OF01EJ4P9.47.55.E11.1.454.CMB.1.raw
  modified_base (556)..(556): a, c, t, g, unknown or other
  misc_feature (556)..(556): n is a, c, g, or t
  modified_base (606)..(606): a, c, t, g, unknown or other
  misc_feature (606)..(606): n is a, c, g, or t
tcagagctcacgtacacgaccggtgctcgatttagcactcgcacgttgggtttgggggccgcagccctgggattcccagctgtttctgcttgctgatcaggactgcacacagagagcctcaccagtggagtcgtgggctgagtcgtttcggtttttaccgttggttcgtacgtttaaccgttttaaaaagggtcgtaccgtaggttggtagaggttgacgtagggtaggtcgggacgggtccgggggtagtacgttacggttccgacggtccggtacggggtaccgttccccgtaggtacgtaccgttccttccgttggttccggttaagttccgtacgtaggtaacttacgttacgtttaccgtaacgttccgttgtagtagtcgaccgttacggtccggtacccctaaccgtaaacgtccgggtaagggtacggggtcttagggtcggtacggtctacgtactactagaacttgcgtaggtcgtacgtagttagttaactaagtcgtcggtacggtacgtcggagggaccgggtctatcgagtcctactcgaanacgtaacacggaagtacgaagtactaagtgtacgtaagtcgtaaaagtanactagtaacgtacgtaggtaacgacggactaaacgcgggtactcgttactacgtactgttttcggtaaccgtttctgggttacccctttcgggccgggttacccgtacggttaccgggtaccgggacggtacccgggtaacgtccggttcggaccg

SEQ ID NO: 163611 - DNA, 692 bp, Homo sapiens
  misc_feature: GYAE6OF01BY6PU.47.55.E11.1.454.CMB.1.raw
  modified_base (208)..(208): a, c, t, g, unknown or other
  misc_feature (208)..(208): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagcccaccctcagcgtctcgggacccccgggnagacggtcaccatctcttgttctggaagcagcctaccaatatacggaaatgaattaagtgtatactgtaccagactaacgtccccaacgaacccggaccccaaactcctcatctataacatgatcgacgccgccctcgacgggtccctggccgtattccgtctggcctacgagtcgtcggcctccctacacgcccaccgtcggcccatcgagggtcgggacccgtcccgggacccgaggagttcggacggtccgttagtaacttttacgtttaacgttggttagggtttacgggttgggtacgtaccggaccgtacgtcccgttacggtaccgttacgttacccggtttaccgttcgttaccggggtaccgtccgggtacccgggtaaccggtaaccggttacccggtaccccgtttacccggtaccgggttacccgaacccggaccccccggtaaacgggtcccccctaaacccccgtaccgg

SEQ ID NO: 163612 - DNA, 821 bp, Homo sapiens
  misc_feature: GYAE6OF01BT0QH.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggttttccttgttgtcttacgttttaaaaggtgtcctagtgtgaggtgcgtaggtaggtggacggtccgggggagtcttaggttcaggccgtggggacgtccctaggagacttcctccgtgtgttagtcctcgtggaattcgtacgtttacaacgttacccttcgtaggtatcgtaccgaccggtccgggtaccccgtaacccgtaaaccgtcccggaaggggttaacggggcgttggggttacggtcgggttcctaccgtaccggttactaccgtaaactcccgtagtaagtcggtacgttagttagtttaaacttaaagttagtacggtaccggtacgtacccgggtgggaccggggtccgtagttaccgagtcctacgtccgtaccgaagtacggaaccgtaaacggactaaaggtaacgttaacgttaacgttaggttaactacggtaagggtaaacttacggtaaactaacgttacggtaaggaacggtacggtaccgtaacgttaacgtaaccgggtcttacggttaccttaacgttaccgttagttttacggtttacgttttccggtacgtttcccgggttccccggtttacccggggtcccgggttaccgggttaccgggtttcccggaccgggggtacccgtaacccgggggttaaccccgttccgggg

SEQ ID NO: 163613 - DNA, 694 bp, Homo sapiens
  misc_feature: GYAE6OF01B0X10.47.55.E11.1.454.CMB.1.raw
  modified_base (172)..(172): a, c, t, g, unknown or other
  misc_feature (172)..(172): n is a, c, g, or t
  modified_base (192)..(192): a, c, t, g, unknown or other
  misc_feature (192)..(192): n is a, c, g, or t
  modified_base (203)..(203): a, c, t, g, unknown or other
  misc_feature (203)..(203): n is a, c, g, or t
  modified_base (207)..(207): a, c, t, g, unknown or other
  misc_feature (207)..(207): n is a, c, g, or t
  modified_base (212)..(212): a, c, t, g, unknown or other
  misc_feature (212)..(212): n is a, c, g, or t
  modified_base (216)..(216): a, c, t, g, unknown or other
  misc_feature (216)..(216): n is a, c, g, or t
  modified_base (292)..(292): a, c, t, g, unknown or other
  misc_feature (292)..(292): n is a, c, g, or t
  modified_base (459)..(459): a, c, t, g, unknown or other
  misc_feature (459)..(459): n is a, c, g, or t
tcagagctcacgtacacgaccggtgctcgatttagcactcgcacgttgggtttggggagagaagacaggattcaggacaatctccagcatggccggcttccctctcctcctcaccctcctcactcactgtgcagggttcttgggcccagtctgtgctgactcagccaccctnagcgtcgtcgggaccccggnagacgtcaccntctnttgtngaancagctacaatagtacgaaatgataatgtatacgtggtaccagacaacgtcccaacggaacccgacccctaatcctnattcaactaactatcgtactccgaacggccgtaccctacggacggggttccctagggccgttattcctcgtcgtacctacgtaagttccgtcgggccctcctcgaccgtccctaccgtcggacctaagtccggagggtccgggaccgtcccgggaccgtaggtacgnggacggtctagtactttacgtagttggtaggttgggttagaccttcgcgttaacggcccttagggtaccttcggtacccgtttaacggttccgggttacggacggttaccggtacgggaacccttaacggggttcccacccgggttacgtaacggtccgaaccggaccccgtaacggaccccctaaaccgtcgttccggtaacccacccgtttccgttccccggtcccctacccg

SEQ ID NO: 163614 - DNA, 666 bp, Homo sapiens
  misc_feature: GYAE6OF01EMPUN.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggttttccttgttgtcttacgtttttaaaaggtgtccagtgtgaggtgcaggtgtggaggtccgggggagtcttagtcagccgtgggacgtccctgagactctcctgtgtagtctcgtaggtatcgtatttcagtacccttgtggatgcctagtcgggtccaccaacgtccgagggtagggctggtgtggtctcgacgtatacacgtcctaggatggactagttagttaaattaaagttgtcggtcggtaccgtcgggtaggaccggggtcgtaattccgagtactaacgtcccgtacccgaaggtaaccgaaccgtaaacgggactaaaggtaacgtttaactacgttagttactacgtaaggaaatacggtaactagtacgtgaaggtacgtagaaccggtagttacggccttagtacttagtacgtttagtttcggtttcgttacggtagtcccggttcccgttcgggtaccggttccggtacgtttccgggaaccgggacccgttacgggaccctcggg

SEQ ID NO: 163615 - DNA, 668 bp, Homo sapiens
  misc_feature: GYAE6OF01CM5NT.47.55.E11.1.454.CMB.1.raw
  modified_base (207)..(207): a, c, t, g, unknown or other
  misc_feature (207)..(207): n is a, c, g, or t
  modified_base (237)..(237): a, c, t, g, unknown or other
  misc_feature (237)..(237): n is a, c, g, or t
  modified_base (608)..(608): a, c, t, g, unknown or other
  misc_feature (608)..(608): n is a, c, g, or t
tcagagctcacgtacacgaccggtgctcgatttagcactcgcacgttgggtttggggagcttcagctgtggtagagaagacaggattcaggacaatctccagcatggccgcttccctctcctcctcacctcctcactcactgtgcagggtcttgggcccagtctgtgctgactcacgccaccctcacgcgtcgtcgggacccccggnagacggtccaccatctcgtttgtctaggancagctaccatagtcggaaatgataatgtatactaggtaccagaccaacgtccccaacgaacccgaccccctaaactcctacactacaactaaactaagtgaatcgacgcccggtcctaccgcgggttcccctggccgtactttcgtacgtcggtcctacccgaagttcgtcggtccctcctcgaacccgcccgtaacccgtcggacctacgtaccggaggtacccggggtcccgtaccccgggtacccggagggtaccgtacgggacggtcgttacgtaacgttttaactttcggttacggttagggtttacggggttcggaacgtccggacgtacgccgttgacgttcgtaccgttacggtccgtacggnggtacgtcggaccgacgttccacccgtgtacgtacaccggtacccacggcccaaccgtcg

SEQ ID NO: 163616 - DNA, 722 bp, Homo sapiens
  misc_feature: GYAE6OF01BJ0P7.47.55.E11.1.454.CMB.1.raw
  modified_base (476)..(476): a, c, t, g, unknown or other
  misc_feature (476)..(476): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggtttttccttgttgcttacttttaaaaggtgtcctagtgtgaggtgcaggtagtgggacggtccgggggagtcttagttcaggccgtgggggactcccgtgacgtactctccgtgtgtacgtctcgtaggaattcgtagtttcacgttaccttcgtggatgctacgtcgggtacccaccctaaacgtccggaagggtaacggggcttggggtcgttcgggtctaccgtagtactacgaattccgtagacgtggactaagttagtttaaattaaagtttacgtcggccggtaccgttacggtacgggacggggtacctattccgacgtccgtntacccgtaccgaaggaaccgaaccgtaaaccggagaaacggtacgtaacgttaccgtattacgtaacgtaaggtaaactagaaactaagtcgtaagaacggtcggtaaccggtaaccgtagtaaccggttcgtacgttcgtattccgttagtttcggtttacgtttcgtactccgggtttcccggtaccggtcgggtacccggttacgttaccgggaccgggaacccgttacgggtaccgttcggg

SEQ ID NO: 163617 - DNA, 749 bp, Homo sapiens
  misc_feature: GYAE6OF01AQQ8P.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggaggtccgggggaggtcttagttcagccgtggggagtccctgagacctctcctgtgtagtctctggaatctagtttcagttaccttcgtggatcgctacgtcgggtcccgacccaaaccgtccgaagggtaacggggcgtgggtggtcgggtctacgtacgtatacaactccgtgtagtggtacgtagttagttaaattaaattagtcggtacggtaccgtccgggtagggtacgggggtaccgtaacgttccgagtacctaacgtcccgtaaccggaacggtaacgaaccgaacggtaacgtaaaggtaagttaacgttacgttagttaacgtacgtaaggtaaataacgaaacttacgtacgtaggtaacggtacggtacggtaacggtacgttacggtacttacggttacttaagttccgtttaagtttcggttttacggttttccggaagtttcccggttaccccggttttccggggtcccggtaccggggtttaccgtttccggggtaccgggggtaaccccggttaccggggttaaccccgttccgggg

SEQ ID NO: 163618 - DNA, 684 bp, Homo sapiens
  misc_feature: GYAE6OF01EJIJ1.47.55.E11.1.454.CMB.1.raw
  modified_base (132)..(132): a, c, t, g, unknown or other
  misc_feature (132)..(132): n is a, c, g, or t
  modified_base (448)..(448): a, c, t, g, unknown or other
  misc_feature (448)..(448): n is a, c, g, or t
  modified_base (627)..(627): a, c, t, g, unknown or other
  misc_feature (627)..(627): n is a, c, g, or t
  modified_base (631)..(631): a, c, t, g, unknown or other
  misc_feature (631)..(631): n is a, c, g, or t
  modified_base (652)..(652): a, c, t, g, unknown or other
  misc_feature (652)..(652): n is a, c, g, or t
  modified_base (657)..(657): a, c, t, g, unknown or other
  misc_feature (657)..(657): n is a, c, g, or t
  modified_base (661)..(663): a, c, t, g, unknown or other
  misc_feature (661)..(663): n is a, c, g, or t
  modified_base (665)..(665): a, c, t, g, unknown or other
  misc_feature (665)..(665): n is a, c, g, or t
  modified_base (667)..(667): a, c, t, g, unknown or other
  misc_feature (667)..(667): n is a, c, g, or t
  modified_base (669)..(669): a, c, t, g, unknown or other
  misc_feature (669)..(669): n is a, c, g, or t
  modified_base (671)..(674): a, c, t, g, unknown or other
  misc_feature (671)..(674): n is a, c, g, or t
  modified_base (678)..(678): a, c, t, g, unknown or other
  misc_feature (678)..(678): n is a, c, g, or t
  modified_base (680)..(682): a, c, t, g, unknown or other
  misc_feature (680)..(682): n is a, c, g, or t
tcagagctcacgtacacgaccggtgctcgatttagcactcgcacgttgggtttgggggccgcagccctgggattcccagctgtttctgcttgctgatcaggactgcacacagagagctcacagtggagtcgnggctgagtcgtttgggttttccttgttcgtactttaacgttttaaaaggtcgtacgtaggtggtggaggtgcgtaggtaggtgggacggtcggggagtcttagtcgagtccggtgggacctccgagtacaccttcgttcgtggttacgttacgtccttcgtaaggtaacttcgttacgtttacgtaaccgttaccttcggtacggtaattcggaccgtaacggttccgggtaacccctaaaccgtaaccgtccgaacccgtcccgtaccccgaaacggtaccggtcccttacggtacccgtttccccgttacccgnggtcccctaccgtcgtaccgacggtacgacctaccgtaccgacggtagacctacggacgtacggcccgggtcctcggctccgtacgtacgtaaacggaacccgtttaccttaccggttacgaccgtaggtcctacgttgggaggaccgggtcggtacctagggaaccgtagccgttaanacgngtacgctacgagctaagccgngacgntagnnngngngnannnngtcnannngc

SEQ ID NO: 163619 - DNA, 761 bp, Homo sapiens
  misc_feature: GYAE6OF01AI7JA.47.55.E11.1.454.CMB.1.raw
tcagagctcacgtacacgaccggtgctcgatttagcactcgcacgttgggttttccttgttgctcttttaaaaggtgtccagtgtgaggtgcaggtagtggagtccggggaggcttagttcagcctggggagtccctgagactctcctgtgtagtctctggaatctagtttcagtaccttctggatgcacgtcgggtcccgccaaactccgaggtaagggctggtgtggtctcacgtatcaatcctgagtggctagttagttaataaattgtcggcggaccgtccggtggaacggggtccgtagttcagtcagtcctaccgaggacgaacgaacggcaaagtagtactacgtgtatcgtaaggaaactagaaactagtcgtaggaagtacggtacgaacgtaacgtacggtcgttagtcttagtcgttagtttggttcgttttacgattccggttccgttccgggtccggccggttacgtccgggtcggggacccgtaacgggtacccctggtacgtacggtccgttccctcctcccgaccgtacccccgttaccgaacccggaacccgggtccccttacggttccccggttaccccgttcccccgggtggtcccccgttcccgtaccgtcccgtaacccggacgggaccgttaccccgaacccggtaccggaacggtaccgacccggtacccggtaccggccccgggttcccggtcgggtaccctccggggtacccttaccggggtaaccgtaaacccgg

SEQ ID NO: 163620 - DNA, 803 bp, Homo sapiens
  misc_feature: GYAE6OF01AWO36.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccagtggagtcgtgggctgagtcgtttcgggtttttccttggttgtaccttaacgtttttaaaagggtcgtccgtaggtgtggaggtgcgagggtaggtgggacgggtccgggggagtcgttaggttcgacggtccggtaggggtacctcccgtaggtaccgtaccgttccgttccgtttggttaggttacgttcgttacgttaggtaacttcgttagttttccgtaccgtttaccgttggtggactcggtaccgtaccggttccgggtaccccaacccgtaaaccggttccggaaggggttacgggtcgttgggtcggtcggttacctacgtacgtactacgtactccgtaggtacgtcggtatagttaagttaattaagttacggtcggtaccggtacggttaccgggaggggtaccgggtaccttagtccgacgtctacgttaccacgaagaccgtaacggaacgtaacgtaagtagttacgttacgtaggttacgagttaaacggaatacgaacgtacgtacgtaggacgtacggtaacgtacgtagtacgttgttaccgtagttattacgttaggtttacgtttcgttacgtccggttaccggttcccggttaccgggtacccggtacgggtcccggtttacgggacccgggttaccgtaaccgggtcccgttacggg

SEQ ID NO: 163621 - DNA, 835 bp, Homo sapiens
  misc_feature: GYAE6OF01CGSPR.47.55.E11.1.454.CMB.1.raw
  modified_base (398)..(398): a, c, t, g, unknown or other
  misc_feature (398)..(398): n is a, c, g, or t
tcagagctcacgtacacgaccggtgctcgatttagcactcgcacggttgggtttggggagcttaagctgtggtagagaagacaggattcaggacaatctccagcatggccggcttccctctcctcctccaccctcctcactcactgtgcgagggtcgttgggcccagtctgtcgctgacctcacgcccaccctcgacgccgttccggtccggggacccccgggcacggaccggtccaaccacttcttctttcggttcgtagggaacgccaacgccttaccaaattacggtaacggaaaatgtaaataagtgttaactacgtacggtaaccaagaccgtaacgtacccgaccggaaccccgacccccaaactcctactactacctaaagaactaagtanacgtacgacggccgtcccgacgggtaccgggtccctcggaccgttacgttctaccgtcgtacctaccgacggtcgccggtaccctcctaccgaccggcccgtacccgtacgcccgttaagtacccggacgggtccccgggacccgtcccggggaaacccggtgggtaacgacggtacgggtaccgttagtttaactttacgttacgggttagggtttacggtttaagggggtttccggacgttaccggacgtacccgggttaccgtaggtttaccgttcgggtttacccttacgggtttccggtggggtaacccgtacgggttaacccggtaaacccggttacggttaccccggttcccgggttaaccccgtaaacgggtccccgaaacccgaaaccccggtaccccggaacccccttaccccgtacggttacccgg

SEQ ID NO: 163622 - DNA, 827 bp, Homo sapiens
  misc_feature: GYAE6OF01BTSXM.47.55.E11.1.454.CMB.1.raw
  modified_base (192)..(192): a, c, t, g, unknown or other
  misc_feature (192)..(192): n is a, c, g, or t
  modified_base (218)..(218): a, c, t, g, unknown or other
  misc_feature (218)..(218): n is a, c, g, or t
  modified_base (261)..(261): a, c, t, g, unknown or other
  misc_feature (261)..(261): n is a, c, g, or t
tcagagctcacgtacacgaccggtgctcgatttagcactcgcacgttggggtttggggagcttcagctgtggtagagaagacaggattcaggacaatctccagcatggccgtcttccctctcctcctcaccctcctcactcactgtgcgagggtcttcgggcccagtctgtgctagactcacgcccaccctnacgtccgtcggtccggggacccccgngtacgaccggtccacctattccttccgttgttaccgaggaacncagtcctactaagttacgacggtaaatgtaattaacgttagttaactacgtacggtaaccacgaccgtaaccgtaccccgaaccggaaccccggaaccccctaaactccctacctactaccgttaataactacagactcgaacggccccggtaccttaccggggaccgggttcccgccggtaccgttacgtttccgccggtaccgtaccccgttaccgtaaggttcccgggtaccgggccctacccgttaccgacccgaccccgtacccggtacgacccgttaacggtacggaccgggtccggggtacccccgtacccggggaaccggtacggtcgttaacggggacgttccgttaacgtttaaccttttaagtttccggttaagggttcggggtttaggtacgggtaccgtacggtacgtacgggtacccgttacggttcgttacggttacccgttacgggttcggtaccggtaccggttacggaaccgggtaaccttccgggtacccgttccgggacgtcggtaaccccgacggtacccctacccggtaccccaccgttacccg

SEQ ID NO: 163623 - DNA, 796 bp, Homo sapiens
  misc_feature: GYAE6OF01E3PGV.47.55.E11.1.454.CMB.1.raw
  modified_base (176)..(176): a, c, t, g, unknown or other
  misc_feature (176)..(176): n is a, c, g, or t
  modified_base (296)..(296): a, c, t, g, unknown or other
  misc_feature (296)..(296): n is a, c, g, or t
  modified_base (381)..(381): a, c, t, g, unknown or other
  misc_feature (381)..(381): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagcgttggttttccttgttgtcttacgttttaaaaggtntccgagtgtgaggtgcgaggtaggtggaggtccgggggaggtcttagtcgagccgtggggactccgtgagacctctctgtgtagtctcgtagtatcgtacgttcacgttaccttcgtagntgctacggtcggtaccaccgtaaacgtccggagggtacgggcgtgggtggtcgggtctcgaacgttatacgaactccgtgtacgnggtactaggtttaacgtttaaagttaaacttaggtacggtacccgggtacgttccgggtaacgggggtaggggtacccgttagttaccgtacggtactaccgtaccgtaccgaacgtaacggtaaaccgaaaccgggtaaacgaaaggttaacggttaactttaaccggtgttaacgttaaccggtaaaggtaaacgaactaaaccgtagttaccggtaaggaaccggttaacgtaccgggtaaaccgtggttaaacccggttcgtttagttaaccgttgttacgtttagtttggttttacggtttccgtaccggtttcccggtccccgggttttccgggtacccgggtttacccgggttacccggttaacggggtaccccgggtaacccgggttaaccggtacccggttccggg

SEQ ID NO: 163624 - DNA, 661 bp, Homo sapiens
  misc_feature: GYAE6OF01BOKYN.47.55.E11.1.454.CMB.1.raw
  modified_base (209)..(209): a, c, t, g, unknown or other
  misc_feature (209)..(209): n is a, c, g, or t
  modified_base (325)..(325): a, c, t, g, unknown or other
  misc_feature (325)..(325): n is a, c, g, or t
  modified_base (374)..(374): a, c, t, g, unknown or other
  misc_feature (374)..(374): n is a, c, g, or t
tcagagctcacgtacacgaccggtgctcgatttagcactcgcacgttgggtttgggagcttcagctgtggtagagaagacaggattcaggacaatctccagcatggccgcttccctctcctcctcaccctcctcactcactgtgcagggtcttgggcccagtctgtgactgactcacgccaaccctcgagccgtctcgggacccccggnacgacggtcacctatctcttgttctggaagcagctccaagtatcggaaatgataagtgtatactggtaccagacaacgtccccaacgaaccggcccccaaactcctacatacgtanaactaactgatcacgccggcctcgaaccgggtcccacggccgtacttcnccgtcggactaccgaacgtcgtcgcccgtcctacaccggtcccaccgtcggaccctacgtaccgtaggtccgggcccttcccgggacccggaagtagtcggtacggtacttgtaagtttaactttacgtggttacgggtaggtttcggacgttccggacgtacgttccccgtagtactcgtaccgtttaccgtcgttccgggtaggtccgttacgggacctaacgggttcccaacccggttcgttaacggtcaacccggacccgaaccggaccccctacccgtaccg

SEQ ID NO: 163625 - DNA, 774 bp, Homo sapiens
  misc_feature: GYAE6OF01DSZYF.47.55.E11.1.454.CMB.1.raw
tcagagctcacgtacacgaccggtgctcgatttagcactcgcacgttgggtttgggggccgcagccctgggattcccagcttgtttctgcttgctgatcaggactgcacacagagagctacacagtggagtcgtgggctgagtcgttggttttctgttcgtacttacttttaaaggtcgtcgtagtggtgtaggtgtagaggtaggtgggacgggtcgggggagtcgttagttcgacggccgggtagggtactcccgagactaccgttcgtaccgtgttagtcggttcttacgtaggtaacttcgttagtttaccgacgtttaccttacggtcggtacgtcggacgtcggtacccgggtacccctaacccgtaaaaccgtcgggtaaggggtacgggtcggtggggttcgtcgggttactacgtaacgttagtacctaacgtcgtgtagtgtacgttagttaattaaataacgtgcggtacgtcgtcgggtaggtacggtactacgttcgacgtactacgtaccgtacaacgggtacgaaacgacggtaaacgttaaggtacgttaacgttaagtttacggttaagtaacggtaagtaaactacggtaacttaacacgggtaagtaaggtccggtaaaccggtacgtacggttaacggtctttagttacctaagtttcggttgttttggttaaccgttcggttacgttaccggttcccgggttacggttccggaccgggttacggcgggtacggacccggtagttaccggtcgg

SEQ ID NO: 163626 - DNA, 895 bp, Homo sapiens
  misc_feature: GYAE6OF01E3CTA.47.55.E11.1.454.CMB.1.raw
  modified_base (774)..(774): a, c, t, g, unknown or other
  misc_feature (774)..(774): n is a, c, g, or t
tcagagctcacgtacacgaccggtgctcgatttagcactcgcacgttgggtttggggccgcagccctgggattccagctgtttctgcttgctgatcaggactgcacacagagagctcaccatggagtcgtgggctgagtcgttcggttttccttggttgtctttacgttttaaaaggtcgtaccgagtgtaggaggtgacgtaggtaggtgggaacggtccgggggaggtcttaggttcaggtccgtggggactcccgtaggacgtacgtcctccgttgttacggtacgtctcgtaggaacttcgtagtttcgtacgttacttcgtaggtactcgtacgtaccggttcgggtaccctaaccgtaaaccgtcgggtaacggggttaacggggttccgttacggggtttacgggttccgggttacctaaccggttaaacggttactaaccgttaaacgttcccgtaggtaacgtagggtaccttaggtttaaacgtttaaacgtttaaaacgttcggtacgggtaacccgggtacgttccgggttaacggggaccgggttaaccgtacttaccgaacggtccttaacggtacccctaacggaaacggtaaccggtaaacccgggtaaaacggtaacctaaacgggttaagtttaaacgttaccggttaagttaaccgtaacggttaaaggtaaaaccgtacggtaaactaacgtcggtaggaaccgttacggtaccgaacggttacgtacggtaccgttaggttacaacccgtttntttaacggtttgtttaccgttaccgtaacggttcccggttacccggtttcggggttaaaccccgtgggtttaaaccccggttcgggaaccggggtacccgtaacccgggtttcggtacggg

SEQ ID NO: 163627 - DNA, 843 bp, Homo sapiens
  misc_feature: GYAE6OF01D1YRN.47.55.E11.1.454.CMB.1.raw
tcagagctcacgtacacgaccggtgctcgatttagcactcgcacgtagggtcttgggcccagtctgtgctgactcagccaccctcagcgtctcgggacccccggcagacggtcaccatctcttgttctggaagcagctccaatatcggaaatgataatgtatactgtaccagcaagtcccacgaaccgccccaaactcctcatctatacgaataatcagccgtcctcgacgggtccctagaccgtattcgtcgtcggcctaccgaagtctagaccacctcgacgtccctcccgtggccatcgaggtcgggccgttccggtccggaggtagtcggacggtcttaggtatttactttagttgtacgacgaacgtagtgggaattacggtacgtaccgttaggtaacggttaggtttcgggtttacggggttttaccggggaccggggtaaacgggtaaaccccgtaaaacggttaccggtaaaccccgggtttacccgttaacggggtacccgaacccgggtaacccccggtaaacgggtccccgttacccccgggtaacccccccggtttccggttaacccgttaaccccgtttcccgttttaccccgggttttacccccccgttttacccccctaacccccggtttccccgtttaccggttttacccgggttacgtaacccggtttcgttaccccggttaacgggtaccggggtcccggggttaccgggttaaccgggaaccggtaacccggggtacccgtaacccgttaaagggtaacggccgtacgtaacgtccggtaagtacgtcgacgtacgtacgtacgtacgtacgtactcgcgacg

SEQ ID NO: 163628 - DNA, 950 bp, Homo sapiens
  misc_feature: GYAE6OF01DDJMZ.47.55.E11.1.454.CMB.1.raw
  modified_base (127)..(127): a, c, t, g, unknown or other
  misc_feature (127)..(127): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggngtctggctgagtcgttgggtttttccttgttcgtacttaacgtttttaaaaggtcgtaccgtaaggttgtaggagggttagacgtaagggttaggtcgggaacggggttcccggggggaacggttcgtttaacggttccggaacgggtcccgggttgggggtaaccgttccccgtagggtaaccggttacccttccgttaccccggttggtttaggttaccggtttccgtccggtttaaaggaaccgttacgttaacggtttttaccgaaccgttttacccttcggtaggtacgttacgaccggtacgttccgggggtaccccaaacccgttaaccggtaccgtaacggggtaagggtcgttaggggttggttcggttactaccgtagtaactagtaacctccgtaggtaagtggtacgttaaggttaaagttttaaactaaagtttacggcggttacggtaaccgtacggtacgggccggggtaccttagtacgtacggactaccgtaccacggaacggtaactaaccggaaaggtaccgaaggtaaaccgttatttaacgagttaacggtaacgttaagaaagttaacgtaaacagtttacgaagtaagggtacgtaacggacccgttaagttacccggtatttacccggactttaaacttaggtttaccggttttagggtttaccgtttacggtttacccgtttacccgggggttcccttttccccggggggaccccgggttttaacgggttacccgggtttacccggggtaaacggggtacccccggttaaacgggggtaccccgggtttaaccccggg

SEQ ID NO: 163629 - DNA, 918 bp, Homo sapiens
  misc_feature: GYAE6OF01EUI0M.47.55.E11.1.454.CMB.1.raw
tcagagctcacgtacacgaccggtgctcgatttagcactcgcacgttgggtttgggggccgcagccctgggattcccagcttgtttctgcttgctgatcaggactgcacacagagagctcacagtggagtcgtgggctggagtcgtttcgggttttcctttgttcgtactttaacgttttaaaaggtcgtaccgaggttgtaggtaggtagtacggtagggttagggtacgggtacggggttccgggggtacgttacgtttaacgttacgtaccgggtccggttacggggtaccgttacccgtaggtacgtaccttccgttaccgttagttacgttacggttacgttacgttaaggtaacgttcggttacgttttaccgtaaccgtttaaccgtttcggtaggtactcgtaccgtaccggttaccgggtaaccccgtaacccgtaaaccgtaccggggtaaggggttaacggggtccgttggggttacgggttcggttacctacgtaacgttactaccgttaacgttcgtaggtacgtcggtaacttaggtttaagtttaaataaacggtttagtaccggtaacggtaccggtacgggtacgggacgggtaccgtacgtacgacgtattacccgtacgaccgtaagaacgtaacgtagtacggaacttaaggtacttaacgttaagttacgtaacgtttaacgaaagtaaaggttaaccctaagttagtaaccggtaaaggttaccgaacggggtaacgtaaccggtaacgtccgggttacttagttacctttaggtacgtttaggttttagttcccgttagggtacgttccccgggtttaccgggttacccgggtaccgggttaccgggtttacccgggaggggtttaaccccgggaacggtcccggggttaacccg

SEQ ID NO: 163630 - DNA, 768 bp, Homo sapiens
  misc_feature: GYAE6OF01DIRXY.47.55.E11.1.454.CMB.1.raw
  modified_base (174)..(174): a, c, t, g, unknown or other
  misc_feature (174)..(174): n is a, c, g, or t
  modified_base (193)..(193): a, c, t, g, unknown or other
  misc_feature (193)..(193): n is a, c, g, or t
  modified_base (218)..(218): a, c, t, g, unknown or other
  misc_feature (218)..(218): n is a, c, g, or t
tcagagctcacgtacacgaccggtgctcgatttagcactcgcacgttgggtttgggggagagaagacaggattcaggacaaatctccagcatggcccggcttccctctcctcctcaccctcctcactcactgtgcagggtcgttggcccagtctgtgctgactcagcccacctnagcgtctcgggaccccggnagacgtcaccatctcttgtctggancagctaccaatatacggaaatgaataaagtgtatactaggtaccagacaacgtcccaacgtaaccgaccccaaatcctacatactataacaatgatcacgccgcctacgacgggtccctggtaccgacttctacgtggactacccgaagttccgtacggccgtccctacaccggcccctaaccccgtccgggtaaccctacgttaaccggtacggtaccgggggtccctaccccggggtaccccggaagggtaactcgggaaacgggtccttaagtaaaccgttttagttaccgttaggttagggttacgggtttagggacgttccgacgacgtccgttacgacgtttacggtacctttaacgggttcctttacgggaacgttcggtaccggggtaaacccgaaacgggtttaccccgacccggttaccggtttaacgggacccgtaaacccgggtcccgtaaaaaccccgggacccccctaaaaccccggtaacccgttgttaaccccctaccttttacccggttcccgtttaaccccccctaaccccg

SEQ ID NO: 163631 - DNA, 753 bp, Homo sapiens
  misc_feature: GYAE6OF01BJGQR.47.55.E11.1.454.CMB.1.raw
tcagagctcacgtacacgaccggtgctcgatttagcactcgcacgttgggtttgggggaagaggaagactgacggtcctgccacaggtggtgctgggcacggtgggcactcgacacaacatttgcgctcaactgtcttgctcaccatggagtctgggctgagcttgggttttccttgttgcttacttttaaaaggtgtccagtgtgagtgcaggtagtggaggtccggggagtcttagtcagccgtgggatcctgagtctctctgtgtagtctctggtaatcgtagtttctagttaccttctggtatcggtctaccggttcgggtacccaccgtaaacttccgtaagggtaacggggtccgttagggtcgttgggttcctacgtaacgttatacctaattccgtagtacgtgggtacctagggtttaacgtttaaattaaaacgtttacgtcggtaccggtaccgttccgggtagggaccggggtaccttaacgtacgtagtacctagtcctacggtaaacgacgtaacccgtaacggaccgtaaagtaccgttagttaaccgtttggtaaccgttacggtaacggtaaaacgttaggtaaacctaagtttaccggtaaggaacggttacggtaaccgtacggtaaaccgttccgggtaacttcggttacttaacgttaccgttagtttgggtttaccgttttaccgtaacttcgggttaacccgtttccggggtcccgtggggtttaacccg

SEQ ID NO: 163632 - DNA, 826 bp, Homo sapiens
  misc_feature: GYAE6OF01C1O0V.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccagtggagtcgtggctgagtcgttgggttttccttgttgtcttacgttttaaaaggtgtccgagtgtggaggtgcgtaggtaggtggacggtccgggggagtcttagttcgaggtccgtggggtacgtcccgtaggacgtaccttcgttccgttggtcgttagtcttcgtaggtaacttcgtagttttacgtacgtttaccttcgtggtaatcgtaccgtacggtccgggtaccccgaaccgtaaaccgtccggtaaggggtaacggggtcgttgggttcgggtcggttacttaccgtaacgtttacgtaccgtaacttccgtagtacgtggtacgtaagttaagtttaaattaaagttagcggtaccgtacgttccgggtaggtacgggaccttagtacgacgtactacgttccgaacgaaggaacgaaccggtaagacgtaaagttacgtaacgttacgtgtaaagttacgtaaggtaaactacgtaaacgtacgttaggtaggtaacgttaccggtaacggtaaccgaggttaccgttccgttaggttacttaacggtttaccgttaggtttttaccgggttacgtttccggtaccggttttacccgggttccccggtttacccgggggtacccgggttacccgggtttacggttaccgggggcccgggttaaaccccgtaccggggttaacccgttccggg

SEQ ID NO: 163633 - DNA, 672 bp, Homo sapiens
  misc_feature: GYAE6OF01BIU3B.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagaggagctcaccatggagtctgggctgagcttgggttttccttgttgctcttttaaaaggtgtccagtgtgaggtgcaggtagtggagtccggggagcttagtcagccgtggggactcctgagactctcctgtgtagtctcgtaggatctagtttcacgttaccttcgtggatcgactacgtcgggtccccaccaaaccgtccgaagggtaacggggtccttagggttggtcgggtctcgacgtactacaacttcctagtatcggactaggttagtttaattaaagttgtcggaccggtacgtccggtagggacgggtcctagttcgagtactactccgtacgaaggtaacgaacgaacggaacgtaagtagttacgtacttagtaactacgttaaggaaatacgaactaagtcgtaggacgtaggtaccgaagtacggtacgtctacgttacgtatcttagtttcgttagtttacgtattccggtcccggttcccgggtacccgggtcggttaccgttacgggaccgggggtacccgtaaccggggttacccgttacggg

SEQ ID NO: 163634 - DNA, 756 bp, Homo sapiens
  misc_feature: GYAE6OF01AWNDK.47.55.E11.1.454.CMB.1.raw
  modified_base (205)..(205): a, c, t, g, unknown or other
  misc_feature (205)..(205): n is a, c, g, or t
  modified_base (349)..(349): a, c, t, g, unknown or other
  misc_feature (349)..(349): n is a, c, g, or t
  modified_base (749)..(749): a, c, t, g, unknown or other
  misc_feature (749)..(749): n is a, c, g, or t
tcagagctcacgtacacgaccggtgctcgatttagcactcgcacggttgggtttgggggaggcttagttcagcctggggagtccctgagactctcctgtgtagtctctggaatcagttttcagttaccttctggatgcacgtcgggtccgccaaactccgagggtaaggggctggtgtgggtctcacgtatcaatcctgagtggntagttgttaataaattatggcggtacctccggtgggacggggccgtattcgagctactcctaccgagagaaccgaacggacgaagagtatactgtactcgtaggaaatacgaaacaatcgtagagaggtcgaacgagtaccggnttagtctagttctagtttgtttagttttcgacgttcgtcccggttccgggtccggtcggttacgtttcgggacggggtacccgtaacggggtaccctgggtaccgacgttcccgttcctacccgtacgtaccgtcccccttaaccgaacccggtaacccggtcccgtacggttaccccggtttcccccgttaccccggtccggcccccgttcccgtaccgcccgttaccgacggtaccgacccgtacccgtacccggagaccgacccgtaaccgaccggtcccgggtacccggtgggtccgtacggtcccgtacgggtaaacgtaccgggtacccttaccggtttccccgaaggttcccgagttacctcggtacgacgggcggtcgtacggacgaccggngacctag

SEQ ID NO: 163635 - DNA, 807 bp, Homo sapiens
  misc_feature: GYAE6OF01BX6FX.47.55.E11.1.454.CMB.1.raw
  modified_base (447)..(447): a, c, t, g, unknown or other
  misc_feature (447)..(447): n is a, c, g, or t
  modified_base (651)..(651): a, c, t, g, unknown or other
  misc_feature (651)..(651): n is a, c, g, or t
tcagagctcacgtacacgaccggtgctcgatttagcactcgcacgtttgggttttccttgttgctacttttaaaaggtgtccagtgtgaggtgcaggtagtggaggtccggggaggcttagttcagccgtggggagtccctgagacctctcctgtgtagtctcgtaggaatctagtttcagttaccttgtggatgcacgtcgggtacccgaccaaacgtccggaagggtaagggctgggtggtcgggtctacgtaacgttataccgaatccgtagagtcggactaggttagtttaaactaaattgcggacggtaccgttccggtaggacgggtcctattcgacgtctagttccgacgaagacgaacgaacggagaagtacgtaactacgtagtactagtaagtaaatacgaaactagtcgtaggagtacgacgaacgtagtacggtnttacgtacgtattacgttagtttcggtttacgtttacgacgttccggtttccgggttaccgggtcccggagggtttaacccttcggggaacccgggtaccgtaacggggtcccttaggtacgaccggttcctacctcccgacgtaccgtccctaaccgaaccggtcccggaccttccgggttccccgttacccccgttcccggnggtacccccgtccctacgggtacccgtaaccggaacgggtaccctcccgtaaccccgggacggtaaggaccccgtacggtaccccgggacccggttcccgggcccggtttacgggctttaacccggggccgttaagggtaaaccccgtaaacccgg

SEQ ID NO: 163636 - DNA, 768 bp, Homo sapiens
  misc_feature: GYAE6OF01COTUZ.47.55.E11.1.454.CMB.1.raw
  modified_base (188)..(188): a, c, t, g, unknown or other
  misc_feature (188)..(188): n is a, c, g, or t
  modified_base (208)..(208): a, c, t, g, unknown or other
  misc_feature (208)..(208): n is a, c, g, or t
  modified_base (217)..(217): a, c, t, g, unknown or other
  misc_feature (217)..(217): n is a, c, g, or t
  modified_base (221)..(221): a, c, t, g, unknown or other
  misc_feature (221)..(221): n is a, c, g, or t
  modified_base (226)..(226): a, c, t, g, unknown or other
  misc_feature (226)..(226): n is a, c, g, or t
  modified_base (231)..(232): a, c, t, g, unknown or other
  misc_feature (231)..(232): n is a, c, g, or t
  modified_base (242)..(242): a, c, t, g, unknown or other
  misc_feature (242)..(242): n is a, c, g, or t
  modified_base (249)..(249): a, c, t, g, unknown or other
  misc_feature (249)..(249): n is a, c, g, or t
  modified_base (256)..(256): a, c, t, g, unknown or other
  misc_feature (256)..(256): n is a, c, g, or t
  modified_base (269)..(269): a, c, t, g, unknown or other
  misc_feature (269)..(269): n is a, c, g, or t
  modified_base (327)..(327): a, c, t, g, unknown or other
  misc_feature (327)..(327): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcacgccaaccctnagtcgtcgccgggacccggnagacgcacntctnttgtnagganncgctacatanacgaatnaatactnttactctcgtacngacacctacccgaacgacccgtaccccaactccactaactactaaacaactaacgtanaaccgtcgaccggcccggtacccgtacgggtaacccgggttccgtacggtccggttaacttccgtacgtacggtccctaacgtaacgttccggtacgccgtccccgtagaccctacccgtaccgtcgtacctacgtaccggtcggtaccggtcccgtacccggggaccgtacggtacggacggtaacgtccgttaaggttacttacggttacggtaggttccgggttaaggttcggggaccttaccggcgtacggttacctacggttaccgtcggtttaaccgttaccggttcccgggttcggtacggggtaaccggttccgggttaaccggttaaacccgggttcccgggttaaaccgttaaccgggtttaccccgggtaaacccgtaacccccgggtaaacggtaacccccccggtaaacccgttcccggttaaacccg

SEQ ID NO: 163637 - DNA, 700 bp, Homo sapiens
  misc_feature: GYAE6OF01BED5R.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggagcttagtcagcctggggactccctgacgactctcctgtgtagtctctggatcagtttcagtaccttctggattgctactcgggtcccgcctaaaaccgtccgaagggtaacggggcttcgggttggttcggggtctccgacgttactcaaacgttccctgtaacgtgggacctaaggttagtttaattaaaagtttatcggtacggtaccttccgggtacgggacggggtcccgtaattaccgaggtacctacgttccctaccgaacgaacggaaccgaaacgggaccgtaaaggtaacgttaaagttaaccgttagggtaactttaaccggtaaggttaaaacgtacgtaaaccgtaagttcgtaagagtaacggtacgtaacgtaagtacgtctacgttctacttacgtagtttcgttcgttttcgagttcgtcccgttcggtacccgggtcggtacgttccgggtgggcccggtaagggtacccggttcgg

SEQ ID NO: 163638 - DNA, 730 bp, Homo sapiens
  misc_feature: GYAE6OF01ANB7P.47.55.E11.1.454.CMB.1.raw
  modified_base (195)..(195): a, c, t, g, unknown or other
  misc_feature (195)..(195): n is a, c, g, or t
  modified_base (219)..(219): a, c, t, g, unknown or other
  misc_feature (219)..(219): n is a, c, g, or t
tcagagctcacgtacacgaccggtgctcgatttagcactcgcacgttgggtttggggagagaagacaggattcaggacaatctccagcatggccggcttccctctcctcctcaccctcctcactcactgtgcagggtcttgggcccagtctgtgctgactcacgccaccctcagccgtcgtcgggacccccgggnagacggtccaccatctcttgttcnggaacgcagctaccaatacgtcggaaatcgaattaagtgtaactacgtgtaccagcaacggtcccaacggaaccgaccccaaactcctacatcaataacgatgatacagccgcctcgacgggtccctggctacttctcgtcggcctaccgaagtccgtcgggccctccgtacgaccggccctacccggtggacccaattcgaacgggttcgggcccgtcccgggacccgagggtacgtacgggtacgcgttagtaactttacgtttaacgtgttacgggttacgggttaggaaccgttcgggactacgggtcctacggacgtttacgggtacccgttttaaccggtcccgtttagggaccttcgggtaccgggaaccgttaaacggtcctaaccccggtacgttaaccgggtaccaacccggttacccggaaacccgggtaccccttaaacccccgacgtttcccggaacttccccgtttaccgtttaccccggtccccccggttaacccc

SEQ ID NO: 163639 - DNA, 754 bp, Homo sapiens
  misc_feature: GYAE6OF01A9EKX.47.55.E11.1.454.CMB.1.raw
  modified_base (107)..(107): a, c, t, g, unknown or other
  misc_feature (107)..(107): n is a, c, g, or t
  modified_base (142)..(142): a, c, t, g, unknown or other
  misc_feature (142)..(142): n is a, c, g, or t
  modified_base (667)..(667): a, c, t, g, unknown or other
  misc_feature (667)..(667): n is a, c, g, or t
  modified_base (675)..(675): a, c, t, g, unknown or other
  misc_feature (675)..(675): n is a, c, g, or t
  modified_base (685)..(685): a, c, t, g, unknown or other
  misc_feature (685)..(685): n is a, c, g, or t
  modified_base (701)..(701): a, c, t, g, unknown or other
  misc_feature (701)..(701): n is a, c, g, or t
  modified_base (712)..(712): a, c, t, g, unknown or other
  misc_feature (712)..(712): n is a, c, g, or t
  modified_base (726)..(726): a, c, t, g, unknown or other
  misc_feature (726)..(726): n is a, c, g, or t
tcagagctcacgtacacgaccggtgctcgatttagcactcgcacgttgggtttgggggccgcagccctgggattcccagctgttctgcttgctgatcaggactgcanacagagagctcgaccagtggagtcgtgggctaggngtcgttcgggttttccttggttcgtacttagttttaaaggtcgtcgagtggtggaggtgacgtaggtaggtcgggacgggtccggggagtcttagttcgaggccggtggggtacgtcctaggactacctcgtcgttaggtgtacgtctacggtagtaacgttcgtacgtttacgacgttaccgttcgtggtactcggccgtacggtccggggtacccaaccgtaaccgccgtaccgtacccgtaccgaccggtaccggtacctccgttccgttacccccgttccgaccggtcccgtacctcggtctaccggacggactccccgtaccgtcggacgtacggccacggtcgcccgggtacccgtggtacccgccggttggtaccggtaacggtaaccggtacccgtttaccgttacccggtaagttcccgggaaacttccggtaacccggtttcggggaaccgggtcccgggttacggtaccggttaaaccgggggacccggtaccttaacgtacttcggggcgttnaccccggngtaaccgcgngacgttacgcgtaccngtacgcggtcncgtaacgctaagtntaaccgtcgcgtacgtgacgtgtcgtcg

SEQ ID NO: 163640 - DNA, 924 bp, Homo sapiens
  misc_feature: GYAE6OF01CET6A.47.55.E11.1.454.CMB.1.raw
  modified_base (767)..(767): a, c, t, g, unknown or other
  misc_feature (767)..(767): n is a, c, g, or t
tcagagctcacgtacacgaccggtgctcgatttagcactcgcacgttgggtttggggccgcagccctgggattcccagctgtttctgcttgctgatcaggactgcacacagagagctcaccatggagtcgtgggctggagtcgttcgggttttccttgttcgtacttacgttttaaaaggtcgtccagttgtggaggtgcgtaggtggtggaggtccggggagtcttagttcgcggtaccggtcgggtacgtcccgtagacgtaccttcctcgtgtggttacgttctacgtaggtaactcgttacgttttacgtaacgttaccgttcgtaggtactcgtaccgtacggtaccgggtaccccaccgtaaaccgtccggtaaggggttacggggtcgtttcggggtcgggtttacgggttacccttacggtaaacgtttccgtacgtaacgttccgtaggtacgtacgggtaccgttaaggtttaagttaaacgttaacgttcggtacgggtaccggtttaccggttccgggaaaggggttaccccggggtacttaacgttaccgtaacggtaccttaccgttccgaaaccggtaaggaaaccggtaaccgtaaaccgggtaactaaacgggtactttaaccgtacgttaacggttaactaccgggtaaaggtaaacttaaccggaaactttaccggtgtaaacggtttaaacgggaccggttaccgggtaaacggttccgggtttacggtaccttacgttaaccgttnttaaacggggttttcgtttacgggttttaaccgtttccggtaaccggttacccgggttttccccggttcccggggtaaaccccgggtttccgggtttacccggtaaccggggttccccgggtaacgttaacccccgggggttaaaccgttcccgggg

SEQ ID NO: 163641 - DNA, 650 bp, Homo sapiens
  misc_feature: GYAE6OF01EB56A.47.55.E11.1.454.CMB.1.raw
  modified_base (210)..(210): a, c, t, g, unknown or other
  misc_feature (210)..(210): n is a, c, g, or t
  modified_base (227)..(227): a, c, t, g, unknown or other
  misc_feature (227)..(227): n is a, c, g, or t
  modified_base (234)..(234): a, c, t, g, unknown or other
  misc_feature (234)..(234): n is a, c, g, or t
  modified_base (268)..(268): a, c, t, g, unknown or other
  misc_feature (268)..(268): n is a, c, g, or t
  modified_base (364)..(364): a, c, t, g, unknown or other
  misc_feature (364)..(364): n is a, c, g, or t
  modified_base (387)..(387): a, c, t, g, unknown or other
  misc_feature (387)..(387): n is a, c, g, or t
  modified_base (407)..(407): a, c, t, g, unknown or other
  misc_feature (407)..(407): n is a, c, g, or t
  modified_base (448)..(448): a, c, t, g, unknown or other
  misc_feature (448)..(448): n is a, c, g, or t
  modified_base (452)..(452): a, c, t, g, unknown or other
  misc_feature (452)..(452): n is a, c, g, or t
tcagagctcacgtacacgaccggtgctcgatttagcactcgcacgttgggtttggggagcttcagctgtggtagagaagacaggattcaggacaatctcagcatggccggcttccctctcctcctcaccctcctcactcactgtgcgagggtcttcgggcccaggtctgtgctgactcagcccacctcaggcgtcgtcgggaccccgggnacggacgtcaccatctnttgttcnggagcagctaccaatagtacggaaatgattaatntaatactaggtacagtacaacgtccaccggaaccgccccaaactccgtacatctaagaacactgatcaggtccgctcgagggtcctggctattcgntggcctacaggtctagggctccngacacccttccgcgtcctanacggtacggtccggacctcccgggacgtaaggcttacgggnggtntacgttattacgttcgttagtgggttaggttcgggaacttccggcgttaccgacgttacggacgtttcgaccgttttcgtacccgggttaggaaggtcccggtaaacgggaacccgttaacggtcccgtaaaccccgggttggttaaccgggaccctaaacggaaccccccgttaaagggaacccccctaccgttacg

SEQ ID NO: 163642 - DNA, 809 bp, Homo sapiens
  misc_feature: GYAE6OF01BX0D4.47.55.E11.1.454.CMB.1.raw
  modified_base (522)..(522): a, c, t, g, unknown or other
  misc_feature (522)..(522): n is a, c, g, or t
tcagagctcacgtacacgaccggtgctcgatttagcactcgcacgtttgggtttgggggccgcagccctgggattcccagctgtttctgcttgctgatcaggactgcacacagagagctcacagtggagtcgtgggctgagtcgttgggttttccttgttgtacgtttaacgttttaaaggtcgtaccgtaggttggtaggtagggtgacgtagggtaggtgggacgggtccggggagtcgttacggtcgacggcggttcgggtacgtccgtgacgtctcgtcgtgtacgttagtctacgtagtactcgttagtttctacgttaccgttcggtaggtactcgtaccgtcggtccgggtacccgtaaaccgtaaccgtacggtaaggggttagggtccggttggtacggtcggttactacgtacgtacgtaccgtaacgttcgtagtacgtaggtacgtagttaaacgtttaaataagtacgacggtccggtacgtcgggtagggtacggtctagtacgtacncgttaacgtcggacgtaagaacgaacggtaacgaagtaacgtaatacgtagtactaaggtaacgtaaaggaaccttaaggaaccttaggtcgtaaacggtaacgggttaccgtaacggtaaccggtaaggttaccgttagtaccgttaacttacgttacggttttccgttaggttttaaccccggtttggaacccctttccgggtttacccggtcccgggttaaacgggttcccggttacgggtcccgggtaacccggggtacccttaaccgggggccctttacggg

SEQ ID NO: 163643 - DNA, 778 bp, Homo sapiens
  misc_feature: GYAE6OF01CNJDS.47.55.E11.1.454.CMB.1.raw
  modified_base (601)..(601): a, c, t, g, unknown or other
  misc_feature (601)..(601): n is a, c, g, or t
  modified_base (699)..(699): a, c, t, g, unknown or other
  misc_feature (699)..(699): n is a, c, g, or t
tcagagctcacgtacacgaccggtgctcgatttagcactcgcacggtttggggtttgggggccgcagccctgggattcccagctgtttctgcttgctgatcaggactgcacacagagagctcaccagtggagtcgtgggctgacgtcgttgggttttccttgttgtacgttaacgttttaaaggtcgtccaggtgttggaggtgacgaggtggtgggacggggtccgggggagtcttaggttcgcggccggtgggggtactcccgtaggacgtccttccgtacgttggtacgttcgttcgttacgtagggtaacttcttacgtttccgtacgttaccgttgtggagtcgacgtaccgggttccggacccgaaccgtaaacggtccggtaaggggtacgggacggttgggtacggtcggttacctacgacgttactactaacgtcgagcgtgtagtagttattaaataagtcgacggcggtacgttacgggacgggaccgggtactagttaccgacgtactacgacgtaacggaacgaacggaaccaaccggtagtaaacgtacggttacgtaacgttacgtaagtacggaaacggttaaanaacgtaagtaacgtacggtaggaaggttaaccggtacgacgttaacggaccgtgttacgttaccgttagtacggttacgttttaggttcgtttaccgnggttttcccggcccgggtttcggggtacccgtcgggtacggtttacccgggcgggtaacccggtccggacggttccggg

SEQ ID NO: 163644 - DNA, 841 bp, Homo sapiens
  misc_feature: GYAE6OF01BK78W.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagcgttgggttttccttgttgcttacttttaaaaggtgtccagtgtgaggtgcgtaggtagtggaggtccgggggagtctttagttcacggccgtggggacgttcccgtaggacgtaccttccgtccgttggttcggttacgttccttcgttaggtaaacttcgtaacgttttacctaacgtttacccgtttcgtaggtagttcgaccgtaccggttcgggtcccccgaacccgtaaaccgtacccggtaaggggttaacgggggtcgttaggggttcggttaggggttcctaccgtaacgttaagttaccgtaacgttccgttaggacggttcggacgttaaggttttagttaaagtttaaagtttagtcggtaccggtaccgttacggggtagggtaccggggtacgtattacgacgtaccgtactccgtacccgaaggtaacgaaccgaaccggaacgtaaacggtaagttaaccgttagtacgttaacgttacgttaaaggtaacttaacgtaaactaacgttacggtaacgtaagggtacggtacgggtaaacgtacgtaccggttattacgttacttagttacgtttgtttagtttcggtttacgtacgttcccggttcccggtttacccggggtcccggttacgggttccggttaccgggacggggtaccccggtaacgggttaccccggttacggg

SEQ ID NO: 163645 - DNA, 820 bp, Homo sapiens
  misc_feature: GYAE6OF01EDKZW.47.55.E11.1.454.CMB.1.raw
tcagagctcacgtacacgaccggtgctcgatttagcactcgcacgttgggtttgggggccgcagccctgggattcccagctgttctgcttgctgatcaggactgcacacagagagctcaccatggagtctgggctgagcttgggttttccttgttgcttacttttaaaaggtgtccagtgtgaggtgcaggtagtggaggtccgggggaggtcttagtcaggtccgtggggactcctgagactcgtcctgtgtagtctcgtggaatctagtttcagttaccttctggtatgctacgtcgggtccccgacctaaacgtccgagggtaacggggtctgggtcggttgggtacctcgtacgtatactaacgtcctagagttcggactaggtttacgttaaattaaaagttgtacggtacggtaccgttccgggtacggggtacgggggtaccccgtaagttcccgaacggtacctaacgttcccgttaacccggaaagggtaaccggaaaacccgtaaaacggggaccgtaaaacgggtaacgttaaaccgttacgtttaacggttacttaacgggttacggtaaaaacgtaggtaaaaaccctaagttccgttaagggaacggtaacggttaaccgggtaaccggttaaacggttacccgggtattcggtttactaacggtttaccttagggtttttggtttacgtttttcccggaagttcccgggtttacccggtttcccggggttacccgggttaccgggttaacccggttttcggggtacccggggaaccccggttaacgggtccccggttacccgggg

SEQ ID NO: 163646 - DNA, 790 bp, Homo sapiens
  misc_feature: GYAE6OF01DDTJ5.47.55.E11.1.454.CMB.1.raw
  modified_base (212)..(212): a, c, t, g, unknown or other
  misc_feature (212)..(212): n is a, c, g, or t
  modified_base (243)..(243): a, c, t, g, unknown or other
  misc_feature (243)..(243): n is a, c, g, or t
tcagagctcacgtacacgaccggtgctcgatttagcactcgcacgttgggtttggggagcttcagctgtggtagagaagacaggattcaggacaatctccagcatcggccgcttccctctcctcctcaccctcctcacctcactgtcgctagggtcttggccctagtctgtgctgacctcgacgccacctcagcgtcgtccgggaccccggnacggacgtcaccatcttcgtagttcaggacncacgtcctacaatcgtaacgaatcgatatgtactacgtcgacacgcaacgtccccgacgaacccgacccctaactcctacaactcctaaagactactcgactcgacgcccgtacctacgggaccggtccgtcggtaacgttacgttaccgcggtcgtacccgtacgtaacggttcgtcccgggtcctacccgtacgacccgtaccctaccgcggtacccctgttaccccgaagggtcccgggtaccccggtacccgggaccgggtaaggttaccggtacggtaacgggttccttaaacggttaacttttaaccggttttacgttacgggggtttaggttaaaccgggggtttcggaaccgttacccggacgttaacggtacccgttacgtaccgtttaccgtccggtttaaacccggttcgggttaacccgggtgttaacccgggtaccggggaaaccgttacccggttacccggtacccgtttaaccgggtaccgtacccgtaaaccccgacccggtaaaccccgaaccccgttccccggttaaac

SEQ ID NO: 163647 - DNA, 802 bp, Homo sapiens
  misc_feature: GYAE6OF01E0T0X.47.55.E11.1.454.CMB.1.raw
  modified_base (175)..(175): a, c, t, g, unknown or other
  misc_feature (175)..(175): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagtcttgggttttccttgttgcttacgttttaaaaggngtccaggtgtgaggtgacgagggtaggtgggaggtccggggggaggtcttagttccgaggtccggtgggggacgttcccgtggtacgtaccttccttccgtggtgttagttcctacgtagaatctacgtttcacgttaccgttcgtaggactgcctacggtcggtaccccgacctaaacgtccggtaaggggtaacggggccgttgggttcggtgggttcctacgacgttactaccgaattccgtagtaagtcggacgtaagtttattaaattaaattagtcggaccggtaccgttacggtagggaccgggtacgtaagttacgacggtcctaacgtacctaccggaagtaacggaaaccaaaccgggacgttaaacggtagttaaacttaccgttagttacctaacgttaagggaaacttagaaactagtacgtaggtaaggtaccgtaaggaaccgtaggttacccggtattacgtaacgttaagtttctttaacggttttacgtttacggaccgtttaccggggttacccggtttcccggggttacccggtacggggttacctttacccgggggtacccggggttaaccccggtaaaccggggttacccgggttcgggtcccgg

SEQ ID NO: 163648 - DNA, 734 bp, Homo sapiens
  misc_feature: GYAE6OF01CMYQK.47.55.E11.1.454.CMB.1.raw
  modified_base (191)..(191): a, c, t, g, unknown or other
  misc_feature (191)..(191): n is a, c, g, or t
  modified_base (234)..(234): a, c, t, g, unknown or other
  misc_feature (234)..(234): n is a, c, g, or t
  modified_base (239)..(239): a, c, t, g, unknown or other
  misc_feature (239)..(239): n is a, c, g, or t
  modified_base (264)..(264): a, c, t, g, unknown or other
  misc_feature (264)..(264): n is a, c, g, or t
  modified_base (318)..(318): a, c, t, g, unknown or other
  misc_feature (318)..(318): n is a, c, g, or t
  modified_base (382)..(382): a, c, t, g, unknown or other
  misc_feature (382)..(382): n is a, c, g, or t
  modified_base (400)..(400): a, c, t, g, unknown or other
  misc_feature (400)..(400): n is a, c, g, or t
tcagagctcacgtacacgaccggtgctcgatttagcactcgcacgttgggtttggggagcttcagctgtggtagagaagacaggattcaggacaatctccagcatggcccggcttcccctctccctcctcaccctcctcactcactgtgcgagggtcttgggcccagtctgtgctgactcagcccaccctnagccgtcgtcgggacccccggacgacgtcaccatctcttgtcngatcngcctacatagacggaatgaatagtntatacgtggtaaccagactaacgtccccacggaacccggaccccaaacgttccncctatacctaataacgatagatacgacgccgccccgtcgacgggtccctggaccgtactttccnctcgtactaccgagtccncggcgtccctcgacgccctaccgtcgacctacgtcgaggtcccgggacgtccccggaccggaggcgtagggacggtacgttacgtaagttttacgttaacgtggtttacgggttaggggttacggacgtttccggccgtaacggtcctttacgggaccttaccgggttaccgttaaccgggtttccggttaccgggtaccggtacgggttcccgggggtaaacccgttaacccggttaccccgttaccccggtttacccgggtttaaacggccccgttaaacccggggtccccccgtaaaaacccggtcccccccgtaaacccccgttaccccg

SEQ ID NO: 163649 - DNA, 704 bp, Homo sapiens
  misc_feature: GYAE6OF01E1QA9.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtcgtggctgagtcgttggttttccttgttgtcttacgttttaaaggtgtcctagtgtgaggtgacgaggtggtggtacggtccggggagtcgttagttcgacggtccggtggggtaccgtcccgtagacgtacctccgttcccgttggtacgttacggttccttagttacggtaactcgttaacgttttccgaactttaccgttcgtgggtactcgcgtacggtccggtaaccccgtaccgtaacgtacggtacggaacggtggtggtggtcgtacgtacgtactacgtactacgtacgtagtagtacgtacgtagttaagttaagttaacgtacgtacggtacgtacggtcggtacggtacggtacgtacgtacgtacgactacgtacgacgacgacgacgtacgagtagtacgtactagtagtacgtacgtaagtaagtaacgtatacgtacgtacgtacgtacgtacgtacgtacgtacgtacgtactacttacgttacgttagttacgttcgttcgtcgtccggttccggtccggtcggtccggtacggtacggtacggtccggtcggtacg

SEQ ID NO: 163650 - DNA, 849 bp, Homo sapiens
  misc_feature: GYAE6OF01AG9JY.47.55.E11.1.454.CMB.1.raw
  modified_base (193)..(193): a, c, t, g, unknown or other
  misc_feature (193)..(193): n is a, c, g, or t
  modified_base (818)..(818): a, c, t, g, unknown or other
  misc_feature (818)..(818): n is a, c, g, or t
  modified_base (827)..(827): a, c, t, g, unknown or other
  misc_feature (827)..(827): n is a, c, g, or t
  modified_base (833)..(833): a, c, t, g, unknown or other
  misc_feature (833)..(833): n is a, c, g, or t
  modified_base (836)..(836): a, c, t, g, unknown or other
  misc_feature (836)..(836): n is a, c, g, or t
  modified_base (838)..(838): a, c, t, g, unknown or other
  misc_feature (838)..(838): n is a, c, g, or t
  modified_base (842)..(842): a, c, t, g, unknown or other
  misc_feature (842)..(842): n is a, c, g, or t
  modified_base (844)..(844): a, c, t, g, unknown or other
  misc_feature (844)..(844): n is a, c, g, or t
  modified_base (846)..(846): a, c, t, g, unknown or other
  misc_feature (846)..(846): n is a, c, g, or t
  modified_base (848)..(848): a, c, t, g, unknown or other
  misc_feature (848)..(848): n is a, c, g, or t
tcagagctcacgtacacgaccggtgctcgatttagcactcgcacggttgggtttgggggccgcagccctgggattcccagctgtttctgcttgctgatcaggactgcacacagagagctcacagtggagtcgtgggctggagtcgttgggttttccttgttgtcttacgttttaaaaggcgtccgtaggtcgngtaggtgacgtaggtagtgggacggtccggggaggtcttagttcgacgccggtagggacgtccgtgagtaccgtctaccgttggtcgttacgtcgtacgtacggtaacttcgtaacgttttccgaacggtttaccgttgtacgggtactcggtaccgtaccgggttaccggggtacccctaacccgtaaaaccggtacccgggtaaagggggtaaccggggaaccccggttaaccggggaccccgttagggtaccggtacgttacccggtccctcccgtaccgggtacctaccccggtaacccgaaaccgggaaccccggtaacccttccggttacccggttcccccgttccccgggtggtccccgtacccgtacgtccccgtaacccggaacggtacccgtacccgtaacccggtccggaaccggaccgtaccgaccggtacccggtaccgggtcccccggtacggggtaccgtcccggtacccggttaccgtaaaccgggtaaccggttaacccgtttaccgtttaacccgtaagtttccgtaacgttaacccggttcggtaacgggtcggggaccgggttaccgtaccgggaccgttaaacgggtccctaaggtcgaccggnacgtgacgntgcgtnacngnagancngngng

SEQ ID NO: 163651 - DNA, 828 bp, Homo sapiens
  misc_feature: GYAE6OF01BJ329.47.55.E11.1.454.CMB.1.raw
tcagagctcacgtacacgaccggtgctcgatttagcactcgcacgttgggtttgggggccgcagccctgggattcccagctgttctgcttgctgatcaggactgcacacagagagctcacagtggagtcgtggctgacgtcgttcggttttcttgttgtacttacgtttaaagtcgtcgtaggtgtggaggtgacgtagggtaggtcgggacgggtccggggtagtcgttaggtcgacggtccggtcggggtaccgtccgtaggacgtctccgttcgtggttgtacgttcgtacgtaggtacttacgttcgtttactacgttaccgttcgtacggtacgtcggtacgtaccgggtccgggtaccccgtaacggtaaacccggtaccgggtaaggggttaacgggtccggttggggttaccgggttcggttacgtaccggtaacgttagtaaccgtaacgtccgtaggtacgtcggtaacgttaagttaacgttaaagttaagtacggtcggtaccgtacggtacgggtacgggtacgggtacctagtacgcgtacctaggtaccaccggaagtaaccggaactaacggaaggtaatacggttaaacgtcgtacgtaacggtaaacgtaaaggactaaagtaaccgtagtaccggtaaggacggtaacggtaacgttaaccggacggttacgtacgttagttaaccgtagttaggttcgtttaggtttaccgtttaccggtaccgtttcccgggttccgggttaaaccggcccggttacggttacccggttacgggaccggggtaaccctacggggttacctaccgggg

SEQ ID NO: 163652 - DNA, 664 bp, Homo sapiens
  misc_feature: GYAE6OF01E5ZA7.47.55.E11.1.454.CMB.1.raw
  modified_base (222)..(222): a, c, t, g, unknown or other
  misc_feature (222)..(222): n is a, c, g, or t
  modified_base (236)..(236): a, c, t, g, unknown or other
  misc_feature (236)..(236): n is a, c, g, or t
  modified_base (253)..(253): a, c, t, g, unknown or other
  misc_feature (253)..(253): n is a, c, g, or t
  modified_base (296)..(296): a, c, t, g, unknown or other
  misc_feature (296)..(296): n is a, c, g, or t
tcagagctcacgtacacgaccggtgctcgatttagcactcgcacgttgggtttgggggcagcttcagctgtggtagagaagacaggattcaggacaatctccagcatggccggcttccctctcctcctcacccctctcactcactgtgcagggtcttcgggcccagtctgtgctgactccacgccctaccctgacggtccgtccggtccggggacccccggnaggaccgtcacctntcttctttgtcgaggancagcctacaatagtacgaatgaattaagtgtatacgtcgtacngaccaacgtacccaccggaaccgcccctaactcctacactactaataacattcgactcgaccgccgtcctacggtaccggggtccgtcggacctactccgtcgcggtcctacgacgtccgtcggcctccgtcaccgccctacgcggactacgtcggtacggtccgggcccgtcccggacggtaaggcgtgggtaccgtcgtaacgtttacgttacgttcgttgggtaggttacgggtacggtctccggtacgtccgtcgtacgacgttacgtccgtttcggtcggtcgggtacgtcgggaccggtaaccggtccgtacccgtaacccggttcgtacggaccacccgggtacccaccggaccctacccg

SEQ ID NO: 163653 - DNA, 848 bp, Homo sapiens
  misc_feature: GYAE6OF01AZZ49.47.55.E11.1.454.CMB.1.raw
  modified_base (220)..(220): a, c, t, g, unknown or other
  misc_feature (220)..(220): n is a, c, g, or t
tcagagctcacgtacacgaccggtgctcgatttagcactcgcacgttgggtttggggagccgcagccctgggattcccagctgtttctgcttgctgatcaggactgcacacagagagctcaccatggagtctgggctgagtcgttgggtttttccttgttgtcttacgttttaaaaggtgtcctagtgtggtaggtgcaggtaggtggaggtccgggggngctttagttcgaggtccgtggggacgtcccgtgacgtacctcgtacctggtcggtagtctacgtggtaactcgtagtttccgtagttacccgttctggtatgcctaccggttgggtacccccgaaccgtaaaccgttccggaagggttaaacggggtccgttggggttcggtacgggttcctacgttaaccggtactacgacttcccgtagacgtacggtacgtaggtttagttaaagtaacgtttaacggtcggtcgggttaaaccccgttccgggttaaacgggtaccggggtacccgtacgtttaccggacgtccgtaacgttacccgtaacccggtaagtaaacccggaacggtaaaacccgggactaaaacggttaaggtactttaaaccggttagttaacttaaccggtaaagggtaaacttaacgggtaaactaacgttagtacgggtaagtaacgggtacgaccgttaagtaacccgggtattaccgttacgttacgtaacgttacgttttaccggtttgtaacgtccggtttacccggtttcccggggtacccgttaccgggtaccggtttttacgggaccggggtaacccggtaacccggggttaacccgtcccgggg

SEQ ID NO: 163654 - DNA, 880 bp, Homo sapiens
  misc_feature: GYAE6OF01B0N0S.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtcgtgggctgagtcttgggtttttccttgttgtacttacgtttttaaaaggtgtccgtaggtgttaggagggtgcgtaggtaggtgggtagggtccgggggaggtcgtttagttcgaggtccggtggggtacgtcccgtaggacgaccgttccgtccgttggttacggttacgttcttaccgttaggtaaacttccgttaacgttttaccgtaacgtttaaccgtttcgtaggtacgtcgaccgtaccggtcgggtaccccgaacccgtaaaaccgttccggtaaaggggtacgggtcggttcgggttaggtcgggttcctacgtacgttacgtacgtaaagttccgtaggtacgtcgggtactaaggtttaacgtttaaagttaaacgttaacgtcggaccggttaaccggtccgggtacgggtaccgggtacgtattacgtacgtactaaccgtccgtaaccggtaacgaacggtaaaccgtaaggtaaaccgtaaaggttaccgttaaacgttaaccgttaagtttaccgtaaacgggttaaacgtaaaacggttaacgtaaacgtaacgtttaacgaaggttaaacggtaccggtaacggtaaacccgggtaactacgggttacgtacgttaacttaacggttcttaaagggttttcgtttagttttccggacgttcgggtttaccccgttcgggtacccggtccggttacggttcgggaccgggtaacccgtccgggaccgttacgg

SEQ ID NO: 163655 - DNA, 793 bp, Homo sapiens
  misc_feature: GYAE6OF01AQ3BO.47.55.E11.1.454.CMB.1.raw
  modified_base (237)..(237): a, c, t, g, unknown or other
  misc_feature (237)..(237): n is a, c, g, or t
  modified_base (260)..(260): a, c, t, g, unknown or other
  misc_feature (260)..(260): n is a, c, g, or t
  modified_base (775)..(775): a, c, t, g, unknown or other
  misc_feature (775)..(775): n is a, c, g, or t
tcagagctcacgtacacgaccggtgctcgatttagcactcgcacggttggggtttggggggggggaagctcagcttcagctgtggtagagaagacaggattcaggacaatctccagcatggccggcttccctctcctcctcaccctcctcactcactgtgcgagggttcttcgggccctagtctgtgctgactcacgcccaccctcgacgtccggttcggtaccggggacccccggngaacgggtaccggtaccaacctntttccttcgtttcggttcggtagggaacgacctacggtacctaccgtaagtacgtaacgggtaaattagaattaagtacgttaacgtacgtacggtaaccagaccgtaaccggtaccccgaaaccggaaccccgtacccctaaactcccgtactaacttacgtaaactaaacgtaacgtacgacgtaccggacggtaccccggtacccgtacgggtaccggggtaccgtacgggtaccttacttcgtaccgcggtacctaccgtacggttccggtccggcctacccgtacgtacccgccccgtaaccgtcggacctacgtacggtacggtcgggacccgttacccgggaccgtaggtagaccggtacgtcttagttaacgttgttacggttggttacgggttaagggtcggtaacctgggaactcgtcgtacgtacgttacgttccgtaccgttcggtaccggagtacccgggtacgtaacccggaagttcccggtaccgttacgacggtaaccnccggtaacccgtaacccg

SEQ ID NO: 163656 - DNA, 685 bp, Homo sapiens
  misc_feature: GYAE6OF01DFALK.47.55.E11.1.454.CMB.1.raw
  modified_base (311)..(311): a, c, t, g, unknown or other
  misc_feature (311)..(311): n is a, c, g, or t
  modified_base (376)..(376): a, c, t, g, unknown or other
  misc_feature (376)..(376): n is a, c, g, or t
  modified_base (445)..(445): a, c, t, g, unknown or other
  misc_feature (445)..(445): n is a, c, g, or t
  modified_base (538)..(538): a, c, t, g, unknown or other
  misc_feature (538)..(538): n is a, c, g, or t
tcagagctcacgtacacgaccggtgctcgatttagcactcgcacgttgggtttggggccgcagccctgggattcccagctgtttctgcttgctgatcaggactgcacacagagagctcacagtggagtcgtggctgagtcgttgggttttccttgttgtcgttacttttaaaaggtcgtccagtgtgaggtgcgaggtaggtgggacggtccgggggagtcgttagttcaggccggtgggactccgtgacgtactccgtcgtgtagtacgtcgtctaggtatcgttagttacgacgtttaccgttgtaggntcgctacggtcggtaccaccctaaccgtcggagggtagggtcgtggtcggtcggtctcacgttanacgtactctgtaagtcggtacgttaagttaagtttaaataacggttcgtcggtacggtccgttacgggngggtaccgggacttacgtcagtctaactccgacgaagacgacgaagaaccgaagtctagtacgttgaagtacgtaaggtaaatacgaaacgtntaggtaacgacggttaagcccggtaaagttacgcggttactccggttaatcgttacgtagttttggtttcgttaacgttaggtcccggtttccggtaccgggttccgtcggttacggtcggaccgggtcggaaccgtttccggacgg

SEQ ID NO: 163657 - DNA, 794 bp, Homo sapiens
  misc_feature: GYAE6OF01A34QJ.47.55.E11.1.454.CMB.1.raw
  modified_base (289)..(289): a, c, t, g, unknown or other
  misc_feature (289)..(289): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcgagccgtggggagtccctgagactctcctgtgtagtctctggaatcagtttcagtaccttcgtggatgcacgnggtccgaccaactccgaggtagggctggtggtggtctcgacgtatactaatcctgactggtctaggttacgttaataaagtttaagtcgtaccggtacgtccggttaaggtacgggggtaccgtaacgttccgaacggtacctacgtccgttaacccgaaggtaacggtaaccgaaacgggtaccgtaaaggtacggtttaaactacccgtttaggttaacgtaccgttaagggtaaaacttacgaaacgttaacgttacctaggggtaaccgttaacgggtaccggtaaaccgtaaccgttaaccgggtaccgttacggttacctaacggtttaccgtttaaacggttttaggttttaccgggtttttacggtaccgttttacgggtttcccccggttttacccgggggttccccggtttaccggggttaacccggttttcccgggggtaaccggggttaccccggggaaacccggggggtttaaccccggtttaacccggggg

SEQ ID NO: 163658 - DNA, 753 bp, Homo sapiens
  misc_feature: GYAE6OF01CB4YB.47.55.E11.1.454.CMB.1.raw
  modified_base (168)..(168): a, c, t, g, unknown or other
  misc_feature (168)..(168): n is a, c, g, or t
  modified_base (604)..(604): a, c, t, g, unknown or other
  misc_feature (604)..(604): n is a, c, g, or t
  modified_base (675)..(675): a, c, t, g, unknown or other
  misc_feature (675)..(675): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctggctgagctgggtttcctgttgctcttttaaaaggtntaccagtgtgacggtgcaggtagtggaggtccgggggagtcgttagttcagccgtggggagtccctgagtactcgtccgtgtgtagtctcgtaggaactcgtaagtttccgaagttaccgttcgttgggacttcgaccgtacgtaccggggtaccgtaccctaaaaccgttcccggaaggggttaaacggggtcgttcggggttacgggttacggggtttaccttacggtaaccggtttaacgttaccggtaaaactttccccgttaggtaaaccggttcggggtaacgttaacggtttagttttaaaacgttaaaaccttttaaggtccggtaacccgggttaccgttaccgggtacgggtaacgggggtaccccttaagtttaccgacgtacgtacgtacccgtaccgaaacgtacgaaaccggtaacggtaanaaggtagtaactacgtagttactacgtagtaaagtgaaactatcgtagaagtcgtacgacgtagtcgtctnactctacgtattggtactttcgatacggtccttcgggtcccgtcgggtacttccgggagggcccgaggtcccgtacgg

SEQ ID NO: 163659 - DNA, 754 bp, Homo sapiens
  misc_feature: GYAE6OF01A7KIE.47.55.E11.1.454.CMB.1.raw
tcagagctcacgtacacgaccggtgctcgatttagcactcgcacgttgggtttgggggagccgcagccctgggattcccagctgtttctgcttgctgatcaggactgcacacagagagctcaccatggagtctgggctgagtcgttgggttttccttgttgtcttacgttttaaaaggtgtccagtgtgaggtgcgaggtagtggaggtcggggagtcttagttcgaggccgtggggacgtcccgtgagactctctgtgtatcgtcgtaggtatctagtttcacgttaccttcgtaggtatcgacgtacggtcgggtcccgaccaaaccgtccggtaagggtaacgggcgttgggtcggtacggtccgtcgtaacgttactacctaacgttccgtaggagttcggacgttaagttagttaattaaaacgtttgccggtcggtaaccgttcggtagggaccgggtactacgttcgaacgtacgtaacgttccgaccgtaaggaaccgtaaacggaacggaacgtaaaggtacgttaactaacggttcgtaacgttaacggtaaggtaaacgtaacgaaaccgtaagttacgtaacggaaaggtaccgggtaacgtaacgtacggttaccggacgttacgttacccgtagtttacgttaggtttaggtttcggttagtaacggttccggtcccgtttacggggtcccgttaccgggttaacccggtgggtaccgggcccggttaagggtacccccg

SEQ ID NO: 163660 - DNA, 771 bp, Homo sapiens
  misc_feature: GYAE6OF01CIDZJ.47.55.E11.1.454.CMB.1.raw
  modified_base (219)..(219): a, c, t, g, unknown or other
  misc_feature (219)..(219): n is a, c, g, or t
  modified_base (234)..(234): a, c, t, g, unknown or other
  misc_feature (234)..(234): n is a, c, g, or t
tcagagctcacgtacacgaccggtgctcgatttagcactcgcacgttgggtttggggagcttcagctggtggtagagaagacaggattcaggacaatctccagcatggccgcttccctctcctcctcaccctcctcactcactgtgcgagggttcttcgggcccagtctgtgctgacctcgacgcccaccctcgagtcgtcgtaccggggacccccggnacggtacgtcacctnttcttcgttgtcgtaggaagcagctaccaatagacgaaatgaataagtgtaatactaggtacagacaacgtaccaacgaacccgaccccaactccacactacaataacaatcgactcgaacgccgaccgcggcgggtaccgtgaccgtattcccgtctcggccttaaccgacgtcggttacggccctaccgtacgaaccgtacccctaacccgtccggtacccaacgtaccgtaacgggtaccgggaccccggttacccggggacccggaaagggtaccgttaggggtaacggttccgttaaggttactttaaacggttttcggttagggttaaccgggttaggggtttaaacggcgttccggaacgtaccggtacgtaccggtactttacgggaacccttttaaccgggttcccggttaaccgggacgttaccgggtacccggggtaaacgtaaccgggttccccgtaaccgttaccgggttaacgggccgttaaaccccggacccggtaaacccgtccccgaaaccccgtaacgg

SEQ ID NO: 163661 - DNA, 848 bp, Homo sapiens
  misc_feature: GYAE6OF01AV6WZ.47.55.E11.1.454.CMB.1.raw
  modified_base (231)..(231): a, c, t, g, unknown or other
  misc_feature (231)..(231): n is a, c, g, or t
  modified_base (337)..(337): a, c, t, g, unknown or other
  misc_feature (337)..(337): n is a, c, g, or t
tcagagctcacgtacacgaccggtgctcgatttagcactcgcacgttgggtttggggagccttcagctgtggtagagaagacaggattcaggacaatctccagcatggccggcttccctctcctcctccaccctcctcactcacgtgtgcgagggttcgttcgggccccaggtcctggtcgctgacctcacgcccaccctcgacgtccgtcggtccgggggaccccccggntaacggaccggtccacctacttccctttcgttgtttcgtacgggaacgccagccctaacaagttacgtacggtaatagaattagttagtactacgttacggtaccngaaccgtaacgtcccccgaacgtaaccccggaaccccctaacctcctaccgaacttacctaacttaacaagtacgactacggacgacccggccggtaccgggtacccgggtccgttcggaccgttaaccgtttcgtccgtcggtaccctaccggaacggttcgcccgggtaccgtaccctacgacccgtaccccgacccggttcgacccgtactaccgggtacggtccgggtcccccggtacccgggaccgggtaaggaccgggttacggtggggtaccttagtttaacgtttaccgtttacggggttgtttacggggtttacgggttacggtaccggtggtaaccgtcggttacccgttacgtacgttacccggttcgtttaaccccggttcggtttacggaccgggtttaccggtaccgggtaaccggtacccgttacccgttaccccgttacgggttactaacccggtaccggaacccccgaaccggtacccccgtaaccctaccggg

SEQ ID NO: 163662 - DNA, 771 bp, Homo sapiens
  misc_feature: GYAE6OF01CNSEA.47.55.E11.1.454.CMB.1.raw
  modified_base (428)..(428): a, c, t, g, unknown or other
  misc_feature (428)..(428): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagtcgttcgggtttttccttgttcgtcttaacgtttttaaaaggtcgtaccgagttgtaggtacgggtgacgagggttaggtgggacgggtccgggggagtctttagttcgacggtcggtaggggacttcccgtagacgtaccttctccgttgtagtacgtctcgtaggtaacttcgtagtttcgacgttaccttgtaggtatcgtaccgtacggtccggggtaccccaacccgtaaaccgtccggtaaggggtacgggcggttgggtggttacgggtctacgtaacgttntacctacgtccgtaggactcggacttagttaacgttaaataaacgttcgtcggacggtaccgtacgggtacgggtaccgggtaaccgtacgttacgacgtactacttaccgtaccgtaagaacgaacggaacggactaaagtacgtttactagttacgttacgtacgtaaggaataacgtaagtacgtatacggaagtcgtacgaacggtactaccggtattacgtattacgtcgttagtttcgttcggtttacgtcggtttcccggttcccggttaccggggtcccggttacgggttacccggttaccgggtaggaaccccggttacgggtcccggtacggg

SEQ ID NO: 163663 - DNA, 738 bp, Homo sapiens
  misc_feature: GYAE6OF01C962U.47.55.E11.1.454.CMB.1.raw
  modified_base (162)..(162): a, c, t, g, unknown or other
  misc_feature (162)..(162): n is a, c, g, or t
  modified_base (532)..(532): a, c, t, g, unknown or other
  misc_feature (532)..(532): n is a, c, g, or t
tcagagctcacgtacacgaccggtgctcgatttagcactcgcacgttgggttgggggaagaggagactgacggtcctgccacgaggtggtgcgtgggcgacggtgggcactccgacacaactatttgcgctcactgtcttgctcacatggagtcgtggctgngtcgtttcggttttccttgttgtcgttaacgtttaaaggtcgttccgtaggtgtggaggtcgtacgtaggtaggtggacgggtcgggggacgtcgttagtacgcggtcggtgggtactccgtgaacgtctccgtccgtgttgtacgtctgtacggtaattcgtacgttcgtactccgttgtgtagtcgtcgtacgtccggaccgtaaccgtaaccgtacgggaacgggtacgggtgtcggtaggttcggtctaaccgtagtactacgtactacgtgtaaccgtgtacgttaagtagttaaataacgtcggtacggaccggttcggtacggggtaaccggtcggggtacctttacgtaacgcggtaaaccncccgttaacgaacccgaaagggaacccaaccggaaggtaaacgtagttaaacgtaactacggttataaccggtaagtaaacgtaagacgtaaagtacgactaggtaacgaacgtacgtaacgtagtaccgtagtacgttcgtattaacgttgttacggtttcgtaccgtacgtcccggtaccggtccggttcgtcggttcccgggg

SEQ ID NO: 163664 - DNA, 778 bp, Homo sapiens
  misc_feature: GYAE6OF01CYQAR.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagaggactcaccatggtagtttgggctgagtcgttcggttttcctcggttgcttacttttaaggaggttgtccagtcgtcgagggtgcgtccgtggtgggaggtcggggggaggtcggtggtccgaggtccgtcggggaccgtcccgtagtacgaaccgttccgtccgttcgtcgaccgtacgtccgttccgtaggtccttcgtaaccctttacaaattaattctcgtactagtacgacgtacggttcgggccgtaccggtacggaccgtaccgaggaaccggaacggggtccgtaaagggtcgggttcgggtacgggtcgtacgtacgtacgtcggaccgtaggtacgtactacgtacttacgtaacgttacgtacgtcgtacgtaccgttccggtacggaaccggggtcctaacgtccgaacctacgttacccgtacgaaacggtacgaaacccgtaaccgttaacccgaacggtaaccgtacccggttacttacgtaccgtactaaccccgttaccacggtaaccgaccggttacccgtaacgtaacgtaccgtaacggaccgtaacccgttaccgtacctacgttacctaccggtacttggacctacggtagtacggtacgttaaggaccgttaacgtacttaggttacggtgtacgttaccgg

SEQ ID NO: 163665 - DNA, 731 bp, Homo sapiens
  misc_feature: GYAE6OF01BMI5I.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggaggtccgggggagcttagttcagccgtggggacgtcctgagactctcctgtgtagtctcgtggaatctagtttcagttaccttgtggatgcacgtcggtccgaccaaactccgaggtaacggggctgggtgtggtctcgacgtatcaatcctgactggtctagttacgttaattaaattagtggtaccggtacgttccggtagggacggggtacgtacgtttcgaacggtctaacgttccttaccgaaggaacggtaaaccgaaacgggactaaacggtaaggttaactaacgttagttaacgtacgttaaggtaaacttaacggtaaactaaacgttcgtaacggtaacggtaacggtaccggaaaccgttaagttaccgggtaccgtttagttacgttaactacctttaaggttttcgttttacggttttccggttaacgttccgggttacccggtttcccgggtcccgggccggggttaccgttttccgggtaccggggggtacccgtaaccgggggtaaccccgtttcgggg

SEQ ID NO: 163666 - DNA, 840 bp, Homo sapiens
  misc_feature: GYAE6OF01CAN31.47.55.E11.1.454.CMB.1.raw
  modified_base (717)..(717): a, c, t, g, unknown or other
  misc_feature (717)..(717): n is a, c, g, or t
tcagagctcacgtacacgaccggtgctcgatttagcactcgcacgtttgggtttgggggccgcagccctgggattcccagctgtttctgcttgctgatcaggactgcacacagagagctcaccagtggagtcgtgggctgagtcgttgggtttttccttggttcgtctttaacgttttaaaaggtcgtaccgtaggtgtggtaggtgcgtagggtaggtgggacgggtccgggggaggtctttaggtcgacgtccggtaggggtacgtcccgtggaacgtaccttccgtccgttggttcggtacgttccttacggtaggtaacttcgttacgttttacctaacgtttaccctttcggtaggtacgtcgaccgtaccggtccgggtaccccgaacccgtaaaccggttccgggaagggggttacgggtcggttgggttcggttcgggttcctacgtacggttactacctacgttccgtagtagtcggtacgttaagttagtttaaattaacggttcgtcgggtaacccggtaccggtacggggtcggggaaccgggtactacgttacgaccgtacgtaccttcgaacggaacgggtaacgaacggtaaacggaacgtaaagtacgttaacttaccggtaagtttacgtacggtaaagtaacaaccgtaaagacgttcggaaacggtaaggtacggtaaccggtagttaccgtacggtntttcgtaactttacggttaccgtttagttttacgtaccgtcggtttaccggttcccgggttccggcgggtaccgttaccggtccggggaaccggggtacctaaccggggttccgtcgtaccgg

SEQ ID NO: 163667 - DNA, 865 bp, Homo sapiens
  misc_feature: GYAE6OF01BN03I.47.55.E11.1.454.CMB.1.raw
  modified_base (835)..(835): a, c, t, g, unknown or other
  misc_feature (835)..(835): n is a, c, g, or t
  modified_base (838)..(838): a, c, t, g, unknown or other
  misc_feature (838)..(838): n is a, c, g, or t
  modified_base (846)..(846): a, c, t, g, unknown or other
  misc_feature (846)..(846): n is a, c, g, or t
  modified_base (853)..(853): a, c, t, g, unknown or other
  misc_feature (853)..(853): n is a, c, g, or t
  modified_base (861)..(863): a, c, t, g, unknown or other
  misc_feature (861)..(863): n is a, c, g, or t
  modified_base (865)..(865): a, c, t, g, unknown or other
  misc_feature (865)..(865): n is a, c, g, or t
tcagagctcacgtacacgaccggtgctcgatttagcactcgcacgttgggtttgggggccgcagccctgggattcccagctgtttctgcttgctgatcaggactgcacacagagagctcaccagtggagtcgtgggctgagtcgttgggtttttccttgttgtactttacgtttttaaaaggtcgtaccgagtggtggaggtgacgtagggtaggtgggacgggtccgggggagtcgtttaggttcaggtccgtagggggtacgtcccgtagacgtaccttccgtccgttggttacgttacgttcttaccggtaggtaactcgttacggttttacctaacggtttaccttacgtagggtaactcggtaccgtacggttccgggggtacccctaaccgtaaaccggttacccgggaaagggggttaaaccgggggaccccggtaaaccgggggttaaccccgttacgggttaccgaaccgggttccccggttacccttaccccgtaccggtacccgtaccccgtaaccccgaaaccggtaacccgggtaccccgttaccggtttcccccggggttccccccgttccccccggggcccgtccccgttcggtccccgtacccggacgggtacccgtcccgaacccggtaccggacggtaaccgaccgtaaccggccgggtccccgggtaccggtccgggtcgtacccggtaccggttaacgggtaccgtaacggttaaccctttaccgtttaacgtacgttttaacgtaccgttacttcgggtaaggaccgggtccgggtacgtacgggtaacggtaccggcgtaacctaggtacggnacngatcgagngcgacgnagcacgannngn

SEQ ID NO: 163668 - DNA, 851 bp, Homo sapiens
  misc_feature: GYAE6OF01EWFUT.47.55.E11.1.454.CMB.1.raw
tcagagctcacgtacacgaccggtgctcgatttagcactcgcacgttgggtttgggggccgcagccctggggacttcccagcttgtttctgtcttgctgatcaggactgcacacagagagctcaccagtggagtcgtgggctggagtcgtttgggtttttcctttggttgtactttaacgttttaaaggtcgtaccgtaggttggtaggtaggtgtacggtagggttaggtggggacggggtaccgggggtaggttacgttaagtacgtacggttcggggtttcggggggtccctaggacgtaccttccgttccgtcggccgcgtaccgtccttcgttacggttactttccgtttacggttttaagttaaggttacgtcgtacctagttacggtaccggttccggggtacccgacggtacggtaccggtaccggggaagggggtacggggtcgtaggggtacggttcgggtcctacggtaagttactactacgttccgtaggtacgtggaacttagttaagtttaaattaaagttgtacggtaccggtcggttaccgggtagggaccggtacgtcgttacacgactactccgtacggaagtaacgaacgtaacgaagtaagtagttaatacgttagtctaaggtaagtaacgtataacgtagttaggagtaacgtacggaccgtaacggtacgttccggtacttacgttcttaacgttcgtttaggtttacggtttcggtttaacgcgtttaccccgggttcccggttacccgggggtaccccgggtttacgggttccgggtttaccggggaaccgggtaccccggggttaaaccgtcccggggttaaccg

SEQ ID NO: 163669 - DNA, 886 bp, Homo sapiens
  misc_feature: GYAE6OF01EURPZ.47.55.E11.1.454.CMB.1.raw
  modified_base (221)..(221): a, c, t, g, unknown or other
  misc_feature (221)..(221): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctctcactcactgtgcagggtcttcgggcccagttctgtgctgactcgacgcccaccctcgacggtccgtcggtccggggaccccccgggngacggaccggtccaaccacttccttccgtttgttcgtaggaacgaccacgtcctaccaaagttacgtaacggtaaatagtaaattaaagttagttaacgttaaccgttacggtaaccgaacgtaaccgtaaaacccggtacccccaaaacccgggaaacccccggaacccccccctaaaacctttccccgttaaccgtaacctttaaccttaaaactaaaaccgtaaacttacggaactaccggaccgggtccccggtaccccgtaccgggtaacccggggttccccgtacggaccccggtttactttccgttccgtcgggtacccttaccgtaacggttccgtacgggccccgtacccgtccgtacccgtccccgtaacccgtccgtacccgtacgtaccggtacgggttcccgggtacccgttccccgggacccggaggtacggtacgggtacggtcgttaagtttaactttacggtttcggttagggttcgggtttaggggttggtaccgttaccgtacgtaccgtccgttacgtaccgttccggttacggtttaccgttccggtttaccgggcgttaccgggtacggtaaccgtcgggtaccctacccggttacggttaccgacccgtacgaccccggaaccgaccccgtaaccctaccgg

SEQ ID NO: 163670 - DNA, 655 bp, Homo sapiens
  misc_feature: GYAE6OF01BZI6F.47.55.E11.1.454.CMB.1.raw
  modified_base (376)..(376): a, c, t, g, unknown or other
  misc_feature (376)..(376): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggaggtccgggggaggcttagttcagccgtggggagtccctgagactctcctgtgtagtctcgtggaatcagtttcagtaccttctggatgcacgtcgggtcccaccaactcgaagggtagggctagggtgtcgggtctcacgtatcaactcctagagtggactagttagttaattaaagttntcggtacggtacgtccggtaggacggggtcctaattcgaggtctattccgaccgaaggtacgaacgaacggacaaggtagtataccgtagtatcgtaaggaatcgaaactagtcagaacgtacgtacgaacgtagtaccggtcttagtacgtaacttgttacgtttaggtttacgttttacgtacgttcggttaccccggtttccggggtccgggttacccgggttacgtttacccgggacgggggtaccccgtaacgggggtaacccctttccggggg

SEQ ID NO: 163671 - DNA, 733 bp, Homo sapiens
  misc_feature: GYAE6OF01CZ4IU.47.55.E11.1.454.CMB.1.raw
  modified_base (158)..(158): a, c, t, g, unknown or other
  misc_feature (158)..(158): n is a, c, g, or t
  modified_base (187)..(187): a, c, t, g, unknown or other
  misc_feature (187)..(187): n is a, c, g, or t
  modified_base (668)..(668): a, c, t, g, unknown or other
  misc_feature (668)..(668): n is a, c, g, or t
tcagagctcacgtacacgaccggtgctcgatttagcactcgcacgttgggtttgggggaagaggaagactgacggtcctgccacaggtggtgcgtggcacggtggcactcgacacaacatttgcgctcaactgtctgctcaccatgagtctggctagngctggtttcctgttgtctactttaaaggngtccagtgtgaggtgcaggtacgtggacggtccggggaagtcgttagttacaggtccgtgggacctccgtgagcctcgtcctgtcgtagttcctagttaggaacttacgtagtttactacggttaccttcgtgacgtcgtaccgtacgtcggtacccgtaacccgtaaacgttaccggtagggtaacgggtcgttcgggttaggtcggtaccttacgtaacgtaacgtactaaacgtccgttaagacgttcggtacgtacggtagtttaaacctaaagtttacggaccggtacggtaccggtacggttaggggaccgggtaaccgtacgttagacgtaccgtaactacgttacccggaaaggtcccaaacggaaacggttacaaacggtaacttaacgtacggttaacgtagttaacggtaaacgtaactacggtaaactcccgttaagtaacggagtaccgtacgtaacgtagtaccggntacggtaactgtacgtagtttcgttagtacgtaacgtcgtaccccgttggcccggtggttaccgg

SEQ ID NO: 163672 - DNA, 946 bp, Homo sapiens
  misc_feature: GYAE6OF01CETDB.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccagtggagtcgtggctgacgtcgtttcgggtttttcctttggtttcgtacttttaacgtttttaaaaggttcgttccgtaggttggtggtagggttggacggtaagggttaggttcggggtaggggttccggggggtaggtacgttttacggtttccgacggtcccggtgggggtacctttacccgtaggacgtacccttcccgttccgttaggttcgttacgttcttcgtaggtacttcgttacgttttcgtacgtttaccttcggtgtacgtcgtacgtaccggtaccgggtacccgtaacctaaccgtaccgggtaaggggttacgggtcggttgggttcgggttcggttccgtaccgtaacgttacgtacctacgttaccgtggtacgtcggtacgttaaggtttaacgtttaaagttaacgtttacgtcggtaccggttaccggttaccgggtacggggtaccgggtacgttacgttaccgtacgtaccgtaccgttaccgtaccggtaacggaaccgtaacccgaaacgggtaacgtaaaggttacgtttaacgttaacgttagttaagtaacggtaaacggtaacttaaacgggtaacttaacgttaccggtaaggaacccgggttacgtaaccggggttaccggtaacgttccgggttactttacgttaacccgtttagtttcccgtttaggtttttcgtttacggggtttacccttcgggtttacccggttcccgggtttacccgggtaccgggttcccgggtttacgggttccccggggtaccgggacccggtttacccgggtaacccgttcggg

SEQ ID NO: 163673 - DNA, 760 bp, Homo sapiens
  misc_feature: GYAE6OF01D77G8.47.55.E11.1.454.CMB.1.raw
  modified_base (192)..(192): a, c, t, g, unknown or other
  misc_feature (192)..(192): n is a, c, g, or t
tcagagctcacgtacacgaccggtgctcgatttagcactcgcacgttgggtttggggagagaagacaggattcaggacaatctccagcatggccggcttccctctcctcctcaccctcctcactcactgtgcagggtcttgggcccagtctgtgctgactcacgccaccctcagcgtcgtcgggaccccggnacgacggtcaccatcgttcttgttctaggaagcacgctaccaatagtacggaaatgaataatggttaactacgtacggtaccagacctaaacgtccccgaaccggtaaacccggccccctaaaactccctacactaccttaaataacaatgaactaccgacggcccggtaccctacgggaccggggttccctaggacctactttcctccgtcggaccttaccgaaggttccctcgggaccctcgtaccgaccgtaccccctacggttccggaccctacggtacgtaccgggggtccgggttaccccgcccggggtaacccgggaggtacggttacggacgggttaccgttagtttaacgttttacgttaacggttgggtttaacgggttggggttacggactccgggactacgtccgtcggtaacgttcgttccttacggtcgtttacgggacgtcggtaaccgggtaccgttacgggtaccgtaccgttaccgtagggacccgtaccggaacccgaccgaccccaaccgttactaccgtcacccgtttccgtacccgtccctacccg

SEQ ID NO: 163674 - DNA, 689 bp, Homo sapiens
  misc_feature: GYAE6OF01AYGLB.47.55.E11.1.454.CMB.1.raw
  modified_base (127)..(127): a, c, t, g, unknown or other
  misc_feature (127)..(127): n is a, c, g, or t
  modified_base (262)..(262): a, c, t, g, unknown or other
  misc_feature (262)..(262): n is a, c, g, or t
  modified_base (646)..(646): a, c, t, g, unknown or other
  misc_feature (646)..(646): n is a, c, g, or t
  modified_base (664)..(664): a, c, t, g, unknown or other
  misc_feature (664)..(664): n is a, c, g, or t
  modified_base (675)..(675): a, c, t, g, unknown or other
  misc_feature (675)..(675): n is a, c, g, or t
  modified_base (683)..(685): a, c, t, g, unknown or other
  misc_feature (683)..(685): n is a, c, g, or t
  modified_base (687)..(687): a, c, t, g, unknown or other
  misc_feature (687)..(687): n is a, c, g, or t
tcagagctcacgtacacgaccggtgctcgatttagcactcgcacgttgggtcttgggcccagtctgtgctgactcagccaccctcagcgtcgtcgggaccccggcagacggtcaccatctcttgtcnggaagcagctacaatactacggaaatgaattaatcgtataactggtaaccagacaacgtcccaacgaaccggcccctaaaactcctcatactaataacaatgatcagccgccctagaccgggtcctagctattcntgactacagtctcggcgacctcacgcccaaccgtcggacacgtactaggtcggacgtcccggaacccggtagggtactacgggaggacctacggttaatttaactttacgttaggttagggtttaaggggttacggggtaacttccggaacgtaccggtaccgttacggtaaacgttcgtacccgttttacggtaccggtttacggacggtacgttacggggaaccgtaacggttccgtaaccgtaccgtaggttccaacggacccaaccggtaccccaaccgtaccacgttacaccgttacctccgttcccaacccgttcctactacggtaacggctaccttcgaaggtaccggacgggccttaccgggaactaccggaccgnggtaacttaaacgcgacngacgactcacntacacgannncngc

SEQ ID NO: 163675 - DNA, 899 bp, Homo sapiens
  misc_feature: GYAE6OF01DRA9I.47.55.E11.1.454.CMB.1.raw
  modified_base (223)..(223): a, c, t, g, unknown or other
  misc_feature (223)..(223): n is a, c, g, or t
  modified_base (392)..(392): a, c, t, g, unknown or other
  misc_feature (392)..(392): n is a, c, g, or t
tcagagctcacgtacacgaccggtgctcgatttagcactcgcacgtttggggtttggggagcttcagctgtggtagagaagacaggattcaggacaatctccagcatggccgcttcctctcctcctccaccctcctcactcactgtgcgagggtcgttcgggccctaggtctgtgtctgacctcacgcctaccctgacgtccgtcggtccggggacccccggngaacggaccggtaccaacctattcttcgtttggttacgagggaacgccagacctaacctaaagtacgtaacggtaaatgaataaagtgtaacgtacgtacggacctaagacgtacgaccccgaacgaacccgtaccccaaactcctacactacttaactaaacgagtanacgttaaccgacgggtacccgggccccttaggggtaaccggggtttccccgtacgggtaaccctggttttacccgtaacggtccggtacccgttaaaccggttaacggttccgttaccggggaccccttaccgttaccgaacccggtaccccttaacccggtacggtaacccgtaaacgttccgggtaacggttcggggtaacccccgggtttccccgggacccgggtaaggttaaccggtagggtaaccgttacggtaacgtttaaaccgttttaacggttacggttaggggtttaacgggtttaacgggttacgggaaaccgtttccggaaccggttaaccgttaccggttacgttaaccgggttacccgttaccggtttaccggggtttaccggttaaccgggtaacggtaaccgggttaaccggaaccggttaaccgttacccgtacccgggtaccgtaacggtacccgacgaaccccggtaaaccgccccgtaaacccgtcg

SEQ ID NO: 163676 - DNA, 880 bp, Homo sapiens
  misc_feature: GYAE6OF01DXIG4.47.55.E11.1.454.CMB.1.raw
  modified_base (225)..(225): a, c, t, g, unknown or other
  misc_feature (225)..(225): n is a, c, g, or t
tcagagctcacgtacacgaccggtgctcgatttagcactcgcacgttgggtttgggggggggaagctcagcttcagctgtggtagagaagacaggattcagacaatctccagcatggccggcttccctctcctcctcacccctcctcactcactgtgcgagggttcttcgggcccagtctgtgctgctcacgcccaccctcagccgtcgtccggggacccccggnaggaccggtccaaccctagttccttctttggttccgtaggaacgcacggtccttaacccaaattacgaaccggtaaaatttaataaacgttaggttaacttacgtcggtaacccagaccgtaaccgtaccccgaaaccgggaaaccccggtaacccccctaaaccgtccctactaacttaccttaaataaaccaattaggactccaacggcccgtacccgtacgtacggggttcccccgtagggtaccctatttcccgtggttcgggacccttaccgaacgtttcccggtcgggtccctcccgttaaccgacccgtaaccccgtaccggttccggacccttacgtacgtgggccgggtccccgtaccccgggtccccgggacggtagttccgggacgttaccgttagtttaagttttaacccgtttgggttagggtttaacgggtttacggggtttacggaaccggttccggtaccgaccggttcccggtaggttacctttacgggttccgttttaacccggttgggttcccgggtaccggttacgggttaaccgggggtaacccgtaaaccccggggttcccgttaaacccccgggtttacccggttacggttaacccggacccggacccccggtaacccggtaaacccccccg

SEQ ID NO: 163677 - DNA, 715 bp, Homo sapiens
  misc_feature: GYAE6OF01DZ1HG.47.55.E11.1.454.CMB.1.raw
  modified_base (302)..(302): a, c, t, g, unknown or other
  misc_feature (302)..(302): n is a, c, g, or t
  modified_base (347)..(347): a, c, t, g, unknown or other
  misc_feature (347)..(347): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtcgtgggctgagcgttgggttttcctttgttgtcttacttttaaaaggtgtccagtgtgaggtgcaggtagtgggacggtccgggggaggtcttagttcacggcccgttggggactcccgtagacgtactctcctgtgtacgtctcgtggtaatctagttctacgtaccttcgnggtatcgctacgtccggtccgaccctaaactccgagggtacgggngtggtaggtcggtctacgacgtactactactccgtagtagtaggctaagttagtttaataaattagtacggtaccggtacgtccgggtagggaccggggtcctaacttcgaacgtctaacgttccctacgaacggtaacgaaaccgaaccggtagaaaggttaactacgttacgtagttaaccttaggtaacgtaaactacgtaaactagtacgtaggaaggtacccggtacgaacgtaaggttacccgagtttcgttaacttgttacgttagtttcggtttaggtttcccgtaggttcccggttccggttacccggtccggtacgggttctacccggggttacgggacccgtaacgggtccctcggg

SEQ ID NO: 163678 - DNA, 871 bp, Homo sapiens
  misc_feature: GYAE6OF01DTPKJ.47.55.E11.1.454.CMB.1.raw
  modified_base (181)..(181): a, c, t, g, unknown or other
  misc_feature (181)..(181): n is a, c, g, or t
tcagagctcacgtacacgaccggtgctcgatttagcactcgcacgttgggttttccttgttgctcttttaaaaggtgtccagtgtgaggtgcaggtagtggagtccggggaggcttagttcagcctggggagtccctgagactctcctgtgtagtctctggaatcagtttcagttaccttntggatgcacgtgggtccgaccaaactccgagggtaagggctgggtgtggtcctcgacgtatcaatccgtgactggctagttagttaattaaagttgtcggtaccggtaccttcccgggtagggaccgggggtccgtaatttaccgacggtcctaacgtccctaccgaacggaacgaaccgaaaccgggacaaaggtaacgttaacttacgtagttaactacggtaaggaaatacgaaactaagttcgtaggagtaacggtacgaacggtacgttaacgggtcttacggttacttaacgttcttaggttttgtttcggttttacgagtttccggtcccggtttaccggggtcccggtaccggggtttacttccggggtacggggaaccccggtaacggggtaaccccgttgggttacccgacgggtttcccgttaccccgttaccgtacccggtacgtaccccccgttaacccgggaacccgggtaaacccggggtcccttaacccgggtttccccgggtttacccccttcccccgggttacggtcccccgtacccgtcggtacccgtaccggacgggtaccctacccccgtacccggtaccggagtaacccgacccggaccgtaccgggtccccggacccgggttggtacccgttacccggtcccggttacgggtaaccgttaaacccgg

SEQ ID NO: 163679 - DNA, 811 bp, Homo sapiens
  misc_feature: GYAE6OF01A2RT6.47.55.E11.1.454.CMB.1.raw
tcagagctcacgtacacgaccggtgctcgatttagcactcgcacgttgggtttggggagccgcagccctgggattcccagctgtttctgcttgctgatcaggactgcacacagagagctcaccatggagtcgtgggctgagtcgttgggttttccttgttgcttacttttaaaaggtgtccagtgtgaggtgcgtaggtgtggacggtccggggaggtcttagttcgacgtccgtggggtacgtcccgtgacgtaccttcgtccgtggttacgttagtccttacgtaggtaacttcgtaacgttttaccgacgtttacccgtttcgtaggtagtcgaccgtaccggtcgggtacccgaccctaaaccgtccggtaaggggtaacgggtcgttgggtcggttacggtcttacgtacgttactacgtaacgtccgtagtaagtcggtacgtagtttaagtttaacgttaaacgtttagtaccggtaccggtaaccgttccgggtagggtaacggggtaccttaacgttacgacggtacgtaccgttacccgtaacgaacggaacgtaaacccgaacggtaactaaaggtacttagtaccgttagtaacgtacgtaaaggtaaacgttacgaaaacgtcgttacgtaaggaacggttaccgttaaccgggaagttaaccggtcgtacgttgttaacgtacttacgttaggtttacggttcgtttaacggcgtttaccgggttccccgggtttccgggtaccggttacccggttacggttaccgggtaccgggcccgggttaacgggtaacccgg

SEQ ID NO: 163680 - DNA, 893 bp, Homo sapiens
  misc_feature: GYAE6OF01DV7IX.47.55.E11.1.454.CMB.1.raw
tcagagctcacgtacacgaccggtgctcgatttagcactcgcacgttgggttggggagccgcagccctgggattcccagtctgttctgcttgctgatcaggactgcacacagagagctcaccagtggagtcgtggcgtgagtcgttgggttttccttgttcgtactttaacgttttaaaggtcgtccgaggtggtgtacggtgcgtagggtcggtgggagggtccgggggtagtcgtttacggtccgagggtcccgggtaggggtaccgtcccgttagtaccgtaccgttccgtccgttggttagtacgttcgttacgtacggtaacttacgttacgtttaccgtaccgtttacccgttcggtacggtactccggaccgtaccggttacccggtacccgaacccgtaaaccggtaccggggttaacggggtaacggggttcggttaggtcgggttcgggtcctacgacggttaacaccgttacgtccgtagcggtacggtacgttaggttaagtttaacgttaaagtttcggtacgggtaccccggttacggtaccggggtacgggtaccgggggtacctacgttaccggactaccgttactcccggtaaccgacggaaaccgaacggtaaccggtaacgaaagttaacggttaacgtccgttacgtaaacggtcgttaacgaaacgttaacaccgttaagtcgacgggaacgttacggtaaccgtaacgtaccggttaccgttacgttacgttaacgttagttcccgtttaaggtttaccggtttcggtttaacctccggggttaaccttcccccggggtttaccggtacccgggggttacggttacccgggtttaccgggaacccgggtcccggttaacccggggtacccg

SEQ ID NO: 163681 - DNA, 876 bp, Homo sapiens
  misc_feature: GYAE6OF01AM9AA.47.55.E11.1.454.CMB.1.raw
  modified_base (193)..(193): a, c, t, g, unknown or other
  misc_feature (193)..(193): n is a, c, g, or t
  modified_base (251)..(251): a, c, t, g, unknown or other
  misc_feature (251)..(251): n is a, c, g, or t
  modified_base (261)..(261): a, c, t, g, unknown or other
  misc_feature (261)..(261): n is a, c, g, or t
tcagagctcacgtacacgaccggtgctcgatttagcactcgcacgttgggtttggggagagaagacaggattcaggacaatctccagcatggccggcttccctctcctcctcaccctcctcactcactgtgcagggtcttgggcccagtctgtgctgactcagccaccctcagcgtcgtcgggacccccgggnacgacggtccaccatctcttgttctggaagcagctccaatatcggaatgataatgtanacgtgtaccngacaacgtcccaacgaaccggcccctaaactcctcatacctaataaacctaatacgactcgacggtcccggtaccctaccggacggggtcccctagggtccgtatttcccgtcgtcggtccctaccgtaacgtccggtcggacccgtcccttaccgaccggtaccccgtaccccgttcgggacccctacgttaccgacggggttcccgggtcccgttacccccgggggacccggtagggtacgtacgggtacgggtcgtttaacgggtaacttttaacgttaccgggtttgggtttaacggggtttaacggggttacgggtacggttaccgggtacccggtacgttacccgggtttaacggtacccggtttacggtttccccggttttaaaccgggtttcccggtttaccggggtaaccggttcccggggtaaccgggaaaccccggtttaaccgggtacccccgttaacccggggtttaacccccggttaaggggttaccccaaaccccgggtaaccccccggtaaaccgggaaccccccctaaacccccggttacgttccgtaaccccgttacccgtttccctacccccgttttccccccgttaaaccccccg

SEQ ID NO: 163682 - DNA, 775 bp, Homo sapiens
  misc_feature: GYAE6OF01AYGEH.47.55.E11.1.454.CMB.1.raw
  modified_base (176)..(176): a, c, t, g, unknown or other
  misc_feature (176)..(176): n is a, c, g, or t
  modified_base (189)..(189): a, c, t, g, unknown or other
  misc_feature (189)..(189): n is a, c, g, or t
tcagagctcacgtacacgaccggtgctcgatttagcactcgcacgttgggtttggggagccgcagccctgggattcccagctgtttctgcttgctgatcaggactgcacacagagagctcaccatggagtcgtgggctgagtcgttggttttcttgttgtcttacttttaaaggtntcagtgtgagtgngtaggtggtggacggtcggggagtcgttagtcgacggtcggtgggtactccgtgacgtacctcgtccgttgtacggttagtcgtcgtagtaacttcgttacgtttacgtacgttacctttcgtaggtatcgccgtacggtcggtacccgaaccgtaaccgtaccggtaaggggtacgggtcggtcgggttagggttccggttcacgtacgttactacgtaactcgtagtacgtcggagttaagttagtttaaagtaattacgtcgtacggtccggttacgggtacgggtacggtacctagttacgacgtactacctaccgtacgtaagacgaaacgtaacggtaacgtaagtaacgtacgttaaccgttaggttaactacggtaaaggttaacgtaaacgtaactaaggttcgtaaacggtaggtaccgggtaacgtaacgggtaaccgttagtaccgttagttacttacgttggtttaacgttttggtttacggtttcgttcggtttaccggttcccgggttccggtccgggttaccggttaccgggttaccgggtacgggtacccgggtaaccgggttacccgg

SEQ ID NO: 163683 - DNA, 794 bp, Homo sapiens
  misc_feature: GYAE6OF01AVDZN.47.55.E11.1.454.CMB.1.raw
  modified_base (571)..(571): a, c, t, g, unknown or other
  misc_feature (571)..(571): n is a, c, g, or t
  modified_base (771)..(771): a, c, t, g, unknown or other
  misc_feature (771)..(771): n is a, c, g, or t
  modified_base (781)..(781): a, c, t, g, unknown or other
  misc_feature (781)..(781): n is a, c, g, or t
  modified_base (786)..(786): a, c, t, g, unknown or other
  misc_feature (786)..(786): n is a, c, g, or t
  modified_base (790)..(790): a, c, t, g, unknown or other
  misc_feature (790)..(790): n is a, c, g, or t
  modified_base (792)..(792): a, c, t, g, unknown or other
  misc_feature (792)..(792): n is a, c, g, or t
  modified_base (794)..(794): a, c, t, g, unknown or other
  misc_feature (794)..(794): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtcgtggctgagtcgttcggtttttccttgttgtactttaacgttttaaaaggtcgtaccgtaggttggtaggaggttgacgtagggttaggtagggtacgggtaccgggggtagttcgtttaaggttcgaaccggtccggtcggggtaccgttccgtaggaacgtaccgttccttccgttgttacggttacgttcgttacgtagtaacttcgttacgtttacgtacttaccgttgtaggtatcgacgtaccggttccgggacccctaaccgtaacccgtacggaacggggtaacccgggaaccggtaacccggtaccgtcggtaccgtacggtccgtcctaccgacgaccgtacccgaccgaaccggtaccgtacccgtaccgttcccgttcccgtaccccggtcggtcccgtcccgtaccgacccgtaccggaacggtaccncccgtaaccggaccggtacgaccgacgaaccgtccgggacccgttcccgtccggtacccgtcggtaccgtacgggtaaccgttaaccgtacccgttaccgttaccgtacgtcggtacgtcccgtggtaccggtcggtaccgggtacgttaccgggaacccggtaggaccgtacggtaaaggtcaccgttgagccgtaganccgtagactnagtgntcgngngn

SEQ ID NO: 163684 - DNA, 823 bp, Homo sapiens
  misc_feature: GYAE6OF01DABR3.47.55.E11.1.454.CMB.1.raw
  modified_base (805)..(805): a, c, t, g, unknown or other
  misc_feature (805)..(805): n is a, c, g, or t
  modified_base (820)..(821): a, c, t, g, unknown or other
  misc_feature (820)..(821): n is a, c, g, or t
  modified_base (823)..(823): a, c, t, g, unknown or other
  misc_feature (823)..(823): n is a, c, g, or t
tcagagctcacgtacacgaccggtgctcgatttagcactcgcacgttgggtttgggggggaagaggaagactgacggtcctgccacaggtggtgctgggcacggtgggcactcgacacaacattttgcgctcaactgtcttgctcaccagtggagtctgggctgagcgtttgggttttccttgttgtcttacgtttttaaaaggtgttccagtggtgaggtgcgtagggtaggtgggagggtccgggggagtacgtttagttcgacggtccggtgggggacgttcccgtggacgtacttccgtccgttaggttgttacgttcctcgtaggtaacgttcgtacgttttcgtaccgttaccgtttcgtggtactacggcctaccggttccgggtacccgaacccgtaaaaccgtcccgggtaaggggtaacccgggggaccggtaaccggggtaaccccgttgggtaccggaacggtccggttccttaccgtaccgtaccgacccctaccccgaacccggtaaaccggggtccctaaccgttccccgggttcccgtttacccccggtcgggtcccgttccccgtacgtcccgtaccggtacggcccgtacccgtaaccccgtaccggaacggccgtaccgaaccggacccggtcccgggtcccgtcccgggtacccgtcggtacccggttacgggtaacccgtaaccgggtaacctttcccggttaccgttaccggtacgggtacgtccgttaccgtagggccgggtaccgggttcgggaccgggacggtaccgcggactaggtacngactgagcgacatgnngn

SEQ ID NO: 163685 - DNA, 759 bp, Homo sapiens
  misc_feature: GYAE6OF01B4C57.47.55.E11.1.454.CMB.1.raw
  modified_base (639)..(639): a, c, t, g, unknown or other
  misc_feature (639)..(639): n is a, c, g, or t
tcagagctcacgtacacgaccggtgctcgatttagcactcgcacgttgggttttccttgttgctcttttaaaaggtgtccagtgtgaggtgcaggtagtggagtccggggaggcttagttcagccgtggggagtccctgagactctcctgtgtagtctctggaatctagtttcagtaccttctggatgcacgtcgggtccgaccaaactccgagggtaagggcgtgggtggtagggtctcgacgttactactaacttccgtgagtgggacgtagttagtttaaagttaaaatttacgtcggtacgggtaccgttacccggtgggaacgggggtaccgtagttaccacggctaactccgtccgaagaacgaacgaacgggacaaagtaagtaattacgtagttacgtacgtaaggaaatagaaactaatcgtagaaggtacgtacggaacgtacgtacggtcttagtacttaatacgttagtttcggtttacgtttcgtacgttcgttcccggttacgggtccgtacgggttaccggttcgggacgggtacccgaacgggtaacccgtggtacctacgggtccttacctcgacgtacccgcccgtaaccgaacccggacgtaccctcgttaccgttcccnccccgggtcggccctacccgtgtacccgtggaccgacgccgacccgtagggactacggcccgtaagccccgggtacccgggtcgtggacccgtcgggtccttaggggaacccttaacggg

SEQ ID NO: 163686 - DNA, 784 bp, Homo sapiens
  misc_feature: GYAE6OF01B85PT.47.55.E11.1.454.CMB.1.raw
  modified_base (384)..(384): a, c, t, g, unknown or other
  misc_feature (384)..(384): n is a, c, g, or t
tcagagctcacgtacacgaccggtgctcgatttagcactcgcacgttgggtttggggccgcagccctgggattcccagctgttctgcttgctgatcaggactgcacacagagagctcaccagtggagtcgtgggctgagtcttggttttcctgttgcttacgttttaaaaggcgtccagtgtagaggtcgacgaggtagtggtacggtcgggggagtcgtttagtcgacggtccgtggggacgtcccgtagacgtacctcgtcgtaggtgttacggtctcgtggtaactcgtaagtttccgaagttccttagtacggagttcgaccgtacgtcgggtaccaccgttaaacgtccgaagggtacgggtctcggtagtcggttacncgtaacgtactactaagtccgtagagtacggtcgtaagttacgttaaataaacgttgacggtaccgaccgtttcggacggtacgggtacctagtacctacgatacgtacgtaacgtaggaactacggtaaacggaactaaaggtaagttaccgttaaccgtagttaacgttacccgtaaaaggtaaacgttaacgaacgttaaacgtcggtagtaaacggtacggtaaacccggtagtaaccggttaaccgtacggtttaccgaaacgtttactcggttttaaaacgtttacggttttgtttaaccggtaagttacccgggtttaaccgttcccggggtaccgttaaccggggttactttcggggaacccgggtacggttaacccgggaccgtttacggg

SEQ ID NO: 163687 - DNA, 747 bp, Homo sapiens
  misc_feature: GYAE6OF01D39T4.47.55.E11.1.454.CMB.1.raw
  modified_base (619)..(619): a, c, t, g, unknown or other
  misc_feature (619)..(619): n is a, c, g, or t
  modified_base (665)..(665): a, c, t, g, unknown or other
  misc_feature (665)..(665): n is a, c, g, or t
  modified_base (673)..(673): a, c, t, g, unknown or other
  misc_feature (673)..(673): n is a, c, g, or t
tcagagctcacgtacacgaccggtgctcgatttagcactcgcacgttgggtttgggggccgcagccctgggattcccagctgtttctgcttgctgatcaggactgcacacagagagctcaccagtggagtcgtgggctgagtcgttgggtttttccttgttcgtcttaagttttaaaaggtcgtcctaggtgtggaggtgcgtagggtaggtgggacgggtccgggggagtcgttagtcacggccggtgggacgtccctagacgtacctcgttccgtagttgtacgtcctgtaggtaatcttagtttaccgtacgttaccttcgtaggtctcgccgtaccggtccgggtaccccgaacctaaaccgtccggaagggggtacggggtcgttaggggttcggttcggtaccttaccgtaacgttaactacctaacgttaccgtagtacgtacggtacttaaggtttaagtttaaaagttaaagttagtaccgggtaccggttaccgtaccgggtagggaccgggtaccttacgtacgacgacttacgtccgaacgtaacgaacgtaacccggaaagtacgtaagttaatacgttacgtaggtaccttaaggaacggtaaanaggtaaacctcgtagtaacgacggttacggacgtacgtagtccgtnttaccgtntattgtatttgttacgtactcgttcgtacccgttcggcggttccgtacggtcggacggaccgtaccgtggtccg

SEQ ID NO: 163688 - DNA, 900 bp, Homo sapiens
  misc_feature: GYAE6OF01DNV3L.47.55.E11.1.454.CMB.1.raw
  modified_base (127)..(127): a, c, t, g, unknown or other
  misc_feature (127)..(127): n is a, c, g, or t
  modified_base (754)..(754): a, c, t, g, unknown or other
  misc_feature (754)..(754): n is a, c, g, or t
tcagagctcacgtacacgaccggtgctcgatttagcactcgcacgttgggtttgggggccgcagccctgggattcccagctgtttctgcttgctgatcaggactgcacacagagagctcacagtggngtcgtggctggagtcgtttggttttccttgtcgtacgttaacgtttaaaggtcgtacgtggtggtggtaggtgacgtaggtaggtgggtacggggtaccgggggtagttcgttacggttacggacggtccggtacggggtaccttccggtagtaacgttccgttccgttaccggttgggttacggtttaccgtttcggttacggttaggttaaacctttaccggttttacggttttaccgttaacggtttacccgttagggttacggtacgttaccgggtaccgtaccggggttaccgggtaaccccggaaaacccgtaaacgggttaccgggtaagggggttacgggttcggttcggggttcgggttacggttactaacggtacgttactacgttaacgtcgtaggtagtacggtagttaagttaattaaagtagttcggcggtaccgtcggtacgggtaccggaggttctagtacgcgtaactaccgtccgaaaggaacgtacggaacgaacggtaacgtaacggttattacgtagttaagtacgttaggaaacgtactaagtaaactagtggtaaccggaagtcggaacccgttaagttacgccggtttattaacgtaccgttntttacgttacgttttaggtttaccggtcgttcccggtttaccgggttcccgggttaccggggtacccgggttttaccggttaacccgggtttccgggggtaaaacccccgggtccccggtttaaaaggggtccccttaaccggggg

SEQ ID NO: 163689 - DNA, 821 bp, Homo sapiens
  misc_feature: GYAE6OF01DLWSS.47.55.E11.1.454.CMB.1.raw
  modified_base (194)..(194): a, c, t, g, unknown or other
  misc_feature (194)..(194): n is a, c, g, or t
  modified_base (255)..(255): a, c, t, g, unknown or other
  misc_feature (255)..(255): n is a, c, g, or t
  modified_base (753)..(753): a, c, t, g, unknown or other
  misc_feature (753)..(753): n is a, c, g, or t
tcagagctcacgtacacgaccggtgctcgatttagcactcgcacgttgggtttggggagagaagacaggattcaggacaatctccagcatggccggcttccctctcctcctcaccctcctcactcactgtgcagggtcttcggccagtctgtgctgactcacgccaccctcacgccgtcgtcgggacccccggnagccggtcactatccttcttgttcgtaggacgcagtcctacaatagtacgaatgtataatntagacgtcggacagtacaaccgtacccgaaccgtaacccggacccctaaaatcccgtactaaactacttaaacgtaaaacgtaactacggtaacctacggaaccggccccggtacccgtacgggtaacccggggttcccgtaaggtccccggtttaactttcccggactttcgggaccctttacggtaaacggttccgtaccgggcccgttaaccctccggtaacccgtccccgtaaaccccggttcggaacccgtaacgtttacccgggtaacggggtcccgggggtaccccgtaaccccgggtacccggggaaggtaaccggttacggggaaccggtttacgttaacggttaacgttttaaacggttacggtttagggttacgggtttaacggggttacgtacggtaccgtagacggtaccgttacgtaccgtcgttaccgttaccgttacggcgtacgacggtacgaccgtacgtccgtaccgttagaccggtanaacccggtacccaccgggacccctacgtaccgtcgtacctacccgttcgtccccggttccctaccccg

SEQ ID NO: 163690 - DNA, 741 bp, Homo sapiens
  misc_feature: GYAE6OF01AHJNG.47.55.E11.1.454.CMB.1.raw
  modified_base (211)..(211): a, c, t, g, unknown or other
  misc_feature (211)..(211): n is a, c, g, or t
  modified_base (243)..(243): a, c, t, g, unknown or other
  misc_feature (243)..(243): n is a, c, g, or t
  modified_base (337)..(337): a, c, t, g, unknown or other
  misc_feature (337)..(337): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcacgcccaccctcagcgtcgtcggggacccccgggnacggaccggtcaccatcttcttgttctggaancagctacaatatacggaatgataatgtatacgtggtaccagcaacgtccccaacgaacccggaccccctaaactcctacatactaataacatanactcacggccgtccctacggtaccggggtccctcggcctattcctacgtcggtacctccgtaaggtccgtcggacctcccgtcgaccgcccctacccgtcggccctactccggacggtaccggggtcccgtacccgggtacccggagggtaacgtcgggtacgggtacctaggttaactttacgtttaccgttaggttacgggtttaaggggttcgggtaccggttaccgacgtaccggtcccgttacgtaccgttcggttaacccgtttacggtccggtttacgggtacggtaccggttacggggaacccttaccggggttacccgtaccccgggttaccgttaccgggtaacccgacccggtaaccccggaacccggtaacccccgtaaccccttaacccgg

SEQ ID NO: 163691 - DNA, 798 bp, Homo sapiens
  misc_feature: GYAE6OF01ALQ6I.47.55.E11.1.454.CMB.1.raw
tcagagctcacgtacacgaccggtgctcgatttagcactcgcacgtttgggtttgggggccgcagccctgggattcccagctgtttctgcttgctgatcaggactgcacacagagagctcaccatggagtcgtgggctgagtcgttgggttttccttgttgtcttacgttttaaaaggtcgtctagtgtgagggtgcgtagggtaggtgggacgggttccggggggaggtcgtttaggttcgacggtccggtacgggggacgttcccgtaggacgtaccgttcctccgttgttgtagttctgtacggaatcgttagtttctacgttaccttcgtggtatcgaccgtacggtccgggtaccccaaccgtaaccgtaccggaagggtagggtcgttgggtgggttcggtactacgtacgtatacgtaactcgtagacgttcggacttagttaagtttaataacgtttacgtacgggtaccgtaccggttaccgggtaggggtaacccgggtacggttattacggtaaccgtactaccgtaccgttaaccggaacgggtaacctaaaccggaaacgggaacgtaaagtaacgtttaactacgtttaaggtaactacggtaaagtaaactacggtaaatacggttacgaaggtaacggtaggtaccgtaaaggtacggttactagtagttaccttagttctttagttccggttttgtttacggttacgtttccggtccggtttaccgggcgtttacggggtaccgttccggggtacggtacccggtaccggggtcctacggg

SEQ ID NO: 163692 - DNA, 783 bp, Homo sapiens
  misc_feature: GYAE6OF01ECLXO.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcgaggtagtggagtccggggagcttagttcagcctgggacgtccctgagctctcctgtgtagtctctggaatctagtttcagtaccttctggactgcacgtcgggtccaccaagtccgaggttaaggggccttgggtagtcgggtctcacgtatacaacttcctgtacgtcggactagttagttaataaacgttgtcggacgtacgtaccggtggacggggtcctacgttcacggtctacgttccgtaccgaaggtaaccgaaacggaaaccggacgtaaacgggtagttaacgtaacgttagttaacgttaccgtaaaggtaaacgtacggtaaaccgtaacgttacgtacgggtaaacggtaacggttacccgggtaaacgggttaaccgttacggtacgtttacgggttaaccgttaccgttaaacggtttcggttttaaccgggtttttacggtttaacccggttacggtttaaccccgggttttccccgggttacccggggtttacccccgggtaacgggtttaccccgggtttaccgggggtaacccggggttaaaccccgggttacccgggtaacccggttttacccgggg

SEQ ID NO: 163693 - DNA, 754 bp, Homo sapiens
  misc_feature: GYAE6OF01ETJCI.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagtcttgggttttccttgttgcttacttttaaaaggtgtccagtgtgaggtgcaggtagtggaggtccgggggagcttagttcagccgtggggagtccctgagcctctcctgtgtagtctctggaatcgtagttcagtaccttgtgtatgcacgtcggtacccgacaaacgtccgtagggtaagggtcgtggtggtcggtctcacgtatacgaacttccgtagtagtggtacgtagttacgtttaaattaaacgtttagcggtaccggtaaccgtccggtagggacggggtacctatttaccgacggtacctagtcccgttaaccgaacggaacggtaaacccgtaaaccggtacgtaaacggttaacgttaacgttaaccgtttacggttaacgttaccggttaaagggtaaactaacgtaaaactaacgttcgtaacgggaaggtaacgggtaccgtaaacggtacggttaccggtagttacgttacgttacgttacgttacgttttaggtttcgtttaaccggtggttaccgttcccggggttaccggtccgggtaccgggtttaccgttccggggtaaccgggtacccggtaacccggggtacccgttacggg

SEQ ID NO: 163694 - DNA, 862 bp, Homo sapiens
  misc_feature: GYAE6OF01BMD9Y.47.55.E11.1.454.CMB.1.raw
tcagagctcacgtacacgaccggtgctcgatttagcactcgcacgttgggtttggggagcttcagctgtggtagagaagacaggattcaggacaatctccagcagtggccggcttccctctcctcctccaccctcctcactcacgtgtcgcgacgggtcgttcgggccctagtctgtgctgtacctcgacgcccaccctcgacggtccgtccggccggggacccccggagtacggaccggtccacctagttccttcgttacgttcgaggacgacacgtcctacaagtacgtaacgtaagtgtaattaagtagtaacgtaacgtacggtaaccaggaccgtaacccggtaccccgaaaccggaacccccggaaccccctaaaaccgttccctaacctaaccttaaccggtaaacaaaccggtaagtcgtaacctacggaccggtaccccgtcccggtacgggtacccggggttcccgtaggtaccccgttcttacccggcgtaccgggtacccttaccgtacgtcccggttacgggaccccttcccgtacgacccgtacccccgtacggtccgtaacccgtaagttacgaccgggggttcccgaaccccggtccccgggaaacggtaagggttagccggacgggtactttaacggtacgttttaccgtaacgggtttgggtaccgggtttaagggggccgtaaccgttccgaccgttaacggtcccggtagttacggttccttaaacccggttcgggtaacgtcggggtaccggacgggtttaaccgaacggttaccggtcccgtaccgggttaccgtgggaccccaacccgaacccgggaccctacccctaaacccgggttc

SEQ ID NO: 163695 - DNA, 580 bp, Homo sapiens
  misc_feature: GYAE6OF01AX5NM.47.55.E11.1.454.CMB.1.raw
  modified_base (297)..(297): a, c, t, g, unknown or other
  misc_feature (297)..(297): n is a, c, g, or t
  modified_base (355)..(355): a, c, t, g, unknown or other
  misc_feature (355)..(355): n is a, c, g, or t
  modified_base (369)..(369): a, c, t, g, unknown or other
  misc_feature (369)..(369): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggttttccttgttgctcttttaaaaggtgtccagtgtgaggtgcaggtagtggagtccgggggagcttagttcagccgtggggagtccctgagacttctcctgtgtagtctctggaatcagtttcagttaccttctggatgcacgtgggtcccncaaactccgaggtaagggctgggtgtgggtctcacgtatcaatcctgatggctagttnttaataaatttagngtcgggacttaccggtgggacggggtcctattcgatctatcctaccgagacgaaccgaaacggacaaagagttatacttgtatacgtagaaatgaactaagtcgtagaagacgtacgacgtaacgtacggtctagtctatctagtttgttgtttcgagttcgtccgttcggtccggtcggtacgttcggagggtccgacgggtcccgtcgg

SEQ ID NO: 163696 - DNA, 741 bp, Homo sapiens
  misc_feature: GYAE6OF01A4HEM.47.55.E11.1.454.CMB.1.raw
  modified_base (193)..(193): a, c, t, g, unknown or other
  misc_feature (193)..(193): n is a, c, g, or t
tcagagctcacgtacacgaccggtgctcgatttagcactcgcacgttgggtttggggagagaagacaggattcaggacaatctccagcatggccggcttccctctcctcctcaccctcctcactcactgtgcagggtcttgggcccagtctgtgctgactcagcccaccctcagcgtctcgggacccccgggnagacggtcaccatctcttgttctggaagcagctccaatatcggaaatgataatgtatactggtaccagcaagtcccacgaaccggccccaaactcctcatctataacaatgatcagccggccctcgacggggtcccctcgggcccgtactttcctccgtcgggccttacccgtaaggtccgtcgggcccgtccctccgtacggcccctaccccgtcggcccaacgtccgtaggggtcgggtacccgttcccccggggacccggagggtacgtacgggacgggtcttacgggtaattttaacgttttaaccgttgggttcgggtttaaggggtttcggggtacttccggtaccgtacggtacccgtcggtaaccgttcggtaccgttttaaccggttccgttaccgggacgtccggtacggggaacccttaacgggtcccgtaccccggttccgttacgggttcccgaccggaccccgaaaccgggccccctaaacccccgtacgttaccgtacccaccgttacccgttccgttcccccctaacccccg

SEQ ID NO: 163697 - DNA, 675 bp, Homo sapiens
  misc_feature: GYAE6OF01A5ZX5.47.55.E11.1.454.CMB.1.raw
  modified_base (162)..(162): a, c, t, g, unknown or other
  misc_feature (162)..(162): n is a, c, g, or t
  modified_base (170)..(170): a, c, t, g, unknown or other
  misc_feature (170)..(170): n is a, c, g, or t
  modified_base (172)..(172): a, c, t, g, unknown or other
  misc_feature (172)..(172): n is a, c, g, or t
  modified_base (203)..(203): a, c, t, g, unknown or other
  misc_feature (203)..(203): n is a, c, g, or t
  modified_base (215)..(215): a, c, t, g, unknown or other
  misc_feature (215)..(215): n is a, c, g, or t
  modified_base (271)..(271): a, c, t, g, unknown or other
  misc_feature (271)..(271): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagcgtgtttctgtgctctttaaagngtcagtgngngtgcagtagtggagtcggggagcgttacgtnacgcgtgggacnccgtgagtcctctcgtgtgtactctacgtgtaattcgtagtttacagttacccttntggatacgccagtcggtacctaccaacgtacgagggtaacggctggtcggtaggcctagactagtcaagtctgactcgtagagttataaagttaaattgaccgtacggtaaccttcgggtagggtaccgggtcttaatcgacgtctaacggtcccttaacgaacgaacgggaaacaccggtaaagaaggtaacttaagttacgtacgttaagtacggtaagtaagtaagttaacgaattacgaacggtaacgtacgtacggtaacggtaacgtacgttaacgtcgttaacttaaacgtggttctttagtttacgtttcgttacgttaccggttccggttacccggttacggttacggttaccggttacgggttaccgggtaccgggtacccggtaccggtacgg

SEQ ID NO: 163698 - DNA, 852 bp, Homo sapiens
  misc_feature: GYAE6OF01A7BEP.47.55.E11.1.454.CMB.1.raw
tcagagctcacgtacacgaccggtgctcgatttagcactcgcacgtttggggtttgggggagcttcagctgtggtagagaagacaggattcaggacaatctcagcatggccggcttccctctcctcctccaccctcctcacctcactgtgcgtagggttcttcgggcccagtcctgtgctgactcacgcccaccctcgacggccgttccgtacccgggggacccccgggtacaacggtaccggttcctaccgtacttcgtttacctttggttaccgtagggtaaaccggcaacgtacctacctaaagttaacggtaaccgggtaaaattaggtaaaactttaaagttacggttaaacttaacggtaccggttaaacccaggtaacccgaaaccggttacccccgaaacccgggaaaccccggtaaccccccttaaaaccttccccgtacctaaacttaccgtaaactaaccggaaattaccagttaccgacggtacccggccgtacggaccgggtaccccgtcggtaacccgtacgttccgtcgtggaccgtaccgtaacgtcgttcgggacccttccgaaccgtacgaccccgtaaccgtcggacctaccgtacggtaaccgtcggggtaccccgccggaccgtacgggacgtaacggtacggtaccggtagttaaccgtttagttacgttaacggttaggttacgggttacggtacgtccgtaaaccggtgtaccgtcgtacgtagttaccgttacggtaccgtccggaaggtccggttaaccgggaacgtacggaccgtacccgtacgtacgtaccggacccggaacctaaccgccctaaccggtcccg

SEQ ID NO: 163699 - DNA, 773 bp, Homo sapiens
  misc_feature: GYAE6OF01BIEND.47.55.E11.1.454.CMB.1.raw
  modified_base (197)..(197): a, c, t, g, unknown or other
  misc_feature (197)..(197): n is a, c, g, or t
  modified_base (446)..(446): a, c, t, g, unknown or other
  misc_feature (446)..(446): n is a, c, g, or t
  modified_base (459)..(459): a, c, t, g, unknown or other
  misc_feature (459)..(459): n is a, c, g, or t
  modified_base (716)..(716): a, c, t, g, unknown or other
  misc_feature (716)..(716): n is a, c, g, or t
tcagagctcacgtacacgaccggtgctcgatttagcactcgcacgttgggtttggggagagaagacaggattcaggacaatctccagcatggccggcttccctctcctcctcaccctcctcactcactgtgcagggtcttgggcccagtctgtgctgactcacgcccaccctcaggcgtccgtcggggacccccggnaggtaccgtcaccagttccttcgtttagttcgaggaacgccgaacgccctaactaagttacggtaacgtaatagtaactagtagtacgtacgtacgtacacgtacgaccgtacccgaaccggacccgaccctatccgatatacctaaagtaactacgtacgtacgaccgaccgggtacccgtaccggtacggggtacccggtccgtaccgggtaaccttcgttccgtacggtccgtacctaaccggttnttccgggctaccnccgtacgacccacccgtacgtacggtacctagttcgggaccggtccggtccccggtacccggaaggttacggacgtacgggtactacgttacgttaactttaggttaccggttagggttacggggtcgggttacgaacgttccggacttaccgtacggttactcgttacgtacgttttaccgtagggttccgacggtcgggtaaccgtacgtacccgttacgtcccgtagtaaccgtcccgaaggtaccccggttcnccgttaccccgtacccgtcgtacctttaccgacccccggttccgtcccccgttacgg

SEQ ID NO: 163700 - DNA, 742 bp, Homo sapiens
  misc_feature: GYAE6OF01EHLPV.47.55.E11.1.454.CMB.1.raw
  modified_base (392)..(392): a, c, t, g, unknown or other
  misc_feature (392)..(392): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctggctgagcttgggttttccttgttgtcttacttttaaaaggtgtccagtgtgaggtgcgaggtagtggaggtccgggggagtcgttagttcgacgtccgtggggacgtcccgtgacgtactccttccgtgttgtagtctcgtaggaacttcgtagttttctacgttacctttgtggtatgctaccgtcgggtaccccgacctaacgtaccgaagggtacggggtcgtgggtggtcggtctcgtacgtactctaactctagngtcggactagttagttaataagttgtacgtacggtacgtcggtggacgggccgtagttacgacgtactacgttcccgtacgaaggaacgtaacgaacggacgaaagtcgttaactacgttaacgttagtacgtaagtaagtacgaaacgtagttacgtaaggtacggtaaggtaccgaacgttacggttaaccgtcgttattaccgttattacgttttaacgtttaccggtttttacgtaccggtttcccggttacccgggtttcccgggttcccgggttacccgggttacggttttcccggggaccggggtaacccgggtaccgggttaacccgtcgggttaacccggg

SEQ ID NO: 163701 - DNA, 866 bp, Homo sapiens
  misc_feature: GYAE6OF01B7PDP.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtcgtgggctgagtcgttcgggttttccttgttgtcttacgtttttaaaaggtcgtcagtgtggaggtgcgaggtagtgggacggtccgggggagtcgttagttcgacggtccggtggggacttcccgtgacgtacctcctccgttgtgtacgtcgtacgtagtaattctacgtttactacgttaccttcgtggtatcgtacgaccggttccgggtaccccaacccgtaaaccgtccggtaaggggtacgggtcggttgggtcgggttcggttacctacgtaacgttactaactaacgttccgtagtacgtaggtacttaaggtttaagtttaaaattaacgtttacggtacggtaacccgggtccggttaccggggtagggggtacccgggtaccgttaacgttaccgaacggtactaccggtttaccctaaaccggaacgggaaaaccgtacccgaaacgggtaacgtaaaggtttaccgttaatacccggtttaataacccgggtaagttaaacgtaaacgttaacgtaactacgttacggaagggtacgaaccggttacccgaaaggtaccggttacggtcctttaagtccgttaattggttttaacggttcggttttaaccgttcggtaacccgggtttccgtttcccccggggtacggttcccgggttaccggttaccgggttccgggggtaaacccggggaacccccgttaacgggggtccccgttacgggg

SEQ ID NO: 163702 - DNA, 940 bp, Homo sapiens
  misc_feature: GYAE6OF01E25G8.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcgaccagtggagtcgtgggctggacggtcgtttcgggttttccttggtcggtacttaacggttttaaacggcgtccgtaggtgtggtacggtgacggtaggtaggtcgggacgggtcggggagtcttacgttcgacggtccggtggggtacctccggtagtaacgccttccgttcgtaggttcgttagtcgtacggtagtatccgttagttacctacgttccgttggcgttacgttacgccggtaaccggtcgggtaccccaaccgtaacggtccgggtaagggtacggtcggtaggtcggttaccggtctacgttaacgtactacgtaaccgttcggagtacgacgtacgttaggtaaacttaaagttaaaccggttgaccggtaccccggaacggtttccggggtaacgggacggttaccgggtacttacgtacggaccctttaacgtacccggttaacggaaacggaacgggtaaacccgtaacggggtaaacgttacggtaaacgtttaacccggaaacgttttcggtaaacccggtttaaggaaaccgggtttaaagaaaccggtaaacccgggttactaagggggttaccgtaaaccggttaaaccgggacggtaaaacggttaacccgggtttccggtaaggttttaccctaaggttaccctttgggtttaacgttttaacccggggttttcggttttacgcccgggtttttaacggtccccccgggtttaacgggggtaccccgggtttagggtacccccgggtttaccgggggagggtaaccccccgggtttaccgggtaacggttcccgggg

SEQ ID NO: 163703 - DNA, 770 bp, Homo sapiens
  misc_feature: GYAE6OF01CR1OX.47.55.E11.1.454.CMB.1.raw
  modified_base (242)..(242): a, c, t, g, unknown or other
  misc_feature (242)..(242): n is a, c, g, or t
  modified_base (710)..(710): a, c, t, g, unknown or other
  misc_feature (710)..(710): n is a, c, g, or t
tcagagctcacgtacacgaccggtgctcgatttagcactcgcacgttgggtttggggagagaagacaggattcaggacaatctccagcatggccggcttccctctcctcctcaccctcctcactcactgtgcagggtcgttcgggcccagtctgtgctcgactcacgcccaccctcagtccgtcgtccggggacccccgggcacggaccgtccacctattcctcttgttcgtaggaagcacnctacaatagtacgaaatgtaatagttagtaactacgtacgtaccgagacctaacgtccccgaacggtaaccccgaccccaaacttcctactactactaataaactatagtactcgacggcccgtacccgtcggaccgggttcccgtcggtacccgttcttccgtccggtcggtaccctacgaacggtccgtcgggccctacctccgaccgaccccgtacccgtcgggacctacggtccggtacgggtcccgggtcccggtaccccgggtaccgggacggtacgtacgggacggttacccgttaggttaactttagtttaaccggttggggtttacgggttacggggttacggtaccgtcgtacgccgacgttacgtacgtcggttaccgtttacggttccgtaggcgtaccggtacggtaaccgtacggtcccgtacgttccgtacgtccgaaccgaacccgtaaccncccccgttaacgaccttccggttaccctaccgtttcccgtccccgttccccgtaaccccg

SEQ ID NO: 163704 - DNA, 809 bp, Homo sapiens
  misc_feature: GYAE6OF01AZAPM.47.55.E11.1.454.CMB.1.raw
tcagagctcacgtacacgaccggtgctcgatttagcactcgcacgttgggtttgggggccgggcagccctgggattcccagctgtttcgtgcttgctgatcaggactgcacacagagagctcaccatggagtcgtgggctggagtcgttcgggttttccttgttgcttacttttaaaaggtcgtccagtgtgaggtgcgtagggtagtgggaggtccgggggaggtcttagttccacggtccgtggggactcccgtagacgacctctcgtgtgtagtctagtggtaatctagttcgtagttaccttcgtggactgctacgtccggtaccacctaaacctcgaggtagggctggtgtcggtctcgtagtactacacgtccgtagacgtcggactagttaacgtttaaagttaacgttagtccggaccgggtaccttccgggtacgggtaccgggtaccgtagttcgacgtactaccgttaccgtaaccgacggaaccgtaaaccggaaccggtaacgtaaacgttaagttaaacgttacgttaaacggttactaacgggttaaacgaaacgtaacgtaaaacctacgttaacggtcggaaacggttaacggttaccggaaacggttaacggttaaccggttcggttaacggttacgtaagttaccgtttaggtttacgggtttaccggtttaaggtacccggtttacccggtacccgggtttcccgggtccccggtttacccggggtaacccggtttccgggtaacccggggggttaccccgtacccgggggttaacccgttccccgggg

SEQ ID NO: 163705 - DNA, 696 bp, Homo sapiens
  misc_feature: GYAE6OF01DG5J6.47.55.E11.1.454.CMB.1.raw
  modified_base (219)..(219): a, c, t, g, unknown or other
  misc_feature (219)..(219): n is a, c, g, or t
  modified_base (677)..(677): a, c, t, g, unknown or other
  misc_feature (677)..(677): n is a, c, g, or t
tcagagctcacgtacacgaccggtgctcgatttagcactcgcacgttgggtttggggagctgtggtagagaagacaggattcaggacaatctccagcatggccggcttccctctcctccctcaccctcctcactcactgtgcgagggttcgttcgggccccagtcctggtgctgactcacgcccaccctcgagtccgtccgtccggggaccccccgggnacggtaccggtccacctattcctctttggttccgtagggaacgccagtccctaaccgaaagttagtaaccggaaattgaattaattgtaaactcgtaggtacccagtcaaccgtcccaacgaaccccgccccaactctcatactaataaccatcgataccgagccgccctagaccggggtcctgggacctcttcgtcgcggcctacgacgtcgtaccggcctcctacgcccgcccacccggttgaccctgtacgtacggtcggcccgtaccccgggccgaggtacgtggacgtcgtagtactttagttacgttgtggttacgggttggacgtcgacgcgtaccgtagtccgttcgtcgttaaccggttccgtacggtacgtccggtccgggtaaacctacgggtacctacccggttccgacgtacccggacctacccggaacccgacccctaaccccncgttacgtcccttaccccg

SEQ ID NO: 163706 - DNA, 888 bp, Homo sapiens
  misc_feature: GYAE6OF01A3HLH.47.55.E11.1.454.CMB.1.raw
tcagagctcacgtacacgaccggtgctcgatttagcactcgcacgtttggggtttgggggaagaggaagactgacggtcctgccacaggtggtgcgtgggcacggtggcactcgacaacaactatttgcgctacaactgtcttgctcaccagtggagtcgtgggctgacgtcgtttcgggtttttcctttggttcgtctttaacgttttaaaggtgtccgtaggtggtgacggtgcgtagggtaggtgggacggggtccgggggtacggttcgttacggttcgacggtccgggtcgggggtccgttccccgtagggtaccgtacttccgttccggttaggttaggttacgttcttacggtaggtaacttcgttacggtttaccgtaaccgttacctttcggtaggtacgtcggtaccgtaccgggttcccggggtaaccctaaccgtaaaccgtacggggttaacggggttaacggggtccggtttggggttacgggttcgggttacctacgtaacggttactaacgtaacgttccgtagtagtcggtagttacgttaatttaagtttaattacggtaccggtccggtaccggttccgggtacggggaccgggttaccgtacgttacgacgtacctctacccgtaaccggaagtaaacccggtaaccgaaacggtaacgtaaaggttaacttacgttaaaccgtttggtaaacttaacgggttaaaggaaattacgtaaaccgttagttaacggaagtacggtacgtacggtaacggtaccggttacgttacgttacgttacgttactttaggtttcgtttacggtttcgtttaacggtccgtttccggttacccgggttcccgggttacggttccgggttacccggg

SEQ ID NO: 163707 - DNA, 933 bp, Homo sapiens
  misc_feature: GYAE6OF01DEPEC.47.55.E11.1.454.CMB.1.raw
tcagagctcacgtacacgaccggtgctcgatttagcactcgcacggtttgggtttgggggccgcagccctgggattcccagctgtttctgcttgctgatcaggactgcacacagagagctcacagtggacgtcgtggctggagtcgtttcgggtttttccttgttcgtacgttttaacgtttttaaagggtcgtccgtaggttggtaggtacggtgtacggtaaggggttacgggtggggtaacggggtccggggggtaagttcgtttaacggttcgaaccggtccgggtacgggggtaccttcccgagtacgttaccgttccgttccgtggttacgttcgttcttacgtaaggttaacttcgttaacgtttcgacgtttccgttgtaggacttcgaccgtacggtaccgggtaccccaacgtaaaccggtacgggtaacggggtacgggttcggtagggttacgggttcggtacctacggtaacgttctaacgtaccctacgtcggagttcggtacgttaagtttaacgttaaattaacgttcgtacgggtaccgtaccggttacgggtcgggtaaccggacttaacggttcgaacggtacctaccggttccgaaccggaaaggtaacccgaacggtaaacgaacgttaaggtaccgtttaagtacgttaggttaaccggtaaagtaacggttaaacggtaaataaccgtaagtttcggtaaaggtccggttaaccgtacgggtaaaccggttaccggttacgttacggttaccgttaagtttaaccctgggttttaaattttcgggtttacccgttttaaccgccgggttttcccgggtttccccgggttacccggggttaccgtttaacccggggttcgggttaccggggaccggggttaaccccggaaccggtttcccgggttacccgg

SEQ ID NO: 163708 - DNA, 717 bp, Homo sapiens
  misc_feature: GYAE6OF01CVRW7.47.55.E11.1.454.CMB.1.raw
  modified_base (120)..(120): a, c, t, g, unknown or other
  misc_feature (120)..(120): n is a, c, g, or t
  modified_base (183)..(183): a, c, t, g, unknown or other
  misc_feature (183)..(183): n is a, c, g, or t
  modified_base (221)..(221): a, c, t, g, unknown or other
  misc_feature (221)..(221): n is a, c, g, or t
  modified_base (541)..(541): a, c, t, g, unknown or other
  misc_feature (541)..(541): n is a, c, g, or t
  modified_base (705)..(705): a, c, t, g, unknown or other
  misc_feature (705)..(705): n is a, c, g, or t
tcagagctcacgtacacgaccggtgctcgatttagcactcgcacgttgggtttggggagcttcagctgtggtagagaagacaggattcgaggacaatctccagcatggccgcttcccctntcctcctcaccctcctcactcactgtgcgacgggttcttcgggcccagtctggtgctgctacncgccctaccctcgacgtccgtaccgcgggacccccggnacggtaccgtcacctgttcttcgttgttcgacggaagtccacgtcctaacctaagtacgtaacgtaaattgaattacgtagtaactcgtacggaaccacgtacaaccggtcccgaaccggacccgtacccctacgtcctacactactaatactaatcgacctcgccggtcccggtaccgtcggggtaaccgggtcccgttaggaccttactttccggtcgtacggttccctaacgaggttccgacgtccccgacgtacgacccgtcctaccgtacgcctacggcggtggacccgggtcgccggaacggtgcgtacgggtnttaccgtagttacgttagtccggtggttacgggtcggttacgacgtccggtaccggtacgttcgtacgttacgttcgttaccgtttcggtaccggtcgacgggtccgtaaccggacccgtaggttcccgaccgttggacgaccccggtaccaccggtaaacccncccgtccttacg

SEQ ID NO: 163709 - DNA, 755 bp, Homo sapiens
  misc_feature: GYAE6OF01BJBIO.47.55.E11.1.454.CMB.1.raw
  modified_base (210)..(210): a, c, t, g, unknown or other
  misc_feature (210)..(210): n is a, c, g, or t
  modified_base (229)..(229): a, c, t, g, unknown or other
  misc_feature (229)..(229): n is a, c, g, or t
  modified_base (571)..(571): a, c, t, g, unknown or other
  misc_feature (571)..(571): n is a, c, g, or t
tcagagctcacgtacacgaccggtgctcgatttagcactcgcacgttgggtttgggggaggagaagacaggattcaggacaagtctccagcatggccggcttccgtctcctcctcaccctctcactcactgtcgcagggtcttggccagtctgtcgctgactcacgccaccctgacgcgtcgtcgggaccccggacggccggtcaccgtntctcgttcgttcaggaacncgacgtctaccgaaatacgtacggaaatcgtaataagtgtactacgtggtaccagtacgaacgtcccgaacggacccgacccgtaaactccgtacacgtcctaacgtaactaactcgactacgaggtcccggtacccgtacggaccggggttccgtggtcccggtaactttcggtaccgtcggtaccctacggtaacggttccgtaggggaccctactacggaccgtccctacggcgtaccgtcgttaccgggaggtacggtacccgttcccgggaccgaaggtcgtacgcggttacgtgttaacgtttacgtcgttggtaagggttacggttcgggtaacnccggtacgtacggtccgttacggtaccgttacggttaccggtttaaccgttccggtacggtaaccgggtcgtacgggtaccctacgggtacccttaaccgggttccgtacgggtcgaccggtacccggtaacgacccctaaccgttcgtaacgtcttaaccgtccgtacccgttcccgtacccg

SEQ ID NO: 163710 - DNA, 733 bp, Homo sapiens
  misc_feature: GYAE6OF01AQOEW.47.55.E11.1.454.CMB.1.raw
  modified_base (188)..(188): a, c, t, g, unknown or other
  misc_feature (188)..(188): n is a, c, g, or t
  modified_base (210)..(210): a, c, t, g, unknown or other
  misc_feature (210)..(210): n is a, c, g, or t
  modified_base (449)..(449): a, c, t, g, unknown or other
  misc_feature (449)..(449): n is a, c, g, or t
tcagagctcacgtacacgaccggtgctcgatttagcactcgcacgttgggtttggggcagcttcagctgtggtagagaagacaggattcaggacaatctccagcatggccggcttccctctcctcctcaccctcctcactcactgtgcagggtcttcgggcccagtctgtgctgactcagcccacctnacgcgtctcggggacccccggnacgacggtacaccattctctttagttcgtaggacgcgacgctaccaattagtacggaaatgtaattacgtagtacttacgtaggaccagacaacgtcccaacggaaccgtacccccaaacttccacgtatactaactaaaccgaatagacctacgaaccgccggtcccttacgggaccggggtccctacgggtacctacgtttccgtcgtacggtacccgttaccgaacggttttcccnccgggaacccgtcccttaaccgacccgtacccccgtaacccggttcggaccccttaagtcccgggtttaaacgggcccgggttacccgtacccgggacccgggttaaggacgttacggacggtaacgttagtacttttaacgttcgtaggttaggttacgggttacggacgtcgaccgttcgacgtagtactcgtacccgtttaggtcgttagggacttccgggtacggaacgtacgtcgtaacccgttcgtaccggacacggacccgaacgaccctaaccccg

SEQ ID NO: 163711 - DNA, 931 bp, Homo sapiens
  misc_feature: GYAE6OF01AEWI3.47.55.E11.1.454.CMB.1.raw
  modified_base (255)..(255): a, c, t, g, unknown or other
  misc_feature (255)..(255): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcacgcccaccctcagccgttcgtaccggggacccccgggcacggaccggtcaccattcctcgtttgttccgtagggaacncacgcctaccaattagtacggaaatgaataatgtaatacgtcggtacacgacaacgtccccaacgaaccccggaccccctaaacgtccactaacttactaactaactaatgactcgacggcccggtcccgtaccggaccggggttccccgtcgggtacccgttacgttccctaccggttcggtccccttaaccgtacggtttccggaccgggtaccctccccggtaccgacccgtacccccgttaccccgtaccgggtaccctaccggttacgggtaccccgggggttcggggtaccccccgggtcccccgggggtaaccggggtcgggtaacggggtaccgggtacgggttaacgttacgggtttttaactttaaaccggggttttaccggttttggggttaaggggttttaaccggggggggttttcgggtaaccggttcccgtaaccgggttccggtaccccgttacggggttaacccgttcggttaacccggtttttaccggggtttcccgttacccgggggtacggttcccggggttaaacccgggggtaccccttaaacggggtttacccccgttaaccccgggttaccgggtttaaaccggggttccccaaacccgggaacccccggtaaccccccggggtaaaaccccccgtaacccctttacccggg

SEQ ID NO: 163712 - DNA, 656 bp, Homo sapiens
  misc_feature: GYAE6OF01EFF6Y.47.55.E11.1.454.CMB.1.raw
  modified_base (352)..(352): a, c, t, g, unknown or other
  misc_feature (352)..(352): n is a, c, g, or t
  modified_base (426)..(426): a, c, t, g, unknown or other
  misc_feature (426)..(426): n is a, c, g, or t
  modified_base (597)..(597): a, c, t, g, unknown or other
  misc_feature (597)..(597): n is a, c, g, or t
  modified_base (613)..(613): a, c, t, g, unknown or other
  misc_feature (613)..(613): n is a, c, g, or t
  modified_base (616)..(616): a, c, t, g, unknown or other
  misc_feature (616)..(616): n is a, c, g, or t
  modified_base (620)..(620): a, c, t, g, unknown or other
  misc_feature (620)..(620): n is a, c, g, or t
  modified_base (622)..(622): a, c, t, g, unknown or other
  misc_feature (622)..(622): n is a, c, g, or t
  modified_base (635)..(635): a, c, t, g, unknown or other
  misc_feature (635)..(635): n is a, c, g, or t
  modified_base (637)..(637): a, c, t, g, unknown or other
  misc_feature (637)..(637): n is a, c, g, or t
  modified_base (640)..(646): a, c, t, g, unknown or other
  misc_feature (640)..(646): n is a, c, g, or t
  modified_base (648)..(649): a, c, t, g, unknown or other
  misc_feature (648)..(649): n is a, c, g, or t
  modified_base (651)..(656): a, c, t, g, unknown or other
  misc_feature (651)..(656): n is a, c, g, or t
tcagagctcacgtacacgaccggtgctcgatttagcactcgcacgttggggtttgggggccgcagccctgggattcccagctgtttctgcttgctgatcaggactgcacacagagagctcaaccagtggagtcgtgggctgagtcgttgggttttccttggttgccttacgttttaaaaagggtcgtaccgtaggttggtaggtaggtcgacgtaagggtaggtgggtaaccgggtccggggggagttacgttagttcgaaggtcccggtaggggtaccgtccgtaggtacgtaccgtctccgtagtcgtacgtctcgtagaatcgtaagttcgtacgtacttcgaggtacncgacgtacgtcggtaccgacaaacgtccagtaccctaccaacgtaccggaccctaggtccgttccccttcccgnggacccgtcctacggcctaccgacggacgtcctacgtacgggacgggaccaaaccgggtcgtccggtacccggtgggtacctcgggtacccgttaggtaaccgaacgggtacccttaacgttccgttaacggtacgtacgtactacggtacggaacggcggtacgtacggngaacgggtcacgtagncgngacngnttagctcaagcancngtnnnnnnncnnannnnnn

SEQ ID NO: 163713 - DNA, 671 bp, Homo sapiens
  misc_feature: GYAE6OF01DJMXS.47.55.E11.1.454.CMB.1.raw
  modified_base (516)..(516): a, c, t, g, unknown or other
  misc_feature (516)..(516): n is a, c, g, or t
  modified_base (539)..(539): a, c, t, g, unknown or other
  misc_feature (539)..(539): n is a, c, g, or t
  modified_base (547)..(547): a, c, t, g, unknown or other
  misc_feature (547)..(547): n is a, c, g, or t
  modified_base (576)..(576): a, c, t, g, unknown or other
  misc_feature (576)..(576): n is a, c, g, or t
tcagagctcacgtacacgaccggtgctcgatttagcactcgcacgttgggtttggggagccgcagccctgggattcccagctgtttctgcttgctgatcaggactgacacaaagagagctcaccagtggcgtctgggctgagtcgttgggtttttccttgttgtcgtttacgttttaaaaggtcgtacgtaggtgtggaggtgagtaggtagtgggacggtccggggagtcgttagttcaggccggtgggactcccgtgacgtactccgtccgtgtgtacgtccgtagtgaatcgttaggttacctacgttaccttgtgggtatcgcgtacggtcggaccgaaccgtaaacgtccgaagggtacgggtcgtgggtagtcggtctacgtacgtatactactccgagtcgagcgttaagttacttaaagttaatcgtcggaccggtacgtcggtacgggtacgggaccttagttcgacgtctcgtaccacgtagaacgaacgacgagtaacgtaagtntacgtcgtaatgtaagaacttanaactggtnaaggtgaacgtacgtagacgtcgtacgtntataccgttgttacgttgtttacgtgtcgtttcgggtccgttccggtccggtaccggttccggtccggtacggtaccgacccggtccgtaccggg

SEQ ID NO: 163714 - DNA, 888 bp, Homo sapiens
  misc_feature: GYAE6OF01A2QHR.47.55.E11.1.454.CMB.1.raw
  modified_base (186)..(186): a, c, t, g, unknown or other
  misc_feature (186)..(186): n is a, c, g, or t
  modified_base (222)..(222): a, c, t, g, unknown or other
  misc_feature (222)..(222): n is a, c, g, or t
  modified_base (269)..(269): a, c, t, g, unknown or other
  misc_feature (269)..(269): n is a, c, g, or t
tcagagctcacgtacacgaccggtgctcgatttagcactcgcacgtttgggtttggggagcttcagctgtggtagagaagacaggattcaggacaatctccagcatggccggtcttccctctcctcctccaccctcctcactcactgtcgcgtaggtcttcgggccctagtctgtcgactgactcncgcccaccgtcagccgttcggtccggggaccccggnacggaccggtccaacctacgttccttcgtttcggtcgtacgggaacncgttacgacctacctaatttaaccgaggtaacttagtaagttaagtcgttaaacttacggttacggaacgtaaccgtacggttaaaccgtaccccggaaaccggacccccggtaaaccccctaaaccttcctaaccttaccttaaacgtaactaaactaacctaggtaaccgtagaaccccggtccgtaccccggtaacgtccgggttccgaaccgggtccttcgttccgtcgcggtaccgttccgaacggttcgaccgggtcccaacgtcgaacccgtccgtaccgacgccgtaacgtcgtaaccggtccgggtcccggtacccggtacgggtaccggtagttacgggaccgttcgttaacggttactttaaccgggtttagttcgggttaaaccggggtttaggaccggtttaccggcggttacgaccgttacccggtacgttaacccgttcggttaaccggtttacccggtttccgggtaaaccgggtccggtttaacccgggtaacgggtacccgggtttaccccggttaaccggtaccccgttacgggttaaacccggtaccggtaaacccccgacccccgtaacgggaacccccctttaaccggtaacccccg

SEQ ID NO: 163715 - DNA, 881 bp, Homo sapiens
  misc_feature: GYAE6OF01CLYGQ.47.55.E11.1.454.CMB.1.raw
  modified_base (752)..(752): a, c, t, g, unknown or other
  misc_feature (752)..(752): n is a, c, g, or t
  modified_base (764)..(764): a, c, t, g, unknown or other
  misc_feature (764)..(764): n is a, c, g, or t
tcagagctcacgtacacgaccggtgctcgatttagcactcgcacggttggggtttgggggccgcagccctgggattcccagctgtttctgtcttgctgatcaggactgcacacagagacgctacacagtggagtcggtggctggacgtcgtttgggttttccttgttcgtacgttaacgttttaaaggtcgtacgtaggttggtggtagggtagacggtaagggtaggtaggggtacggggtccgggggtaggttcgttacggttacggacggccggggttaggggtacgtcccggtaggacgtaccttcgttcgttaggtagttacgttcgttaggttaacgtacttacgttaggttttacctacgtttacgttacggttagacgtcggtaacgtccgggttaccgggtaaccccgaacccgttaaccgggtacgggtaacgggggttaacggggtcgtttacgggggtttaccggttacggtttaccgttaacggttaacgtaactaccgttacgttacggttacggaaggttcgttaacggttaagtttaaagtttaagttaaacgttcggtacggtacccggttacggtacggggtacgggtaccgggacttacgtcgagtccgtacgtaccgaaggacgtaacgaacgtaacggacgtaagtagtacgttaggtactaggaagtaaagtaacgtaactaggtaacgtacggtaagaaccggttagaaccgtacgtacggttacgttntacgttacgttnttaccggttgttttaacgtttcggtacgtaccggtttccgttccggggtaccgggttacccgggtaggtttaccccgggtaggggtaccggtccgggaaacccggttggtcccgggg

SEQ ID NO: 163716 - DNA, 877 bp, Homo sapiens
  misc_feature: GYAE6OF01CBF08.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagacgctcaccagtggagtcgtggctgagtcgtttggttttccttgttgtacttagttttaaaggtcgtaccgtagtgtggtaggtgacgtaggtaggtgggacgggtccgggggagtcgttagttcgacggtccggtcggggacgtcccgtaggtacgtccttccgtcgtggtcgtacgtctcgtaggtaactcgttacgtttacgtacgttaccgttcgtaggtacgtcgtacgtaccggtaccgggtaccccgtaacccgtaaaccgtaccggggtaagggtaacggggtccggttagggtcggttcggttacctacgtacgttaacgtacctagtctagagtcgtactagttagttaataagtcgtcgtacgtacgtcggtagggccggtacttagtacgacgtacgtaccgtaccgtaacggaaggtaacgaaaccgtaaacggtaacttaaaggtccgttaaaacgttcgttaaacgttactaaacggttaacggtaaagtacccggttaaagtaaccttacgggaacggttaaaccgggtacggttaaaccggtacccgtaagggtttacccggtaacccgttttagtttacccggttaaaacgtttttccgggttttaaagttttccggggtttaaacccgtcggtttaaccccgggggtttcggttaccccgggggtacccggttacgggtttaccccggttaacggggacccccggggtaaccggttaaaccccgggtcggttaaccggttcccg

SEQ ID NO: 163717 - DNA, 886 bp, Homo sapiens
  misc_feature: GYAE6OF01ECENI.47.55.E11.1.454.CMB.1.raw
  modified_base (146)..(146): a, c, t, g, unknown or other
  misc_feature (146)..(146): n is a, c, g, or t
  modified_base (272)..(272): a, c, t, g, unknown or other
  misc_feature (272)..(272): n is a, c, g, or t
  modified_base (314)..(314): a, c, t, g, unknown or other
  misc_feature (314)..(314): n is a, c, g, or t
  modified_base (400)..(400): a, c, t, g, unknown or other
  misc_feature (400)..(400): n is a, c, g, or t
  modified_base (510)..(510): a, c, t, g, unknown or other
  misc_feature (510)..(510): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtncgagggttcgttcgggccagtctgtagcttaggactcacgccctaccctacgacgtccggttccgtccggggacccccgggacgacggaccggtccaacctacttccttcgttcgttcgaggaacncagtcctacaattacggacgtaaatagtaattaatcgttaanacggttacggacacgacgtaaccgcccgaaccggaaccccgaaccccgtaaccttccgtactaaccttacttaaactaaaccgtancgtaaacgcctaaccgggcccgtccgtaacgggtccgggttcccggacgtacgttacgttcccgtaggtaccgtaccgtaccgttaacggtcggttacggccccgttaanccccgtaccgtacccccaccggttcgtacccgtaggtaccggttcggggtacccgggtcccccggttacccggggaaccgggttacggttacggaccgggttacggtccgttaaaggtttcgtttaaaccgggtttcggttaagggtttaccgggttttgggtaacgggacgttaccggttccggtaacggttccgtacgggttccggttacgtttaccgtttaccggttaccggttacccgggttacgggtaccccggttaaacgggtaccccgggttaaaccgttccccggtttacccggtaccggtaccgttaaaccggacccccggttaaacccgggaacccccgaacccccgtaaacccggttttaacccg

SEQ ID NO: 163718 - DNA, 788 bp, Homo sapiens
  misc_feature: GYAE6OF01ETBGJ.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccagtggagtcgtgggctgagtcgtttgggttttccttgttgtactttacgtttaaaggtcgtaccgtagtggttacgtaggtgacgtaggtaggttcgggcgggtcggggagtcttacggttcgacgccgtaggggtacctccgtagacgtactcgtcgtagtgtcgtctagtagtatctacgttacgtacgttaccttgtaggtagtcacgtcggtaccggtaccccaaccgtaacgccggtaagggtacggtcgtgggttacgtcggtctaaccgtagtacactacgtctaggacgttcggtaagtacttaagtaacttaacgttgaccggttccggtaacggtcggtaacgggtacgggtacttaacggtcgacgtacgttaccgtacctaacggaacgaaccggtaaacggtaacgtaaaggtaacgaacgtttaacggtacttaacgggtacgttaaacggaaagttaacgttaaacgtaactaaggtaacgtaggaaacgtaccggtccggtaacgtaaccggtacgtacgttagttaacccgttagtccgtttaggttttaaccggtttgttacgtacggtttaccggtccggtttcccggggtaacgttccgggttacggttccgggtaacgggccggttaaacggtccggtaacccgg

SEQ ID NO: 163719 - DNA, 828 bp, Homo sapiens
  misc_feature: GYAE6OF01ENQ4Y.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagtcgttgggtttttcctttgttgtcttacgttttaaaaggtgtccaggtgtgaggtgacgaggttaggtgggacgggtccgggggaggtcttaggttcacggtccgtggggtacgtcccgtggacgaccttcttcctagttcgttagtctcgtaggtaactcgttagtttctacgtaccgtttcgtaggacgtcgtacgtaccggtcgggtaccccgtaacccgaaaccgttacccggtaagggggttaaggggtccgttgggttacgggtcgggttaccgtacgtaaccggtttacacctaaacgtttccgagtaggtcgggtactaagttaagtttaaattaagttacgtcggaccggttcgtcgggtagggacggggtacctagttacgatccgtactccgtaccaaggtacggaaccgaacggaacgtaagtaacgttacttaacgttacgttaattacggtaaacgttaagtaacgaaacgttacgttacgaaggtacggtaacggtaacgtaacggtaccgtacggtaccgttagttacttaaggttctttacgtttacggttttcgtttaccgtagttccccgggttacccggttttcccgggtacccgggttaccggttacccggtttaccggggttaccggggttaaccccggttaaccggggtaacccccgtttaccggg

SEQ ID NO: 163720 - DNA, 965 bp, Homo sapiens
  misc_feature: GYAE6OF01CV2NL.47.55.E11.1.454.CMB.1.raw
tcagagctcacgtacacgaccggtgctcgatttagcactcgcacgttgggtttggggagccgcagccctgggattcccagctgtttctgcttgctgatcaggactgcacacagagagctcacagtggagtcgtgggactgagtcgtttcgggtttttccttggttacgtaccgtttaacgtttttaaaagggtcgttaccgtaggttggtaggtacgggtggtacggtaaggggttagggtacggggtacgggggttccggggggtaaggttcgtttacggttccggacggtccgggtgggggtaccgttccgtaggtacgtactccgttccgtggttacgtacgttctacgtaggtaacttacgtacgtttacgtaacgttacctttggtaggtacgtcgtaccgtacggttaccgggacccgtaaccgtaaaccgtaccgggtaaggggtacgggtcgttgggtcgggttacggtacctacgtacgttacgtactacgtccgtaggtacgtgtacgttagtttaagtaattaagtcgtacggtacggtacgtcggtagggtaccggtacgtacgtacgacgtcctacgtacctaacgtaacggaacgaaacccgtaaacgtaacgtaaacggtaattaacgttagttaacgttaacgtaagtaaacggtaaagttaaacggtaaaccttaagttaccggtaaacggttaacgggttaccggtaaaccggtaaaccggtaacgggtttaacccgggtttcgttaaaccgtttaaccggtttaaccttacggttttagggttttaacggtttttaccgggttttaccggttaacccgggtttacccggggttttccccggggttaacccggggtttcccgggggtttaccggggttaacccgggttttacccgggggggtaacccggggttaaccccggggttaaaccccggggtttaacccggg

SEQ ID NO: 163721 - DNA, 788 bp, Homo sapiens
  misc_feature: GYAE6OF01AQ4A9.47.55.E11.1.454.CMB.1.raw
  modified_base (142)..(142): a, c, t, g, unknown or other
  misc_feature (142)..(142): n is a, c, g, or t
tcagagctcacgtacacgaccggtgctcgatttagcactcgcacggttggggtttggggggccgcagccctgggattcccagctgtttctgcttgctgatcaggactgccacacagagagctcaccagtgggagtcgtgggngtgagtcgtttgggtttttccttgttcgtcctttaacgtttttaaaagggtcgtaccgtagtggttaggacggtggcgaaggggttaggtcgggtacggggtaccggggggtagtcgtttaaggttcgaacggtccgggttcggggacgtcccgtaggacgtcctccgttccgttgttaggtacgttactcgtaggtacttcgttacggtttacctacgttaccttaggtcggtattcgaccggtaccggttaccgggtacccctaaccgaaaccggtttaccggggaaggggttacggggtcggtgggtttcgggtcggtcctacggtaacgtactacacgttcggtagtcgtggtagtagttattaattaagtaggcggtcggacgttcgggtgggacggtctgtacgactacgtactcgacgacgggaataaccggataaggaacttaagttactacgttacgtaagttaacgaagtaataagtactacggtaagtcgtaagggccggtaagtaacgttcggtacgttactaggtttatccgttaggttacgtttgttaacggttcttacgggttcccggttccggtcccgggtacggtacccggttccggtacgggacccggttacggacccggtacgtcgg

SEQ ID NO: 163722 - DNA, 646 bp, Homo sapiens
  misc_feature: GYAE6OF01A6C8E.47.55.E11.1.454.CMB.1.raw
  modified_base (191)..(191): a, c, t, g, unknown or other
  misc_feature (191)..(191): n is a, c, g, or t
  modified_base (461)..(461): a, c, t, g, unknown or other
  misc_feature (461)..(461): n is a, c, g, or t
  modified_base (470)..(470): a, c, t, g, unknown or other
  misc_feature (470)..(470): n is a, c, g, or t
  modified_base (596)..(596): a, c, t, g, unknown or other
  misc_feature (596)..(596): n is a, c, g, or t
  modified_base (610)..(610): a, c, t, g, unknown or other
  misc_feature (610)..(610): n is a, c, g, or t
  modified_base (622)..(622): a, c, t, g, unknown or other
  misc_feature (622)..(622): n is a, c, g, or t
  modified_base (637)..(638): a, c, t, g, unknown or other
  misc_feature (637)..(638): n is a, c, g, or t
  modified_base (640)..(646): a, c, t, g, unknown or other
  misc_feature (640)..(646): n is a, c, g, or t
tcagagctcacgtacacgaccggtgctcgatttagcactcgcacgttgggtttgggggccgcagccctgggattcccagctgtttcttcttgctgatcaggactgcacacagagacgctcaccatggagtctgggctgagtcgttgggttttccttgttgtacttagttttaaaggtcgtccgagtgtggnggtgctaggtagtggacggtcggggagtcgttagtcgagtccggtggggtacgtcctggacgtactccgtcttgtagtcgtctacgtagacttcgtacgtttactacgttacccgttgtggtatcgtaccgtaaccggtccggtaccgtacccctaaacgtccccggaaggggtaaccggccggtaaaccgggaccgttcggtcaacgtccgtcctccgacctagaccctccgaaccgtccggtacctacgtccgtaccccgttccccgnggtaccccnccgtcctccgccgacgtccgccgtaccgtaccgaggtcgccaccggcgcccggtacgtccggcgtacgtcgtcggtaccgtacgtacttcccgttactgtacgtcgtacctggtcggacggtcggngtaccggcgacggngacctagtagcnctgctagcagcgtanntnnnnnnn

SEQ ID NO: 163723 - DNA, 753 bp, Homo sapiens
  misc_feature: GYAE6OF01BWAHQ.47.55.E11.1.454.CMB.1.raw
  modified_base (185)..(185): a, c, t, g, unknown or other
  misc_feature (185)..(185): n is a, c, g, or t
  modified_base (197)..(197): a, c, t, g, unknown or other
  misc_feature (197)..(197): n is a, c, g, or t
tcagagctcacgtacacgaccggtgctcgatttagcactcgcacgttgggtttgggagctgtggtagagaagacaggattcaggacaactctccagcatggccggcttcctctcctctcaccctctcactcactgtgcaggtcttggcccagtctgtgcttgactcagtccacctcacgcgttcncgggaccccggnaagccggtcaccatcgtcttgtctaggagcagcctacaatagacggtaaatgagttaatacgtacttacgtacggtaaccagtacgtaacgtcccgaacgaacccggtacccccaaacttcccgtacaacttacctaataaaccgtaacgtagtacgtccgaaccgtaccggacccctacgggtacgggttaccccgtacggtcccgtaactttccgtacgtaggtacccgtacccgttaaagtcccgtaccgggaacccgtcccgttaccgaaccggtccccctaaccccggttacggacccgtactaccggtaacggtcccgggttcccgggaccccgggtacccggtaaacgggtacgtcggtaccggtacgttaacgtacgttttaacgtacgtttacggtagttaggggtttacggctacggtctacgtacgtcgtaacgtcgttacgtttcgtacgtacgtacgtcggtacggacccgtaaggtccccgagttcccgacgttccgaacccgacccgtacgacccccgaaccgttcgaccttccgtacccg

SEQ ID NO: 163724 - DNA, 930 bp, Homo sapiens
  misc_feature: GYAE6OF01BAFGL.47.55.E11.1.454.CMB.1.raw
tcagagctcacgtacacgaccggtgctcgatttagcactcgcacgttgggtttggggagccgcagccctgggattcccagctgttctgcttgctgatcagactgcacacagagagtctcaccatggagtcgtggctgagtcttgggttttccttgttcgtactttacgttttaaaaggtcgtaccgagtcgtaggaggtgcgtaggtacggtgggacggtccggggagtcttagtcgagtccgtgggtactccgtagacgtacctccgtcgtgttgtacgtcgtgtaggtaacttcgtacgttttacgacgttctttacggtacgtagtacgtaccgaccggttcggtacccgtaacccgtaaaccgtaccggtaaggggtaaccggggtcttacggggttggttcccggggttacctacggtaaacccggtttactaccggtaaccgttccgtaaggtacggttaccgaacggtttaacgtttaaaggttaaacttaaaccggtttaggttaccgggtaaccggttacccgggtttacccggggtacggggtaaccggggtttacccaaacgttttccggaaaccggttcgttaaaccgttccccggtaaccggtaacggaacccgggtaaaaccggtaacccgggtaacggtaaacgtaccgggtttaaattacccggttaaggtaccgtttaacgggtaacggaaaacgttaccgaaaaccgtttaccggagttaaaccgggtacggtaaccgtaaagggttacccgtaagttaccgggtcttacccggttataccgttacggtacgttttacgggtccttttaacgggtccgtttaccgggttacccggtttcccggggaaccgtttacccggggtaacggtttacccccggggtagggtcccccggggttaaacgggtacccccg

SEQ ID NO: 163725 - DNA, 650 bp, Homo sapiens
  misc_feature: GYAE6OF01AQCCW.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggtttccttgttgctcttttaaaggtgtccagtgtgaggtgcaggtagtggagtccgggggaggcttagttcagcctggggactccctgagactctccgtgtgtagtctctaggaacttcagtttcagtaccttctggatcgctacgtcgggtccaccaactccgaggtagggctggtgtaggtctacacgtatcaatctgagtggactaggttagttaataaacgttgtacggtccggtaacgttccggtagggacggggtcccgtaagttcgacgtacctagtcctaccgtagacgaaccgtaacggacaaaggtacgttaataaccttaggtaataccggtaagtaaactcggtaaacagttaccgtagaacggtacgtaccggaacgtacgtacgggtctggtacttagtcttacgttggtttcgtttcgtagttccggtacccgttcgggtacccggtcgggttacgttccgggaggggcccgtaacggggtacccgttcggg

SEQ ID NO: 163726 - DNA, 886 bp, Homo sapiens
  misc_feature: GYAE6OF01EC7DW.47.55.E11.1.454.CMB.1.raw
tcagagctcacgtacacgaccggtgctcgatttagcactcgcacgttgggtttgggggagccgcagccctgggattcccagctgtttctgcttgctgatcaggactgcacacagagagctcaccgagtggagtcgtgggctgagtcgttggggttttcccttgttcgtcttaacgtttttaaaaggtcgttaccgaggtggtggtaggtgtacgtagggttaggtggggtacgggttccggggggaggttcgttttaacggttcgtaacgggtcccggttagggggtaccgttccccggtggtacgtacccttccgttcggttggttacgttacggttcctacggttaggtaacttaccgttaacggttttccgtaacgtttaccgtttacgtaggttacgtacggtccgttaccgggtaccgggtaaccccgtaacccgtaaaccggtacccgggtaagggggttaacgggggtccgtttagggggttcggttacgggttccgtaccgttaaacgttacgtacctaaacgttccgtaggtaccgaggttacgtaaggtttaattaaagttaaacgttcggtacggtaccggttccggtaccgggtacgggtaccgggtaccttaggtacacggtctacctaccgtaccgtaaggaccgtaacgaacggagtaacggtataacgttgtaacgttagtaacggtaagtaactaagtaacgtagtcgttaaggacgtacgggtacgtaacggtcttaaccgggtacttacgttagttaccgtggtttatttcgggtttacgttacggttcgttacccgggttcccggttcggtaccccggttacggttacccggttccgggtacgggtcccggtaaccggtacccggg

SEQ ID NO: 163727 - DNA, 632 bp, Homo sapiens
  misc_feature: GYAE6OF01BI61Z.47.55.E11.1.454.CMB.1.raw
  modified_base (209)..(209): a, c, t, g, unknown or other
  misc_feature (209)..(209): n is a, c, g, or t
  modified_base (223)..(223): a, c, t, g, unknown or other
  misc_feature (223)..(223): n is a, c, g, or t
  modified_base (283)..(283): a, c, t, g, unknown or other
  misc_feature (283)..(283): n is a, c, g, or t
  modified_base (315)..(315): a, c, t, g, unknown or other
  misc_feature (315)..(315): n is a, c, g, or t
  modified_base (377)..(377): a, c, t, g, unknown or other
  misc_feature (377)..(377): n is a, c, g, or t
tcagagctcacgtacacgaccggtgctcgatttagcactcgcacgtttgggtttggggagcttcagctgtggtagagaagacaggattcaggacaatctcagcatggccggcttccctctcctcctcaccctctcactcactgtgcagggttcttgggcccagtctgtgctgactcacgccacctcacgcgtcgtcggggacccccggnacgacggtcaaccnctcttcttgtcgaggaacgcagctacaatatacggaaatgaataatgtatacgtgtaccngacacgtccacgaacccgaccccaaatcctanactactaataacatgactcgacgccggtacctacggtaccgggtcctcggacctagtttccncgttggcctaccgtagtcgtcgccgcctacaccgcccaccgtcgacctacgtcgtacggtcggccgtaccggccggagtacgtcggaggtcctaagtactttagttacgttggttcggtacggttgggtactaccggcgtacgtcgttacgactcggttaccgttcggtacgttggaccgttcggtaccggtagaccggttcgacccgtacgtacggtaccgtacgacccggaaccgtcccgtaacccgtaccgg

SEQ ID NO: 163728 - DNA, 862 bp, Homo sapiens
  misc_feature: GYAE6OF01B2L90.47.55.E11.1.454.CMB.1.raw
  modified_base (213)..(213): a, c, t, g, unknown or other
  misc_feature (213)..(213): n is a, c, g, or t
  modified_base (369)..(369): a, c, t, g, unknown or other
  misc_feature (369)..(369): n is a, c, g, or t
tcagagctcacgtacacgaccggtgctcgatttagcactcgcacgttgggtttggggagctgtggtagagaagacaggattcaggacaatctccagcatggccggcttccctctcctcctcaccctcctcactcactggtgcgagggtcttcgggcccagtctgtgctgactccacgcccacctcaggtccgtccgtccggggacccccgggnacggaccggtccaccgtacttccgttcttttgttccgtaagggactcacgtcctacctaaatcgttaacggaatagataatagtactacgtcggacagactacgtcccaaccggaacccgtaccccaaacctcctactactactaactaacagttnactcacggccgtaccgtacgacgggtcccgtacggccgtacgttcgtaccgtcgacgtaccgtacgtccgcggccgtcctacgccgtacccctccggtacgcctacgtccggtacgggtccgggtcccgtacccggggtacccgagggaccgttacggggaccggttcgttaacgggtttacgtttttaaaccgtttacggggtttacggtttaacgggggtttaaacgggtttcggggtacgtttacccgggtaacgtccgggttaaacccgttacggtacccgttttaaccgtttccccgggtttttaccggtaacccggggttaccgggtccggtttacggggtaaacccggtaacccgggtttaaaccgggttccccggtaccccgggtttaaccggtaacccggggtacccgtaaccccggaccccggggtaaacccctacccccgggtaaaccctttaccgggtccccgttaaccgtttacccccgg

SEQ ID NO: 163729 - DNA, 743 bp, Homo sapiens
  misc_feature: GYAE6OF01CJ88P.47.55.E11.1.454.CMB.1.raw
  modified_base (131)..(131): a, c, t, g, unknown or other
  misc_feature (131)..(131): n is a, c, g, or t
  modified_base (189)..(189): a, c, t, g, unknown or other
  misc_feature (189)..(189): n is a, c, g, or t
  modified_base (197)..(197): a, c, t, g, unknown or other
  misc_feature (197)..(197): n is a, c, g, or t
  modified_base (291)..(291): a, c, t, g, unknown or other
  misc_feature (291)..(291): n is a, c, g, or t
  modified_base (294)..(294): a, c, t, g, unknown or other
  misc_feature (294)..(294): n is a, c, g, or t
  modified_base (438)..(438): a, c, t, g, unknown or other
  misc_feature (438)..(438): n is a, c, g, or t
  modified_base (455)..(455): a, c, t, g, unknown or other
  misc_feature (455)..(455): n is a, c, g, or t
tcagagctcacgtacacgaccggtgctcgatttagcactcgcacggttggggtttgggggccgcagccctgggattcccagcttgtttctgcttgctgatcaggactgcaacacagagagcacacagtggngtcggtggctagagtcggttggtttactgtgactaatagtaggtagtcgtctaggtgnggtaggtnacgagtcggtagggtgggacggggacgggggtcgtccggttaggaccgtacgggtccgggtcgggggtacctagacgtccttcgtcgtggtccncgnggtccttaagtgtaacttccgtaattcggtactagtacgacctagtactagcgtcggtaccgacgggtaccacgttaggcgacgtacggtaacgtcgtaggtaggttctacgggttcctacgttagtcgcggttacgttcgggngtaccaccgtagtacgngtagacgcggttaccggtcgtaaccggggcggtacggtaccgtaccgttaccgaacctacggttacctaaggaacgtaaacgtaccgtacgaaccgttagtacccgttacgtaacgttaacttacgtaactaacggtacgtaacgtacgacggtacggtaacgggcccggtaacggtacggtaccggtaacgttcgtaaacgggtagtaccgtaagggaccgtacgggtcgtccggtaaggtaaccggtaagggttaaccggtaaggttacgtacgttggttaaccgg

SEQ ID NO: 163730 - DNA, 806 bp, Homo sapiens
  misc_feature: GYAE6OF01EFRGU.47.55.E11.1.454.CMB.1.raw
  modified_base (792)..(792): a, c, t, g, unknown or other
  misc_feature (792)..(792): n is a, c, g, or t
tcagagctcacgtacacgaccggtgctcgatttagcactcgcacgttgggtttggggagccgcagccctgggattcccagctgtttctgcttgctgatcaggactgcacacagagagctcaccagtggagtcgtggctgagtcgttggttttccttgttgtcttacgttttaaaggtcgtccgtagtgtaggaggtgcgtaggtagtggagggtccggggagtcttagtcgaggccgtgggactccgtgacgtaccttccgtcgttgttcgttacgtcgtcgtaggtaacttcgttaacgtttaccgaacgtttaccttgtacggtattcgtaccgtacggttcccgggtaccccgtaacccgtaaaccggttaccggtaagggggttaacggggtcgttacggggttcggttcgggttaccttacgtaacggttactaccgttaacgttcccgtaaggtacggttcggtaacgttaggtttaacgttaaattaaacgtttgtacgggtacccggtaccggttacggtcggggaacggtaccgtagttaccgacgtacctactacccgtaccgaaggaccgtaaacgaacggataacgtagtacgtttacgacggtagtaacgtaaggtaaatcgtaaactgtacgtaggagtacggtaccgactagggttacctcttagtacgttcgttacgtttagtttcggtttacgttaacgcggtttaccccgggttccccggtaacgggttcccggttaagggttccccggtttagggacccggggttaaacccgnggggttacccccgg

SEQ ID NO: 163731 - DNA, 803 bp, Homo sapiens
  misc_feature: GYAE6OF01EQIVK.47.55.E11.1.454.CMB.1.raw
  modified_base (107)..(107): a, c, t, g, unknown or other
  misc_feature (107)..(107): n is a, c, g, or t
  modified_base (221)..(221): a, c, t, g, unknown or other
  misc_feature (221)..(221): n is a, c, g, or t
  modified_base (781)..(781): a, c, t, g, unknown or other
  misc_feature (781)..(781): n is a, c, g, or t
tcagagctcacgtacacgaccggtgctcgatttagcactcgcacggtttggggtttggggagagaagacaggattcaggacaatctccagcagtggccgtcttcccnctcctcctcaccctcctcactcactgtagcgtagggttcgttcgggaccagttcctggttacgcgtacgtactcgacgcccaaccctgacgtcggtccgtccggggaccccggnaggtaccggtcacctagttctcgttcgtgtacggaagctacgtacctaaccgtaaattacgtaacgggtaaatgtaaactttaagtacgttattaaccgttacggaccaacggtaactaaaccggttacccgaaacccggaacccggtaaccctaaacgtcctacgtaaactacttaaaacgtaactaacggttacgaaccgttacgaccgggtaccgtaccccggtagggccgggttcctaacgggtacttacgtttcctacggtacgtaccacgttacgtccggtcgtacccgactaccggaacctcccgtacgtaccgctacggtaggtccgggtcgggtcccgtaccggaccggtaggtacgtaggtacgttacgtagttaacgtttaacgttacgttagggttaccggttaagggttacgtacggtaccgagtaaccgttgtccgttaaggtcgttacgttacgttccggtacggtccgtacgtacggaaccgtaccgtacgtcccgtaacttcgaccgactacccgaccgtaccctaaccgtacgtacgtaccncggttacctccgtcccgtaccg

SEQ ID NO: 163732 - DNA, 971 bp, Homo sapiens
  misc_feature: GYAE6OF01ETG41.47.55.E11.1.454.CMB.1.raw
tcagagctcacgtacacgaccggtgctcgatttagcactcgcacgttgggtttgggggagccgcagccctgggattcccagctgtttctgcttgctgatcaggactgcacacagagagctcaccatggagtcgtgggctgagtcgttgggttttccttgttgtcttacttttaaaaggtgtccagtgtgaggtgacgaggtagtggaggtccggggagtcttagttcgacggtccgtggggacgttccccgtaggacgtacctccgttccgtggttacggttacgttccgttacgtaggtaaacgttccgttaaggtttttacccgaaacggttttacccgtttccggttaggtaacgttccggtaccggtaaccggttaccgggggtttaccccaaccgttaaaaaccggttccccgggtaaaaggggggttaacgggggtccgtttcggggtacggtttcggggttacctaccgttaacggttacttaaccgtaaacgttcccggtagtacggtcggtacttaaggttagtttaaattaaacgtttggtacggtaccggtaaccggttcgggtacgggtacggggtacccttaagttccgaacgtccgtaacgtttcccgaacggtaaagggtaccggtaaacgtaaccgggtaacgtaaacggttaacgtttaacttaacgggtaactttaacggttaacgtaaaacggggtaaacttaaccgggtaaaactaccgggtttagtaaacggggtacggttaaacggttaccccgggtaaaccgggtaacggttacccggttaccgttagttaacccgttagtttacccggttaagtttttcgggttttacccgttttaaacgggccgtttaacccggggtttcccccggttagggttacccccggggttaccggttacccgggtttacgggtacccggggtaaccccggtaccgggttaaaccccgggg

SEQ ID NO: 163733 - DNA, 826 bp, Homo sapiens
  misc_feature: GYAE6OF01CVZ84.47.55.E11.1.454.CMB.1.raw
  modified_base (134)..(134): a, c, t, g, unknown or other
  misc_feature (134)..(134): n is a, c, g, or t
  modified_base (239)..(239): a, c, t, g, unknown or other
  misc_feature (239)..(239): n is a, c, g, or t
  modified_base (467)..(467): a, c, t, g, unknown or other
  misc_feature (467)..(467): n is a, c, g, or t
tcagagctcacgtacacgaccggtgctcgatttagcactcgcacggttgggtttggggagctgtggtagagaagacaggattcaggacaatctccagcagtgccggtcttccctctccctcctcaccctcctcncgtcactgtgcgagggtcgttcggcccagtctgtgctcgactcacgccctaccgtcacgtccgtccggtaccggggacccccggagaacggtaccgtaccacctnttccgtcgttttacggtccgtaaggacgacgaccgccttaacctaaagttacgaagtaaagtagtaaataacgttagtaacgttaacgtacggtaacctacgtaaccgaaccgtaccccaaaccgggaaaccccggtacccccctaaaccgtaccctaacgtacttaactaaactaaaccgtaatcggtaactaccgaccggaccccgtcgtccgggaccgtcccggngtaccttctcgtaccgtcgtaccctacgtaacgtccgtacggtcccgtccaccgaccgtaccccgtaccgtcggaactcgtaaccggtcggtccccggacccggttaccccgggacggagggttaacctcgggtaaccggtacttacgggtttaaacgttttaacggttacccgttaggggtttcgggtttaaacgggttcggggacccttaccggggaacctaccgggttacgtaccggtagttttcggtccgttaaaccggttccgtacggacggtacccggtaacgtcccggtacgtaacccgtccgtacggtaagtcccgacctacggaccgaccctactacgcgtacctccccg

SEQ ID NO: 163734 - DNA, 772 bp, Homo sapiens
  misc_feature: GYAE6OF01DTY8X.47.55.E11.1.454.CMB.1.raw
  modified_base (191)..(191): a, c, t, g, unknown or other
  misc_feature (191)..(191): n is a, c, g, or t
  modified_base (257)..(257): a, c, t, g, unknown or other
  misc_feature (257)..(257): n is a, c, g, or t
tcagagctcacgtacacgaccggtgctcgatttagcactcgcacgttgggtttgggggccgcagccctgggacttcccagctgtttctgcttgctgatcaggactgcacacagagcgctacaccagtggacgtcgtggctgacggttcgtttcggttttcttgttcgtactttaacgtttaaagtcgtacngtgtggtgtgcgtaggtggcgggacgggtccggggatcgtcgtacgacgccggtgggaccttccgngtaccgtaccttcgttcgttgtgtacgtctcggtagttacttcgttacgttccgttacgttctggtcgtctcgacggtaccggacccgtaaccgtaacgtaaccggtacggggtacgggttacggttcggtcggttcggtacgtacctaacgtccttaactcgtaacgtcggtggtacgttcggtacgtttaaggtttaaattaaacggtagtcggtccggtaacgtccgggtacggtcggtaaccggtcttacgaccgtactccgtacgtaccgtaacggaacgaacgtaacggaacgtaacgtaacggttacgtaacgttacgtaacgtacggtaagtaagtaacgtaacgtaacgtacgtacggtacggtaacggtacgtacggtacgttaacgtcgttacgttacgttacttgttacgtttgttacgtttcggttacgttcggttaccggttcccgtcgggttaccggttccggttaccggttacggaccggtaccggtcggtaccggtcg

SEQ ID NO: 163735 - DNA, 689 bp, Homo sapiens
  misc_feature: GYAE6OF01A3V2S.47.55.E11.1.454.CMB.1.raw
  modified_base (176)..(176): a, c, t, g, unknown or other
  misc_feature (176)..(176): n is a, c, g, or t
  modified_base (288)..(288): a, c, t, g, unknown or other
  misc_feature (288)..(288): n is a, c, g, or t
tcagagctcacgtacacgaccggtgctcgatttagcactcgcacgttgggtttgggggccgcagccctgggattcccagctgtttctgcttgctgatcaggactgcacacagagagctcacccatggagtctgggctagagcttgggttttccttgttgcttacttttaaaaggtntacagtgtgaggtgcgaggtagtggaggtccgggggagtcttagttcagcgtgggactcctgagtctctctgtgtagtctctggatcgtagtttacagttccttcgtaggtntcgacaccggtcggtacccgacccaaacgtaccggaagggttacggggcgttggtagtcgggtccacgtacgtaatccgtaacttccgtagtacgtcggtataacggtttagttaattaaacgttagtacggaccggtaaccgttcccgggtagggaaccggggtaccgtaagtttaccgacggctacgtccgtaccgaagtaccgaacgaaacggtacaaaggtacgttaagtaccgtagtacttaacgtaaggaattacgaacagttactaaggaacgtaggacctaggattacggattcgtattatcgtagttcggttcgttcgtacgttacgttcccggttcgggtaccgtaccgggttcgttaccgggtacgggtaccaaccgggttccgtacggg

SEQ ID NO: 163736 - DNA, 128 bp, Homo sapiens; identical to SEQ ID NO: 163391
  misc_feature: GYAE6OF02IHC9T.47.55.E11.1.454.CMB.1.raw
  modified_base (126)..(128): a, c, t, g, unknown or other
  misc_feature (126)..(128): n is a, c, g, or t

SEQ ID NO: 163737 - DNA, 188 bp, Homo sapiens
  misc_feature: GYAE6OF02FL52A.47.55.E11.1.454.CMB.1.raw
  modified_base (186)..(188): a, c, t, g, unknown or other
  misc_feature (186)..(188): n is a, c, g, or t
tcagagctcacgtacacgaccggtgctcgatttagcactcgcacgttgggatcgcagcctgactgcttacgtcttcggagctgggaccaaggtcaccgtcctaggtcagcccaaggccaaccccactgtcactctgttcccaccctcctctacgtgagctctgagcgggctggcaaggcgcatagnnn

SEQ ID NO: 163738 - DNA, 175 bp, Homo sapiens
  misc_feature: GYAE6OF02IKQ4K.47.55.E11.1.454.CMB.1.raw
  modified_base (175)..(175): a, c, t, g, unknown or other
  misc_feature (175)..(175): n is a, c, g, or t
tcagagctcacgtacacgaccggtgctcgatttagcactcgcacgttgggtttgggggaagaggaagactgaaggccctgctccaggagcacctccgagagcacagcggccctgggctgcctggtcaaggactacttcctacgtgagctctgagcgggctggcaaggcgcatagn

SEQ ID NO: 163739 - DNA, 537 bp, Homo sapiens
  misc_feature: GYAE6OF02I64GV.47.55.E11.1.454.CMB.1.raw
  modified_base (285)..(285): a, c, t, g, unknown or other
  misc_feature (285)..(285): n is a, c, g, or t
  modified_base (351)..(351): a, c, t, g, unknown or other
  misc_feature (351)..(351): n is a, c, g, or t
  modified_base (401)..(401): a, c, t, g, unknown or other
  misc_feature (401)..(401): n is a, c, g, or t
  modified_base (424)..(424): a, c, t, g, unknown or other
  misc_feature (424)..(424): n is a, c, g, or t
  modified_base (449)..(449): a, c, t, g, unknown or other
  misc_feature (449)..(449): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagcgtggtttcgtgtagctctttaaagtgtcagtgtgaggtgcaggtagtggagtccgggggaggcttagttcagcctggggagtccctgagactctcctgtgtagtctctggaatcagtttcagtaccttctggatgcatgggtccncaaactccgaggtaagggctggtgtggtctcacgtatcaatcctgatggctagtgttaataaattntgcggactcgtgacgggccgattcgagcatctcagagacaacggcaaagngtatactgtatcgtagaatgaanatcgtagagagtacgagtatacggntgtactatctatttgttgtttcgattcggtcccgtttggtcccggtcgggtacctttcggtacgggggccctacggggtacccctggg

SEQ ID NO: 163740 - DNA, 126 bp, Homo sapiens
  misc_feature: GYAE6OF02F41AQ.47.55.E11.1.454.CMB.1.raw
  modified_base (126)..(126): a, c, t, g, unknown or other
  misc_feature (126)..(126): n is a, c, g, or t
tcagagctcacgtacacgaccggtgctcgatttagcactcgcacgttgggtttgggtgccgaagtttctgcctggtcaaggactacttcctacgtgagctctgagcgggctggcaaggcgcatagn

SEQ ID NO: 163741 - DNA, 175 bp, Homo sapiens; identical to SEQ ID NO: 163294
  misc_feature: GYAE6OF02H3P1O.47.55.E11.1.454.CMB.1.raw
  modified_base (175)..(175): a, c, t, g, unknown or other
  misc_feature (175)..(175): n is a, c, g, or t

SEQ ID NO: 163742 - DNA, 175 bp, Homo sapiens; identical to SEQ ID NO: 163294
  misc_feature: GYAE6OF02G449C.47.55.E11.1.454.CMB.1.raw
  modified_base (175)..(175): a, c, t, g, unknown or other
  misc_feature (175)..(175): n is a, c, g, or t

SEQ ID NO: 163743 - DNA, 125 bp, Homo sapiens
  misc_feature: GYAE6OF02ILYWZ.47.55.E11.1.454.CMB.1.raw
  modified_base (125)..(125): a, c, t, g, unknown or other
  misc_feature (125)..(125): n is a, c, g, or t
tcagagctcacgtacacgaccggtgctcgatttagcactcgcacgttgggtttgggtgccgaagttgctgcctggtcaagactacttcctacgtgagctctgagcgggctggcaaggcgcatagn

SEQ ID NO: 163744 - DNA, 480 bp, Homo sapiens
  misc_feature: GYAE6OF02I43X1.47.55.E11.1.454.CMB.1.raw
  modified_base (382)..(382): a, c, t, g, unknown or other
  misc_feature (382)..(382): n is a, c, g, or t
  modified_base (470)..(480): a, c, t, g, unknown or other
  misc_feature (470)..(480): n is a, c, g, or t
tcagagctcacgtacacgaccggtgctcgatttagcactcgcacgttgggtttggggccgcagccctgggattcccagctgtttctgcttgctgatcaggactgcacacagagagctcaccatggagtctgggctgagctgggtttccttgttgctcttttaaaaggtgtccagtgtgaggtgcaggtagtggagtccggggaggcttagttcagcctggggagtccctgagactctcctgtgtagtctctggaatcagtttcagtaccttctggatgcactgggtccgccaaactccaggtaaggggccaggggaaccctggtcagcgtctcctcagcctccaccaaggcccatcggtctcccctgcgcctgctccaggancacctccgagagcacagcggccctgggctgcctggtcaaggacctacttcctacgtgagctctgagcgggctggcaagggcgcatagnnnnnnnnnnn

SEQ ID NO: 163745 - DNA, 127 bp, Homo sapiens; identical to SEQ ID NO: 163384
  misc_feature: GYAE6OF02G420F.47.55.E11.1.454.CMB.1.raw
  modified_base (126)..(127): a, c, t, g, unknown or other
  misc_feature (126)..(127): n is a, c, g, or t

SEQ ID NO: 163746 - DNA, 343 bp, Homo sapiens
  misc_feature: GYAE6OF02I51ZT.47.55.E11.1.454.CMB.1.raw
  modified_base (340)..(343): a, c, t, g, unknown or other
  misc_feature (340)..(343): n is a, c, g, or t
tcagagctcacgtacacgaccggtgctcgatttagcactcgcacgttgggttttccttgttgctctttaaaaggtgtccagtgtgaggtgcaggtagtggagtccggggaggcttagttcagcctggggagtccctgagactctcctgtgtagtctctggaatcagtttcagtaccttctggatgcactgggtccgccaaactccagcctccaccaagggcccatcggtcttcccctggcgccctgctccaggagcacctccgagagcacagcggccctgggctgcctggtcaaggactacttcctacgtgagctctgagcggctggcaaggcgcatagnnnn

SEQ ID NO: 163747 - DNA, 562 bp, Homo sapiens
  misc_feature: GYAE6OF02GHEK7.47.55.E11.1.454.CMB.1.raw
  modified_base (221)..(222): a, c, t, g, unknown or other
  misc_feature (221)..(222): n is a, c, g, or t
  modified_base (225)..(225): a, c, t, g, unknown or other
  misc_feature (225)..(225): n is a, c, g, or t
  modified_base (227)..(229): a, c, t, g, unknown or other
  misc_feature (227)..(229): n is a, c, g, or t
  modified_base (232)..(232): a, c, t, g, unknown or other
  misc_feature (232)..(232): n is a, c, g, or t
  modified_base (234)..(234): a, c, t, g, unknown or other
  misc_feature (234)..(234): n is a, c, g, or t
  modified_base (238)..(239): a, c, t, g, unknown or other
  misc_feature (238)..(239): n is a, c, g, or t
  modified_base (242)..(242): a, c, t, g, unknown or other
  misc_feature (242)..(242): n is a, c, g, or t
  modified_base (246)..(246): a, c, t, g, unknown or other
  misc_feature (246)..(246): n is a, c, g, or t
  modified_base (248)..(248): a, c, t, g, unknown or other
  misc_feature (248)..(248): n is a, c, g, or t
  modified_base (250)..(250): a, c, t, g, unknown or other
  misc_feature (250)..(250): n is a, c, g, or t
  modified_base (254)..(256): a, c, t, g, unknown or other
  misc_feature (254)..(256): n is a, c, g, or t
  modified_base (258)..(259): a, c, t, g, unknown or other
  misc_feature (258)..(259): n is a, c, g, or t
  modified_base (262)..(262): a, c, t, g, unknown or other
  misc_feature (262)..(262): n is a, c, g, or t
  modified_base (265)..(265): a, c, t, g, unknown or other
  misc_feature (265)..(265): n is a, c, g, or t
  modified_base (279)..(282): a, c, t, g, unknown or other
  misc_feature (279)..(282): n is a, c, g, or t
  modified_base (284)..(284): a, c, t, g, unknown or other
  misc_feature (284)..(284): n is a, c, g, or t
  modified_base (292)..(292): a, c, t, g, unknown or other
  misc_feature (292)..(292): n is a, c, g, or t
  modified_base (296)..(296): a, c, t, g, unknown or other
  misc_feature (296)..(296): n is a, c, g, or t
tcagagctcacgtacacgaccggtgctcgatttagcactcgcacgtttggggatcggcaggcctccgacctggtccttacggtctttcggagcttgggaccaaggtcaccgtcctaggtcagcccaaggccaaaccccactgtcactcgtgtttcccggcccttcctctaccgtggttacgtcttctgagtttacggggcttcggctaagggcgcgatagnntgngnnnggngntgcnncgnggcngncnctcnnncnnctntgntctctcatattatnnnncnctgtcgcncgcncgaggaggagagatagtgtctcgtagtagtaagtaagtaagtagacgaataataataataattatagtactaactactagtaggaggacgtagtactacactactctacgacgactaactacaacgaacgacgtactatacttactactaagtacggacgacgtacgtagagagacgtacgacgacgacgtcgtagtattagttacgtaggtaggaggaggaggaggtacgtaggtacggttagggtagggtcgggtacggtacgg

SEQ ID NO: 163748 - DNA, 514 bp, Homo sapiens
  misc_feature: GYAE6OF02H7VYD.47.55.E11.1.454.CMB.1.raw
  modified_base (328)..(328): a, c, t, g, unknown or other
  misc_feature (328)..(328): n is a, c, g, or t
  modified_base (347)..(347): a, c, t, g, unknown or other
  misc_feature (347)..(347): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccgggcagacggtcaccatctcttgtctggaagcagctccaatatcggaaatgataatgtatactggtaccagcaagtcccacgaacggcccccaaactcctcatctataacatgatcagcggccctnacgggtcctggccgattcnctggctcaagtctgcgctcagccaccctggccatcagtcgggctccggcccgaggatgaggctgattattactgtgtaggttggatcgcagcctgactgcttacgtcttcggagcgtgggacctaaggtccaccgtcctaggtcacgtcccaaggcccaaccctacg

SEQ ID NO: 163749 - DNA, 511 bp, Homo sapiens
  misc_feature: GYAE6OF02HMK0L.47.55.E11.1.454.CMB.1.raw
  modified_base (342)..(342): a, c, t, g, unknown or other
  misc_feature (342)..(342): n is a, c, g, or t
  modified_base (458)..(458): a, c, t, g, unknown or other
  misc_feature (458)..(458): n is a, c, g, or t
tcagagctcacgtacacgaccggtgctcgatttagcactcgcacgttgggtttggggagctgtggtagagaagacaggattcaggacaatctccagcatggccggcttccctctcctcctcaccctcctcactcactgtgcagggtcttgggcccagtctgtgctgactcagccaccctcagcgtctgggacccccggcagacggtcaccatctcttgttctggaagcagctccaatatcggaaatgataatgtatactggtaccagcaagtcccacgaaccggcccccaaactcctcatctataacaatgatcagcggcctcagggtccctggccgattcnctggctccaagtctggcgcctcagccaccctggccatcagtgggctccggcccgaggatgaggctgattattactgtgtaggttggatcgcagcctgactgcttacgtcttcgganctgggaccaaggtcaccgtcctaggtcagcccaaggcccaacccactcgctac

SEQ ID NO: 163750 - DNA, 125 bp, Homo sapiens; identical to SEQ ID NO: 163293
  misc_feature: GYAE6OF02IJ8BD.47.55.E11.1.454.CMB.1.raw

SEQ ID NO: 163751 - DNA, 177 bp, Homo sapiens
  misc_feature: GYAE6OF02GTZBL.47.55.E11.1.454.CMB.1.raw
  modified_base (175)..(177): a, c, t, g, unknown or other
  misc_feature (175)..(177): n is a, c, g, or t
tcagagctcacgtacacgaccggtgctcgatttagcactcgcacgttgggtttgggggaagaggaagactgacggccctgctccaggagcacctccgagagcacagcggccctgggctgcctggtcaaggactacttcctatgtatactctgagcgggctggcaaggcgcatagnnn

SEQ ID NO: 163752 - DNA, 126 bp, Homo sapiens; identical to SEQ ID NO: 163319
  misc_feature: GYAE6OF02HB1WQ.47.55.E11.1.454.CMB.1.raw
  modified_base (126)..(126): a, c, t, g, unknown or other
  misc_feature (126)..(126): n is a, c, g, or t

SEQ ID NO: 163753 - DNA, 187 bp, Homo sapiens
  misc_feature: GYAE6OF02HJLFZ.47.55.E11.1.454.CMB.1.raw
  modified_base (185)..(187): a, c, t, g, unknown or other
  misc_feature (185)..(187): n is a, c, g, or t
tcagagctcacgtacacgaccggtgctcgatttagcactcgcacgttgggatcgcagcctgactgcttacgtcttcggagctgggaccaaggtcaccgtcctaggtcagcccaaggccaaccccactgtcactctgttcccaccctcctctacgtgagcctgagcgggctggcaaggcgcatagnnn

SEQ ID NO: 163754 - DNA, 126 bp, Homo sapiens; identical to SEQ ID NO: 163319
  misc_feature: GYAE6OF02GF2EE.47.55.E11.1.454.CMB.1.raw
  modified_base (126)..(126): a, c, t, g, unknown or other
  misc_feature (126)..(126): n is a, c, g, or t

SEQ ID NO: 163755 - DNA, 517 bp, Homo sapiens
  misc_feature: GYAE6OF02GJ5MO.47.55.E11.1.454.CMB.1.raw
  modified_base (190)..(190): a, c, t, g, unknown or other
  misc_feature (190)..(190): n is a, c, g, or t
  modified_base (495)..(495): a, c, t, g, unknown or other
  misc_feature (495)..(495): n is a, c, g, or t
tcagagctcacgtacacgaccggtgctcgatttagcactcgcacgttgggtttggggagagaagacaggattcaggacaatctccagcatggccggcttccctctcctcctcaccctcctcactcactgtgcagggtcttgggcccagtctgtgctgactcagccaccctcagcgtctgggacccccggnagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcacgccaccctgccatcagtgggctccggcccgagatgaggctgattatactgtgtaggttgggatcgcagcctgactgcttacgtcttcggagtctgggaccaaggtccaccgtctaggtcagcccaaggcccaacccntcgtccactctcgtcccgtccc

SEQ ID NO: 163756 - DNA, 528 bp, Homo sapiens
  misc_feature: GYAE6OF02G1QYC.47.55.E11.1.454.CMB.1.raw
  modified_base (190)..(190): a, c, t, g, unknown or other
  misc_feature (190)..(190): n is a, c, g, or t
  modified_base (335)..(335): a, c, t, g, unknown or other
  misc_feature (335)..(335): n is a, c, g, or t
tcagagctcacgtacacgaccggtgctcgatttagcactcgcacgttgggtttggggagagaagacaggattcaggacaatctccagcatggccggcttccctctcctcctcaccctcctcactcactgtgcagggtcttgggcccagtctgtgctgactcagccaccctcagcgtctgggacccccggnagacggtcaccatctcttgttctggaagcagctccaatatcggaaatgataatgtatactggtaccagcaagtcccacgaacggcccccaaactcctcatctataacaatgatcagcggccctcgaggggtccctggccgattcnctggctccaagtctggcgcctcagccacctggcccatcagtgggcctccggcccgaggatgaggctgattattactgtgtaggttggatcgcagcctgactgctttacgtcgttcggagcgtgggaaccagggtccaccgttcctaggtcacgcccaaggcccaacccgctcgtccactctcgttccccgccc

SEQ ID NO: 163757 - DNA, 230 bp, Homo sapiens
  misc_feature: GYAE6OF02H5YUX.47.55.E11.1.454.CMB.1.raw
  modified_base (191)..(230): a, c, t, g, unknown or other
  misc_feature (191)..(230): n is a, c, g, or t
tcagagctcacgtacacgaccggtgctcgatttagcactcgcacgttgggatcgcagcctgactgcttacgtcttacggagctgggacccaaggtcaccgtcctaggtcaggcccaaggccaacccactgtcactctgttacccgccctcctctacgtgagctctgagcgggctggcaaggcgcgatagcnnnnnnnnnnnnnnnnnnnnnnnnnnnnnnnnnnnnnnnn

SEQ ID NO: 163758 - DNA, 513 bp, Homo sapiens
  misc_feature: GYAE6OF02G1HMB.47.55.E11.1.454.CMB.1.raw
  modified_base (216)..(216): a, c, t, g, unknown or other
  misc_feature (216)..(216): n is a, c, g, or t
  modified_base (377)..(377): a, c, t, g, unknown or other
  misc_feature (377)..(377): n is a, c, g, or t
  modified_base (415)..(415): a, c, t, g, unknown or other
  misc_feature (415)..(415): n is a, c, g, or t
  modified_base (447)..(447): a, c, t, g, unknown or other
  misc_feature (447)..(447): n is a, c, g, or t
tcagagctcacgtacacgaccggtgctcgatttagcactcgcacgttgggtttggggggggaagctcagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccgggnagacggtcaccatctcttgttctggaagcagctccaatatcggaaatgataatgtatactggtaccagcaagtcccacgaacggcccccaaactcctcatctataacaatgatcagcgccctcaggggtccctggccgattctctggctccaagtctggcncctcagccaccctggccatcagtggctccggccgaggntgagctgattattactgtgtaggttggatcgnatcctagactgcttacgtcttcggatcgtggaccaaggtccaccgtcctaggtcacgcccgaacgg

SEQ ID NO: 163759 - DNA, 484 bp, Homo sapiens
  misc_feature: GYAE6OF02HX66D.47.55.E11.1.454.CMB.1.raw
  modified_base (350)..(350): a, c, t, g, unknown or other
  misc_feature (350)..(350): n is a, c, g, or t
  modified_base (430)..(430): a, c, t, g, unknown or other
  misc_feature (430)..(430): n is a, c, g, or t
  modified_base (455)..(455): a, c, t, g, unknown or other
  misc_feature (455)..(455): n is a, c, g, or t
  modified_base (461)..(484): a, c, t, g, unknown or other
  misc_feature (461)..(484): n is a, c, g, or t
tcagagctcacgtacacgaccggtgctcgatttagcactcgcacggtttgggggtttgggggccgcacgcccctgggattcccagcctggtttcttgctttgctgatcaggactgcacacagagagctcaccattggagtctgggctgagtctgggttttccttgttgtactcttttaaaaggtgtccagtgtgaggtgcaggtagtggagtccgggggaggcttagttcagccgtgggggagtccctgagactctcctgtgtagtctctggaattcagtttcagtaccttctggatgcactgggtctgccaaactccagcctcaccaaggcccatcgtcttcccctgcnccctgctccaggacgcacctccgagacgcacacgccggccctgggcctgcctggtaccaagggtacctactccctacgtnagctcgtgagcgggctggcaaggcncatagnnnnnnnnnnnnnnnnnnnnnnnn

SEQ ID NO: 163760 - DNA, 580 bp, Homo sapiens
  misc_feature: GYAE6OF02GQEE1.47.55.E11.1.454.CMB.1.raw
  modified_base (225)..(225): a, c, t, g, unknown or other
  misc_feature (225)..(225): n is a, c, g, or t
  modified_base (374)..(374): a, c, t, g, unknown or other
  misc_feature (374)..(374): n is a, c, g, or t
tcagagctcacgtacacgaccggtgctcgatttagcactcgcacgttgggtttgggggagcttcagctgtggtacgagaaggaccaggattcacggacaatctccagtcattcggcccggcttcccctcttcctccgtcacccctcctcactcactggtgacagggtcttgggcccagtctgtgctagactcagccacctcagccgtacgtcgggacccccgggnacgaccggtcacccatcctcgttgttctggaagcaggtctccaatactacggtaaatcgagtaactgtataactaggttaccagcgaagtccccaacgaaccggcccccaaactcctctagtctataaccaatggactcagcggccctnacgggtccctggccgtattctcgtggctccgaagtctggcgtcctcacgccaccctggccatcagtcggctccggccgaggatgaggtctgatttattactgtcgtaggttggatcgacagccttgacctgacttacgtcttcggtagcgtggggaacccaagggtccaccgtcgtacggtcaacgacccacggtcccaaccctcg

SEQ ID NO: 163761 - DNA, 531 bp, Homo sapiens
  misc_feature: GYAE6OF02F7RQI.47.55.E11.1.454.CMB.1.raw
  modified_base (214)..(214): a, c, t, g, unknown or other
  misc_feature (214)..(214): n is a, c, g, or t
tcagagctcacgtacacgaccggtgctcgatttagcactcgcacgttgggtttggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggnagacggtcaccatctcttgttctggaagcagctccaatatcggaaatgataatgtatactggtaccagcaagtcccacgaaccggcccccaaactcctcatctaataacaatgatcagcggccctcaggggtccctggccgattctctggctccaagtctggcacctcagccctccctgccatcagtcgggcctccgggtccgaggatgaggctgatttattactgtgtaggttgggatcgcagcctgactgctttacgtcgttcgggagtccgtgggaccaaggttccaccggttcctaggtccaggccccaacgg

SEQ ID NO: 163762 - DNA, 450 bp, Homo sapiens
  misc_feature: GYAE6OF02IPC8C.47.55.E11.1.454.CMB.1.raw
  modified_base (436)..(436): a, c, t, g, unknown or other
  misc_feature (436)..(436): n is a, c, g, or t
  modified_base (441)..(450): a, c, t, g, unknown or other
  misc_feature (441)..(450): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccagcctccaccaagggcccatcggtcttcccctggccgccctgcctccaggacgcacctccgagacgcacagcggccctgggctgcctggtcaaggactacttcctacgtgagctctgagcgggctggcaaggcgnatagnnnnnnnnnn

SEQ ID NO: 163763 - DNA, 174 bp, Homo sapiens
  misc_feature: GYAE6OF02IIGAU.47.55.E11.1.454.CMB.1.raw
  modified_base (174)..(174): a, c, t, g, unknown or other
  misc_feature (174)..(174): n is a, c, g, or t
tcagagctcacgtacacgaccggtgctcgatttagcactcgcacgttgggtttggggaagaggaagactgacggccctgctccaggagcacctccgagagcacagcggccctgggctgcctggtcaaggactacttcctacgtgagctctgagcgggctggcaaggcgcatagn

SEQ ID NO: 163764 - DNA, 523 bp, Homo sapiens
  misc_feature: GYAE6OF02GE4TT.47.55.E11.1.454.CMB.1.raw
  modified_base (503)..(503): a, c, t, g, unknown or other
  misc_feature (503)..(503): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaagggctggtgtgggtctcacgtatcaatcctgatggcagtgttataaattatgcggactcgtgaggggccattcagcatctcagagacaacggcaagagtatactgtatctaggaaatgaacaatctagagagtcgacgatacggctgtctatctattgtgtttcgatcgtcctttcggtccgtcgggtacttcggnggggccctagggaccctggg

SEQ ID NO: 163765 - DNA, 489 bp, Homo sapiens
  misc_feature: GYAE6OF02IWSMS.47.55.E11.1.454.CMB.1.raw
  modified_base (410)..(410): a, c, t, g, unknown or other
  misc_feature (410)..(410): n is a, c, g, or t
  modified_base (428)..(428): a, c, t, g, unknown or other
  misc_feature (428)..(428): n is a, c, g, or t
  modified_base (475)..(489): a, c, t, g, unknown or other
  misc_feature (475)..(489): n is a, c, g, or t
tcagagctcacgtacacgaccggtgctcgatttagcactcgcacgttgggtcttgggcccagtctgtgctgactcagccaccctcagcgtctgggaccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttggatcgcagcctgactgcttacgtcttcggagctgggaccaagggtcaccgtcctaggtcagcccaaggcccaacccnctgtccactctgttcccnccctcctctacgtgacgctcgtgacgcgggctggcaaggcgcatagnnnnnnnnnnnnnnn

SEQ ID NO: 163766 - DNA, 569 bp, Homo sapiens
  misc_feature: GYAE6OF02IPE16.47.55.E11.1.454.CMB.1.raw
  modified_base (217)..(217): a, c, t, g, unknown or other
  misc_feature (217)..(217): n is a, c, g, or t
  modified_base (240)..(240): a, c, t, g, unknown or other
  misc_feature (240)..(240): n is a, c, g, or t
  modified_base (245)..(245): a, c, t, g, unknown or other
  misc_feature (245)..(245): n is a, c, g, or t
  modified_base (387)..(387): a, c, t, g, unknown or other
  misc_feature (387)..(387): n is a, c, g, or t
  modified_base (512)..(512): a, c, t, g, unknown or other
  misc_feature (512)..(512): n is a, c, g, or t
tcagagctcacgtacacgaccggtgctcgatttagcactcgcacgttgggtttggggggggaagctcagcttcagctgtggtagagaagacaggattcaggacaatctccagcatggccggcttccctctcctcctcaccctcctcactcactgtgcagggtcttgggcccagtctgtgctgactcagcccaccctcagcgtctcgggacccccggnagaccggtcaccatctcttttcnggaancagctccaatatcggaaatgataatgtatactggtaccagcaagtcccacgaaccggcccccaaactcctacatctataacaatgatcagccgccctcgacgggtccctgggccgtattctctggcctaccaagtctggccnccctcacgccccacccgtcggccatcgaggtcgggcctcccgggcccgaggagtggacggtctagtatttacttactggtgttagggttggactcgcacgcctgactgtccttacgtcttacggngtcgtacgggacctaggttcccaccggttcgtacggtcacggtcccgaaggtccccc

SEQ ID NO: 163767 - DNA, 483 bp, Homo sapiens
  misc_feature: GYAE6OF02FZDUT.47.55.E11.1.454.CMB.1.raw
  modified_base (464)..(464): a, c, t, g, unknown or other
  misc_feature (464)..(464): n is a, c, g, or t
  modified_base (469)..(483): a, c, t, g, unknown or other
  misc_feature (469)..(483): n is a, c, g, or t
tcagagctcacgtacacgaccggtgctcgatttagcactcgcacgttgggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggccgaggatgaggctgattattactgtgtaggttgggatcgcagcctgactgcttacgtcttcggagctgggaccaggtcaccgtctagtcagcccaagcccaacccactgtcactctcgtccccgcctcctctacgtgacgctcgtgacgcgggctggccaggcncatgnnnnnnnnnnnnnnn

SEQ ID NO: 163768 - DNA, 186 bp, Homo sapiens
  misc_feature: GYAE6OF02FUOA9.47.55.E11.1.454.CMB.1.raw
  modified_base (186)..(186): a, c, t, g, unknown or other
  misc_feature (186)..(186): n is a, c, g, or t
tcagagctcacgtacacgaccggtgctcgatttagcactcgcacgttgggatcgcagcctgactgcttacgtcttcggagctgggaccaaggtcaccgtcctaggtcagcccaaggccaaccccactgtcactctgttcccgccctcctctacgtgagctctgagcgggctggcaaggcgcatagn

SEQ ID NO: 163769 - DNA, 550 bp, Homo sapiens
  misc_feature: GYAE6OF02HRHEC.47.55.E11.1.454.CMB.1.raw
tcagagctcacgtacacgaccggtgctcgatttagcactcgcacgttgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgcctttcggtccgcgggtacttcgtggggccagggaaccctggtcacgcgtctcctcacgcctccaccaacgggcccagtccggtccttccccgtggccgcccgtgcctccgaggcgcaccctccgagacgcaccgacgccggccctgggcctggcctggtctaacgg

SEQ ID NO: 163770 - DNA, 517 bp, Homo sapiens
  misc_feature: GYAE6OF02HGRKL.47.55.E11.1.454.CMB.1.raw
  modified_base (190)..(190): a, c, t, g, unknown or other
  misc_feature (190)..(190): n is a, c, g, or t
  modified_base (514)..(514): a, c, t, g, unknown or other
  misc_feature (514)..(514): n is a, c, g, or t
tcagagctcacgtacacgaccggtgctcgatttagcactcgcacgttgggtttggggagagaagacaggattcaggacaatctccagcatggccggcttccctctcctcctcaccctcctcactcactgtgcagggtcttgggcccagtctgtgctgactcagccaccctcagcgtctgggacccccggnagacggtcaccatctcttgttctggaagcagctccaatatcggaaatgataatgtatactggtaccagcaagtcccacgaacggcccccaaactcctcatctaataacaatgatcagcggccctcgacggggtccctggccgattctctggctccaagtctggcgcctcacgccacctggccatccagtcggctccggcccgaggatgaggctgattatactgtgtaggttggatcgcagcctgactgcttacgtcttcggagtcgtggaccaggtcaccgtctaggtcagcccaaggcccaccgactcgccactctcgtcccnccc

SEQ ID NO: 163771 - DNA, 520 bp, Homo sapiens
  misc_feature: GYAE6OF02G22JS.47.55.E11.1.454.CMB.1.raw
  modified_base (206)..(206): a, c, t, g, unknown or other
  misc_feature (206)..(206): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctggggacccccggnagacggtcaccatctcttgttctggaagcagctccaatatcggaaatgataatgtatactggtaccagcaagtcccacgaaccggcccccaaactcctcatctataacaatgatcagccggccctcgaggggtccctggccgattctctggctccaagtctggcgcctcacgccaccctggccatcagtcgggcctccgggccgaggatggagctgattatctgtgtaggttggatcgcagcctgactgccttacgtcgttcggagtcgtggaccaggtccaccgtctaggtcacgacccaggcccaccctacg

SEQ ID NO: 163772 - DNA, 577 bp, Homo sapiens
  misc_feature: GYAE6OF02IEW4B.47.55.E11.1.454.CMB.1.raw
  modified_base (207)..(207): a, c, t, g, unknown or other
  misc_feature (207)..(207): n is a, c, g, or t
tcagagctcacgtacacgaccggtgctcgatttagcactcgcacgttgggtttggggcagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccgggnagacggtcaccatctcttgttctggaagcagctccaaatatcggaaatgataatgtatactggtaccagcaagtcccaacgaaccggcccccaaactcctacatctaataacaatgatcagcgcctcgaggggtccctggccgattctctcggctccaagtctggccgcctcacgcccacccgtcggaccatcgacggtgggccgtccgggcccgaggactcggaacggtctgtatttattactggttggtaggttggactcgcagtcctgactgtaccgttacgtcgttcgggacgtcgttacgggacctaacggttccgaacccggttccgtacgggtccaacggccccgaacggacccctaaccccg

SEQ ID NO: 163773 - DNA, 535 bp, Homo sapiens
  misc_feature: GYAE6OF02GTQNA.47.55.E11.1.454.CMB.1.raw
  modified_base (292)..(292): a, c, t, g, unknown or other
  misc_feature (292)..(292): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccnccaaactccaggtaaggggctggtgtgggtctcacgtatcaatcctgatggcagtgttaataaattatgcggactccgtgaggggccattcagcatctccagagacaacggcaagagtatactgttatctaggaaatgaacaatctgagagtcgacgatacggctgtctatcattgttgttttcgattcgtccgtttcggtcccgcgggtacttccggtcggggccctaggggacccctcggg

SEQ ID NO: 163774 - DNA, 496 bp, Homo sapiens
  misc_feature: GYAE6OF02JBF6H.47.55.E11.1.454.CMB.1.raw
  modified_base (481)..(496): a, c, t, g, unknown or other
  misc_feature (481)..(496): n is a, c, g, or t
tcagagctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggccccaaactcctcatctataacaatgatcagcggccctcaggggtccctggccgattctctggctccaagtctggcgcctcagcccaccctggccatcagtgggctccggcccgaggatggaggctgattattactgtgtaggttggatcgcagcctgactgcttacgtcttcggagctgggaccaagggtcaccgtcctaggtccagccccaaggcccaaccccactgtccacctctcgttccccgcccttcctctacgtgacgctctgagcgggctggcaggcgcatagnnnnnnnnnnnnnnnn

SEQ ID NO: 163775 - DNA, 491 bp, Homo sapiens
  misc_feature: GYAE6OF02H2UC6.47.55.E11.1.454.CMB.1.raw
  modified_base (477)..(477): a, c, t, g, unknown or other
  misc_feature (477)..(477): n is a, c, g, or t
  modified_base (483)..(491): a, c, t, g, unknown or other
  misc_feature (483)..(491): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctgggggagtccctgagactctcctgtgtagtctctggaatcagtttcagtaccttctggatgcactgggtccgccaaactccaggtaaggggccagggaaccctggtcagcgtctcctcagcctccaccaaggccccatccggtcttccccctggcgccctgactcccaggagccacctccgagagcacagcggccctgggctgcctggtcaaggactacttcctacgtgagctctgacgcgggctgggcaagggcncatagnnnnnnnnn

SEQ ID NO: 163776 - DNA, 483 bp, Homo sapiens
  misc_feature: GYAE6OF02G5QG1.47.55.E11.1.454.CMB.1.raw
  modified_base (407)..(407): a, c, t, g, unknown or other
  misc_feature (407)..(407): n is a, c, g, or t
  modified_base (467)..(467): a, c, t, g, unknown or other
  misc_feature (467)..(467): n is a, c, g, or t
  modified_base (472)..(483): a, c, t, g, unknown or other
  misc_feature (472)..(483): n is a, c, g, or t
tcagagctcacgtacacgaccggtgctcgatttagcactcgcacgtagggtcttgggcccagtctgtgctgactcagccaccctcagcgtctgggaccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatggaggctgattatactgtgtaggttggatcgcagcctgactgcttacgtcttcggagctgggaccaggtcaccgtctaggtcagcccaaggcccaacccnctcgtcactctcgttccccaccctcctctacgtgactctctgacgcgggctggcaaggcncatgnnnnnnnnnnnn

SEQ ID NO: 163777 - DNA, 545 bp, Homo sapiens
  misc_feature: GYAE6OF02IPIZJ.47.55.E11.1.454.CMB.1.raw
  modified_base (186)..(186): a, c, t, g, unknown or other
  misc_feature (186)..(186): n is a, c, g, or t
  modified_base (436)..(436): a, c, t, g, unknown or other
  misc_feature (436)..(436): n is a, c, g, or t
  modified_base (454)..(454): a, c, t, g, unknown or other
  misc_feature (454)..(454): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctacttttaaaaggtgtccagtgtgaggtncaggtagtggagtccggggagcttagttcagcctgggggagtccctggagactctcctgcgcagcctctggattctcctttagtagttatgccatgacttgggtcccgccaggctccgagggaaggggctggagtgggtctcgaggcattggtggtagtggtcgaccaggacactatttaacgtaaagtccctgcaggggccgatttcgtttatctccgagagacaattccgaaggaacatactgattcngcagttgacagactgagngtacgagacacggcgttatattatgtattaagtgggatcgggtgtctacgacttcgttgggggccgggaacccttgggtaccaccggtctc

SEQ ID NO: 163778 - DNA, 605 bp, Homo sapiens
  misc_feature: GYAE6OF02GHPD5.47.55.E11.1.454.CMB.1.raw
  modified_base (197)..(197): a, c, t, g, unknown or other
  misc_feature (197)..(197): n is a, c, g, or t
  modified_base (217)..(217): a, c, t, g, unknown or other
  misc_feature (217)..(217): n is a, c, g, or t
  modified_base (317)..(317): a, c, t, g, unknown or other
  misc_feature (317)..(317): n is a, c, g, or t
tcagagctcacgtacacgaccggtgctcgatttagcactcgcacgttgggtttgggggggggaagctcagcttcagctgtggtagagaagacaggattcaggacaatctccagcatggccggcttccctctcctcctcaccctcctcactcactgtgcagggtcttgggcccagtctgtgctgactcagccaccctnagcgtctgggaccccccggnagacggtcaccattctcttgttctggaagcagctcaatatcggaaatgataatgtatactggtaccagcaagtcccaacgaaccggcccccaaaactccncatctaataacaatgatcagccggccctacgacgggggttccctgggcccgtatttcctcgtggaccttaccgaagttccgtacggccgccctcgacgcccacccgtgggccctatccgaggtcgggcctcccgggcccgagggatggacggtctaggtatttacgtacgtggtacggttagggttgggactcggaccagtccgtgacttcgtcgttacggtccgttcgggagtccgtacgggaacctaggtcccacccggttccgtacggtcacggaccctaacggg

SEQ ID NO: 163779 - DNA, 770 bp, Homo sapiens
  misc_feature: GYAE6OF02H8UX9.47.55.E11.1.454.CMB.1.raw
  modified_base (730)..(730): a, c, t, g, unknown or other
  misc_feature (730)..(730): n is a, c, g, or t
tcagagctcacgtacacgaccggtgctcgatttagcactcgcacgttagggttcggttggccaagtctgtgctgactcgagccaccctcagcggtctgggaccccgggcgacgacggtcaccatctcttggttctcggagcagctccaagtatccggaaatgtactaatgtatactggtaccagcaagtcccaccgaacggccccaaactctccactctataacatagtatgagccggcctcacggggttccctttggccggattcgtcgtcggcttccgaagtctggtcgcctgagccaccgtggccactcggacgtacgggcccttccggacccgtacggtatacgtaacgggtcccttaggaacttttacgttaaccgttgggtttacggttacggggtttacgggggttaacgttcccggaccgttaacggggtcccttagggacgttcgaccgtttaccgttcgtttcggggaagaccgttagggggtaaccctttaacgggttcctaacccggtttcctaagggttccctaacggtccccgtaaacgggtaccctaaaccccgtcgttcggtacccgtaaccggtcccgttaaccggtttacccccgcccgtttacccttttacgtaccggtcgaacgttaccttcgtcgaacccggttcccgggtacccctttagggacccgttaaacgggccgtaaccgggtaacttaacgggtctaaccgnttaccgagtccgaacgttgacggcctaagcacctagtctg

SEQ ID NO: 163780 - DNA, 555 bp, Homo sapiens
  misc_feature: GYAE6OF02JWGQC.47.55.E11.1.454.CMB.1.raw
  modified_base (214)..(214): a, c, t, g, unknown or other
  misc_feature (214)..(214): n is a, c, g, or t
  modified_base (242)..(242): a, c, t, g, unknown or other
  misc_feature (242)..(242): n is a, c, g, or t
tcagagctcacgtacacgaccggtgctcgatttagcactcgcacgttgggtttgggggggaagctcagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccggnagacggtcaccatctcttgttctggaancagctccaatatcggaaatgataatgtatactggtaccagcaagtcccacgaacggcccccaaactcctacatctataacaatgatcagcgccctcgacggggtccctggccgtattctctggctccaagtctggccgcctcacgccacccgtggccatcagtcgggcctcccggcccgaggactggaggctggtacttagttacgtggttacgtaggtttcgggattcggccgagcccgtgacgtgtcttacgtcgttcgggagtcgtcgggaccgtaggtcctaccgtccgtaggtccacggacccaacgg

SEQ ID NO: 163781 - DNA, 125 bp, Homo sapiens
  misc_feature: GYAE6OF02GUH3X.47.55.E11.1.454.CMB.1.raw
tcagagctcacgtacacgaccggtgctcgatttagcactcgcacgttgggtttgggtgccgaagttactgcctggtcaaggactacttcctacgtgagctctgagcgggctggcaaggcgcatag

SEQ ID NO: 163782 - DNA, 540 bp, Homo sapiens
  misc_feature: GYAE6OF02HI8XS.47.55.E11.1.454.CMB.1.raw
  modified_base (292)..(292): a, c, t, g, unknown or other
  misc_feature (292)..(292): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccnccaaactccaggtaaggggctggtgtgggtctcacgtatcaatcctgatggcagtgttataaattatgcggactccgtgacggggcgattcagcatctcagagacaacggcaagagtatactgtatcgtaggaaatgaaacaatctagagagtcgacgatacggctgtctatctatttgttttacgattcgtccgttccggtccggcgggtactttcggcggggtacccacgggtacccgtggtaccg

SEQ ID NO: 163783 - DNA, 551 bp, Homo sapiens
  misc_feature: GYAE6OF02IGM43.47.55.E11.1.454.CMB.1.raw
  modified_base (521)..(521): a, c, t, g, unknown or other
  misc_feature (521)..(521): n is a, c, g, or t
tcagagctcacgtacacgaccggtgctcgatttagcactcgcacgttgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaagggctggtgtgggtctcacgtatcaatcctgatggcagtgttataaatatgcggactccgtgaggggccgattcagcatctccagagacaacggcaagagtatactgtatctggaaatgaacaatctgagagtcgacgatacggctgtctatcattgtgttttcgattcgccttcggtccgcgggtacttcgtgggccagggaaccctggtcagcgtctcctcacgcctccaccaacgggcccagtccggtccttccccgtggccgccctcgcctcccgaggacgccaccgtccgacgacgccaacgngccggcccgtgggcctcggcctggcaacgg

SEQ ID NO: 163784 - DNA, 555 bp, Homo sapiens
  misc_feature: GYAE6OF02HOPSC.47.55.E11.1.454.CMB.1.raw
  modified_base (206)..(206): a, c, t, g, unknown or other
  misc_feature (206)..(206): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccgggnagacggtcaccatctcttgtctggaagcagctccaatatcgaatgataatgtatactggtaccagcaagtcccacgaaccggccccaaactcctcatctataacaatgatcagcggcctcgaggggtccctggccgatttcctctcggctccaagtctggcgcctcagcccaccctggccatcagtcgggccgtccggcccggaggactggaggtctagatttatacgttgtggttaggttgggatcgctagccttacgctgtccttacggttcttcgggagtccgtagggacccgtaaggtccctaccgtccgttagggtccacgacccgaacggccccaacccctcg

SEQ ID NO: 163785 - DNA, 386 bp, Homo sapiens
  misc_feature: GYAE6OF02FO4ET.47.55.E11.1.454.CMB.1.raw
  modified_base (380)..(386): a, c, t, g, unknown or other
  misc_feature (380)..(386): n is a, c, g, or t
tcagagctcacgtacacgaccggtgctcgatttagcactcgcacgttgggttttccttgttgctcttttaaaaggtgtccagtgtgaggtgcaggtagtggagtccgggggaggcttagttcagcctgggagtccctgagactctcctgtgtagtctctggaatcagtttcagtaccttctggatgcactgggtccaccaaaactccaggtaaggggccagggaaccctggtcagcgtctcctcagcctccaccaagggcccatcggtcttccccctggcgccctgctccaggagcacctccgagagcacagcggccctgggctgcctggtcaaggactacttcctacgtgagctctgagcggctggcaaggcgcatagnnnnnnn

SEQ ID NO: 163786 - DNA, 492 bp, Homo sapiens
  misc_feature: GYAE6OF02I1YLX.47.55.E11.1.454.CMB.1.raw
  modified_base (473)..(473): a, c, t, g, unknown or other
  misc_feature (473)..(473): n is a, c, g, or t
  modified_base (477)..(492): a, c, t, g, unknown or other
  misc_feature (477)..(492): n is a, c, g, or t
tcagagctcacgtacacgaccggtgctcgatttagcactcgcacgttgggtcttgggcccagtctgtgctgactcagccaccctcagcgtctgggaccccgggcagacggtcaccatctcttgttctggaagcagctccaatatcggaaatgataatgtatactggtaccagcaagtcccacgaacggccccaaactcctcatctataacaatgatcagcggccctcaggggtccctggccgattctctggctccaagtctggcgcctcagccaccctggccatcagtgggctccggcccgaggatggaggctgattattactgtgtaggttgggatcgcagcctgactgcttacgtcttcggagtctgggaccaggtcaccgtcctaggtcagcccaaggcccaacccatcgtccacttctcgttccccgccttcctctacgtgagctctgacgcgggtctgggacaggcgnatgnnnnnnnnnnnnnnnn

SEQ ID NO: 163787 - DNA, 597 bp, Homo sapiens
  misc_feature: GYAE6OF02JBG2K.47.55.E11.1.454.CMB.1.raw
  modified_base (207)..(207): a, c, t, g, unknown or other
  misc_feature (207)..(207): n is a, c, g, or t
  modified_base (349)..(349): a, c, t, g, unknown or other
  misc_feature (349)..(349): n is a, c, g, or t
  modified_base (366)..(366): a, c, t, g, unknown or other
  misc_feature (366)..(366): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctcggggacccccggnagacggtcaccatctcttgtctggaagcagctccaatatcggaaatgataatgtatactggtacagcaagtcccacgaaccgccccaaactcctcatctaataacaatgatcagccggccctcgacgggtcctggccattcnctggctacagtctggcncctcacgccacccgtggaccatcgaggtcgggcctcccgggacccggaggacgtggacggtctgtaactttacgttacgtggtaggttagggttacgggtacttccggacgacggtccgttagaccgttggtccgtttacgtcgtttcgggacggtccgttacggggaacctaacgggtcccgaaccgttccgtacgggtccacggaccccgaacggccccaacccctacg

SEQ ID NO: 163788 - DNA, 521 bp, Homo sapiens
  misc_feature: GYAE6OF02F7W50.47.55.E11.1.454.CMB.1.raw
  modified_base (191)..(191): a, c, t, g, unknown or other
  misc_feature (191)..(191): n is a, c, g, or t
  modified_base (352)..(352): a, c, t, g, unknown or other
  misc_feature (352)..(352): n is a, c, g, or t
  modified_base (496)..(496): a, c, t, g, unknown or other
  misc_feature (496)..(496): n is a, c, g, or t
tcagagctcacgtacacgaccggtgctcgatttagcactcgcacgttgggtttggggagagaagacaggattcaggacaatctccagcatggccggcttccctctcctcctcaccctcctcactcactgtgcagggtcttgggcccagtctgtgctgactcagccaccctcagcgtctgggacccccgggnagacggtcaccatctcttgttctggaagcagctccaatatcggaaatgataatgtatactggtaccagcaagtcccacgaacgcccccaaactcctcatctataacaatgatcagcggcctcaggggtccctggccgattctctggctccaagtctggccncctcacgccaccctggccatcagtggctccggcccgaggatgaggctgattatactgtgtaggttggatcgcagcctgactgcttacgtcttcggagcgtgggaccaaggtccaccgtctaggtcacgcccaaggcccaacccnctcgtccactcctcgtcccctaccc

SEQ ID NO: 163789 - DNA, 551 bp, Homo sapiens
  misc_feature: GYAE6OF02IGSWX.47.55.E11.1.454.CMB.1.raw
  modified_base (205)..(205): a, c, t, g, unknown or other
  misc_feature (205)..(205): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccggnagacggtcaccatctcttgttctggaagcagctccaatatcgaatgataatgtatactgtaccagcaagtcccacgaacggcccccaaactcctcatctataacaatgatcagccggccctcgacgggtccctggccgtatttctcgtgctccaagttctcggcgcctcgacgcccacccgtcggcctactcgaggtcgggcctcccgggcccgaggatggaggctgatttattgcgtggttgtagggttggatcgcgacgtcctagctgtccttacgtcgttcggagtcgtcgggaccaaggtccaccgttccgtaggtccacggcccgaccggccctaaccccg

SEQ ID NO: 163790 - DNA, 562 bp, Homo sapiens
  misc_feature: GYAE6OF02GIGSG.47.55.E11.1.454.CMB.1.raw
  modified_base (186)..(186): a, c, t, g, unknown or other
  misc_feature (186)..(186): n is a, c, g, or t
  modified_base (206)..(206): a, c, t, g, unknown or other
  misc_feature (206)..(206): n is a, c, g, or t
  modified_base (370)..(370): a, c, t, g, unknown or other
  misc_feature (370)..(370): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctnagcgtctgggacccccgggnagacggtcaccatctcttgttctggaagcagctccaatatcggaaatgataatgtatactggtaccagcaagtcccacgaaccggccccaaactcctcatctaacaacaatgatcagcggccctgacggggtccctggccgattctctggctccaagtctggcncctcacgccacctggccatcaggtcgggcctccggcccgaggactgaggctgattattactgtgtaggttggatcgcagcctgacctgtcttacgtcgtttcgggacgtcgtcggggaaccctaagggttcccaacccggttccgtaacgggtccaaccggcccccgaaacgggacccccaaaccccgtacg

SEQ ID NO: 163791 - DNA, 535 bp, Homo sapiens
  misc_feature: GYAE6OF02I0CE0.47.55.E11.1.454.CMB.1.raw
tcagagctcacgtacacgaccggtgctcgatttagcactcgcacgttgggtttgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgagggccattcccagcatctccagagacaacggcaagagtatactgtatctggaaatgaacaatctgagagtcgacgatacggctgtctatcattgtgttttcgattgccttcggtccgcgggacttctggggccagggaaccctggtcagcgtctcctcagcctcaccaagggcccatccggtcttccccctggccgccctgcctccaggcgccacctccgagacgcacacgccggccctgggctgccgtggtccaaggacctacgttcctacggtcgagtcctcgtgaggcgggctggcaagggcgctag

SEQ ID NO: 163792 - DNA, 488 bp, Homo sapiens
  misc_feature: GYAE6OF02HB3VW.47.55.E11.1.454.CMB.1.raw
  modified_base (468)..(468): a, c, t, g, unknown or other
  misc_feature (468)..(468): n is a, c, g, or t
  modified_base (473)..(474): a, c, t, g, unknown or other
  misc_feature (473)..(474): n is a, c, g, or t
  modified_base (476)..(488): a, c, t, g, unknown or other
  misc_feature (476)..(488): n is a, c, g, or t
tcagagctcacgtacacgaccggtgctcgatttagcactcgcacgtagggtcttgggcccagtctgtgctgactcagccaccctcagcgtctgggaccccgggcagacggtcaccatctcttgttctggaagcagctccaatatcggaaatgataatgtatactggtaccagcaagtcccacgaacggccccaaactcctcatctataacaatgatcagcggccctcaggggtccctggccgattctctggctccaagtctggcgcctcagccacctggccatcagtgggctccggcccgaggatgaggctgatttattactgtgtaggttgggatcgcagcctgactgcttacgtcttcggagctgggaccaaggtcaccgtcctaggtcatcccaaggcccaacccatgtcactctcgttccccaccctcctctacgtgacgctctgacgcggctggcaaggccgnatagnngnnnnnnnnnnnnn

SEQ ID NO: 163793 - DNA, 177 bp, Homo sapiens
  misc_feature: GYAE6OF02GXQTV.47.55.E11.1.454.CMB.1.raw
  modified_base (175)..(177): a, c, t, g, unknown or other
  misc_feature (175)..(177): n is a, c, g, or t
tcagagctcacgtacacgaccggtgctcgatttagcactcgcacgttgggtttgggggaagaggaagactgacggccctgctccaggagcacctccgagagcacagcggccctgggctgcctggtcaaggactacttcctacgtgagctctgagcgggctggcaaggcgcatagnnn

SEQ ID NO: 163794 - DNA, 517 bp, Homo sapiens
  misc_feature: GYAE6OF02HGUBW.47.55.E11.1.454.CMB.1.raw
  modified_base (206)..(206): a, c, t, g, unknown or other
  misc_feature (206)..(206): n is a, c, g, or t
  modified_base (369)..(369): a, c, t, g, unknown or other
  misc_feature (369)..(369): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccgggnagacggtcaccatctcttgttctggaagcagctccaatatcggaaatgataatgtatactggtaccagcaagtccacgaacgccccaaatcctcatctataacaatgatcagccggccctcgacggggtccctggccgattcgtctcggctccaagtctggcncctcagcccacctcggccagtcagtcgggcctccggccgaggactgaggctgtattatcgtgtgttaggttggatcgcagcctgactgcttacgtctggacgcgtggaccaggtcaccgtcaggtcacgcccgaaggcccaccctacg

SEQ ID NO: 163795 - DNA, 532 bp, Homo sapiens
  misc_feature: GYAE6OF02IJJKA.47.55.E11.1.454.CMB.1.raw
  modified_base (430)..(430): a, c, t, g, unknown or other
  misc_feature (430)..(430): n is a, c, g, or t
  modified_base (458)..(458): a, c, t, g, unknown or other
  misc_feature (458)..(458): n is a, c, g, or t
  modified_base (509)..(509): a, c, t, g, unknown or other
  misc_feature (509)..(509): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagttaccttctggatgcactgggtcccgccaaactccaggtaagggctgggtgtgggtctcacgtatcaatcctgatggcagtgttataaattatgcggactcgtgaggggtccgattcgagcatctccagagacaacggcaagagtatactgtatctagaatnaacaatctagagagtacgacgagtacgntagtctatcatttgtttcgattgtccgttcggtccggtcgggtacttcggnggggccagggacccgtggtaccg

SEQ ID NO: 163796 - DNA, 591 bp, Homo sapiens
  misc_feature: GYAE6OF02I7SVH.47.55.E11.1.454.CMB.1.raw
  modified_base (291)..(291): a, c, t, g, unknown or other
  misc_feature (291)..(291): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttcctgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccnccaaactccgaggtagggctggtgtgggtctcacgtatcaatcctgatggctagtgttaataaattatgcggtactccggtaggacgggggtcccgtagttccgagtcctaatcctaccgaaggtaacgaaccgaaacgggacgaaacggtagtaatacgtagttatacgtaggaaatagaactaagtcgtagagagtacgaacgacgttacggctggtactatctattgttgttttcgattcggtccgttcggtccgtccgggtacgttcggtcggggtccgtacggggtaccctcggg

SEQ ID NO: 163797 - DNA, 518 bp, Homo sapiens
  misc_feature: GYAE6OF02GQQG1.47.55.E11.1.454.CMB.1.raw
  modified_base (199)..(199): a, c, t, g, unknown or other
  misc_feature (199)..(199): n is a, c, g, or t
  modified_base (222)..(222): a, c, t, g, unknown or other
  misc_feature (222)..(222): n is a, c, g, or t
tcagagctcacgtacacgaccggtgctcgatttagcactcgcacgttgggtttggggagctgtggtagagaagacaggattcaggacaatctccagcatggccggcttccctctcctcctcaccctcctcactcactgtgcagggtcttgggcccagtctgtgctgactcagccaccctcagcgtctgggacccccggnagacggtcaccatctcttgttcnggaagcagctccaatatcggaaatgataatgtatactggtaccagcaagtcccacgaacggcccccaaactcctcatctataacaatgatcagcggccctcgacggggtccctggccattctctggctccaagtctggcgcctcacgccaccctggcccatcagtcgggcctccggcccgaggatgaggctgattattactgtgtaggttggatcgcagctgctgcttacgtcttcggagcgtcggaccaggtccaccgtccgtaggtcacgcccaaggcccaacccgctcgctcc

SEQ ID NO: 163798 - DNA, 179 bp, Homo sapiens
  misc_feature: GYAE6OF02JEWX0.47.55.E11.1.454.CMB.1.raw
  modified_base (175)..(179): a, c, t, g, unknown or other
  misc_feature (175)..(179): n is a, c, g, or t
tcagagctcacgtacacgaccggtgctcgatttagcactcgcacgttgggtttgggggaagaggaagactgacggccctgctccaggagcacctccgagagcacagcggccctgggctgcctggtcaaggactacttcctacgtgagctctgagcgggctggcaaggcgcatagnnnnn

SEQ ID NO: 163799 - DNA, 556 bp, Homo sapiens
  misc_feature: GYAE6OF02I6VCP.47.55.E11.1.454.CMB.1.raw
  modified_base (207)..(207): a, c, t, g, unknown or other
  misc_feature (207)..(207): n is a, c, g, or t
  modified_base (374)..(374): a, c, t, g, unknown or other
  misc_feature (374)..(374): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagtcaccctcagcgtctcgggacccccgggnagacggtcaccatctcttgtctggaagcagctccaatatcggaaatgataatgtatactggtaccagcaagtcccacgaaccggcccccaaactccctcatctaataacaatgatcagcggccctcgacggggtccctggccgattctctggctccaagtctggccncctcacgcccaccctcggcccatcgaggtcgggcctccgggcccgaggactggacggtctgtatttacttacgtgtggttaggttgggatcgcgacgcctgactgtcttacgtcttcggagtcgtcgggacctaaggtccaccgtccgtacggtccacgacccgaacggcccaaccccgtcg

SEQ ID NO: 163800 - DNA, 534 bp, Homo sapiens
  misc_feature: GYAE6OF02HE9V9.47.55.E11.1.454.CMB.1.raw
  modified_base (192)..(192): a, c, t, g, unknown or other
  misc_feature (192)..(192): n is a, c, g, or t
  modified_base (510)..(510): a, c, t, g, unknown or other
  misc_feature (510)..(510): n is a, c, g, or t
tcagagctcacgtacacgaccggtgctcgatttagcactcgcacgttgggtttggggagagaagacaggattcaggacaatctccagcatggccggcttccctctcctcctcaccctcctcactcactgtgcagggtcttgggcccagtctgtgctgactcagccaccctcagcgtctcggggacccccggnagacggtcaccatctcttgttctggaagcagctccaatatcggaaatgataatgtatactggtaccagcaagtcccacgaacggcccccaaatcctcatctattaacaatgatcagcggcctcgaggggtccctggccgattctctggctccaagtctggcgcctcacgcccaccctggccatccgagtcgggctccggcccgaggactggacggctgattatactgtgtaggttggatcgcagcctgactgtctttacgtcttcggagtcgtggaccaaggtccaccgtctaggtcacgcccaaggcccaacccgtntcgtccactctcgttccccacccg

SEQ ID NO: 163801 - DNA, 572 bp, Homo sapiens
  misc_feature: GYAE6OF02GVJ16.47.55.E11.1.454.CMB.1.raw
  modified_base (206)..(206): a, c, t, g, unknown or other
  misc_feature (206)..(206): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccgggnagacggtcaccatctcttgttctggaagcagctccaatatcggaaatgataatgtatactggtaccagcaagtcccacgaaccggcccccaaactcctcatctataacaatgatcagcggccctcgaggggtccctggccgattctctggctccaagtctggcgcctcgacgcccaccccgtggcccactcgaggtcgggccgtcccggcccggaggacgtcggaggctgtatttattacgtgttggtagggttgggatcggcgacgccgttgacgtgtccgttacgtccgttcggacgtcgtcgggacctaacgggtccacccggtccgttacggtcacggcccgaacggacccaaccccgtacg

SEQ ID NO: 163802 - DNA, 546 bp, Homo sapiens
  misc_feature: GYAE6OF02G2JAV.47.55.E11.1.454.CMB.1.raw
  modified_base (202)..(202): a, c, t, g, unknown or other
  misc_feature (202)..(202): n is a, c, g, or t
  modified_base (230)..(230): a, c, t, g, unknown or other
  misc_feature (230)..(230): n is a, c, g, or t
  modified_base (366)..(366): a, c, t, g, unknown or other
  misc_feature (366)..(366): n is a, c, g, or t
tcagagctcacgtacacgaccggtgctcgatttagcactcgcacgttgggtttggggagctgtggtagagaagacaggattcaggacaatctccagcatggccggcttccctctcctcctcaccctcctcactcactgtgcagggtcttgggcccagtctgtgctgactcagcccaccctcagcgtctcgggacccccgggnagacggtcaccatctcttgttctggaancagctccaatatcggaaatgataatgtatactggtaccagcaagtcccacgaacggcccccaaactcctcatctaataacaatgatcagccgccctcgacgggtccctggccgattctctggcctcaagtctggcncctcacgcccaccctggccatcaggtcgggcctccgggcccgaggatggacggctgtattacttacgtgttgtagggttggactcgcgtagcctgacctgctttacgcttcggagcgtcgggacctaggtccaccgtctaggtccacgacccaacggacccaaccccacgtcgtctaccg

SEQ ID NO: 163803 - DNA, 556 bp, Homo sapiens
  misc_feature: GYAE6OF02JYEBQ.47.55.E11.1.454.CMB.1.raw
  modified_base (292)..(292): a, c, t, g, unknown or other
  misc_feature (292)..(292): n is a, c, g, or t
  modified_base (535)..(535): a, c, t, g, unknown or other
  misc_feature (535)..(535): n is a, c, g, or t
  modified_base (538)..(539): a, c, t, g, unknown or other
  misc_feature (538)..(539): n is a, c, g, or t
  modified_base (543)..(543): a, c, t, g, unknown or other
  misc_feature (543)..(543): n is a, c, g, or t
  modified_base (545)..(546): a, c, t, g, unknown or other
  misc_feature (545)..(546): n is a, c, g, or t
  modified_base (548)..(548): a, c, t, g, unknown or other
  misc_feature (548)..(548): n is a, c, g, or t
  modified_base (550)..(552): a, c, t, g, unknown or other
  misc_feature (550)..(552): n is a, c, g, or t
  modified_base (554)..(556): a, c, t, g, unknown or other
  misc_feature (554)..(556): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagttcagtaccttctggatgcactggggtccnccaaactccgaggtaacgggccagggaacctggtcagcgtctcctcacgcctccacgaacggcccagtcggtccttccccgtggccgccctgcctccgaggcgccaccctccggagacgccacacggccggcccgtgggcctggcccgtggtaccgaacggtccttaaccgttcccgtaacggtcgacgtcctcgtacggacggcggggtctgggccgaacgggtccgacctagtacggctcncgnngcgngnngncnnncnnn

SEQ ID NO: 163804 - DNA, 583 bp, Homo sapiens
  misc_feature: GYAE6OF02H6NJ4.47.55.E11.1.454.CMB.1.raw
  modified_base (293)..(293): a, c, t, g, unknown or other
  misc_feature (293)..(293): n is a, c, g, or t
  modified_base (359)..(359): a, c, t, g, unknown or other
  misc_feature (359)..(359): n is a, c, g, or t
  modified_base (404)..(404): a, c, t, g, unknown or other
  misc_feature (404)..(404): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctgggggagtccctgagactctcctgtgtagtctctggaatcagtttcagtaccttctggatgcactgggtccncaactccaggtaaggggctggtgtgggtctcacgtatcaatcctgatggcagttgttataaattanggcggactcgtgaggggccagttcagcatctcagagaacaacggnagaagtatactgtatctaggaaatgaaacaatcgtagaagtagtacgaacgtaacgtaacgggccttaggtacctaattcgtattttggttttaccgattcgggtaccctttccggggttacccgccggggttacctttcggtccgggggacccacgggggttaacccctgggtacccg

SEQ ID NO: 163805 - DNA, 196 bp, Homo sapiens
  misc_feature: GYAE6OF02GMD21.47.55.E11.1.454.CMB.1.raw
  modified_base (177)..(196): a, c, t, g, unknown or other
  misc_feature (177)..(196): n is a, c, g, or t
tcagagctcacgtacacgaccggtgctcgatttagcactcgcacgttgggtttgggggaagaggaagactgacggccctgctccaggagcacctccgagagcacagcggccctgggcctgcctggtcaaggactacttcctacgtgagctctgagcgggctgggcaaggcgcatagnnnnnnnnnnnnnnnnnnnn

SEQ ID NO: 163806 - DNA, 553 bp, Homo sapiens
  misc_feature: GYAE6OF02IK7B9.47.55.E11.1.454.CMB.1.raw
  modified_base (352)..(352): a, c, t, g, unknown or other
  misc_feature (352)..(352): n is a, c, g, or t
  modified_base (417)..(417): a, c, t, g, unknown or other
  misc_feature (417)..(417): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggtttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcacgtgggtccgaccaaactccgaggtaagggcgtggtgtgggtctcacgtatcaatcctgatggcagtntttaataattatgcgtactccggtggacgggccgtattcgagcatcctacgagacgacgaacggnaagatatactgtatcgtaggaaatgaaacatcgtagaagtacgtacgaacgtagtacggtctagttactatctatttgtttgtttcgagttcgtccgttcggtccggcggtcttcggcgggactacgggaccctgg

SEQ ID NO: 163807 - DNA, 570 bp, Homo sapiens
  misc_feature: GYAE6OF02GVO1V.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtatctggaatcagtttcagtaccttctggatgcactgggtccgccaaactccaggtaaggggctggtgtgggtctcgacgtatcaatcctgatggcagtgttataaattatgcgactcgtggagggccgattcagcatctaccgagacgaacgaacggcaaggagtatactgtatcgtaggaaatgaaacaatctagaagagtacgacgagtacgctagtactatctatttggttacgttttcgattcggtcccgtttccgggtacccggtcgggttacctttcgggtcgggggtaccctacgggggtaaccccttcgggg

SEQ ID NO: 163808 - DNA, 615 bp, Homo sapiens
  misc_feature: GYAE6OF02IXOOV.47.55.E11.1.454.CMB.1.raw
  modified_base (299)..(299): a, c, t, g, unknown or other
  misc_feature (299)..(299): n is a, c, g, or t
  modified_base (387)..(387): a, c, t, g, unknown or other
  misc_feature (387)..(387): n is a, c, g, or t
tcagagctcacgtacacgaccggtgctcgatttagcactcgcacgttgggtttgggggaagaggaagactgacggtcctgccacaggtggtgctgggcacggtgggcactcgacacaacatttgcgctcaactgtcttgctcaccatggagtctgggctgagctgggttttccttgttgctcttttaaaaggtgtccagtgtgaggtgcaggtagtggagtccgggggaggcttagttcagccgtggggagtccctgagactctcctgtgtagtctctggaatcagtttcagtaccttntggatgcactgggtccaccaaactccaggtaaggggctgggtgtggtctcgaacgtatcaatcctgatggcagttgttaataaaattntggccggtacttccggtagacggggccctaagttcgacgcgtaattcctaccgagaacgaacaacgggacaaaggacgttaatacgtggttaactcgtaagggtaaatagaaacctaagtctaggaacgtaagtacgaacgtactaacgggtcttacggttactacgttactagtttcgttaggttttcgactttcgtacccgtttaccgggtcccggtcggtaaccg

SEQ ID NO: 163809 - DNA, 582 bp, Homo sapiens
  misc_feature: GYAE6OF02J2YA6.47.55.E11.1.454.CMB.1.raw
  modified_base (205)..(205): a, c, t, g, unknown or other
  misc_feature (205)..(205): n is a, c, g, or t
  modified_base (233)..(233): a, c, t, g, unknown or other
  misc_feature (233)..(233): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccggnagacggtcaccatctcttgttctggaancagctccaatatcggaaatgataatgtatactggtaccagcaagtccccacgaaccggcccccaaatcctcatctaataacaatgatcagccggcccctcgacggggtccctggcccgatttcctcgtcggcctccaaagtcgtcgggaccgcctacgacgcccacccgtggcccactcgacggtcgggcctcccgggcccgaggactggaggctggtaattacttacgtgtggttaggttggactcgcgagtccgtagactgccttacgtcgttcggacgtccggtgggacctaacggtccacccgtccgtaaggtccacggtacccaacggcccctaaccccgtacg

SEQ ID NO: 163810 - DNA, 533 bp, Homo sapiens
  misc_feature: GYAE6OF02FWLBS.47.55.E11.1.454.CMB.1.raw
  modified_base (380)..(380): a, c, t, g, unknown or other
  misc_feature (380)..(380): n is a, c, g, or t
tcagagctcacgtacacgaccggtgctcgatttagcactcgcacgttgggtttgggggaagaggaagactgacggtcctgccacaggtggtgctgggcacggtgggcactcgacacaacatttgcgctcaactgtcttgctcaccatggagtctgggctgagctgggttttccttgttgctcttttaaaaggtgtccagtgtgaggtgcaggtagtggagtccgggggagcttagttcagcctggggagtccctgagactctcctgtgtagtctctggaatcagtttcagtaccttctggatgcactgggtccgccaaactccagggtaaggggctggtgtggtctcacgtatcaatcctgatggcagtgttataaattngcggactcgtgagggcgattcagcatctccagacgacgaacggcaagagtatactgtatctaggaaatagaacaatctagagagtcgaacgagttacggctgtctatctagtttgttgtttcagttcgtccgtttccgggtccgtcgggtacc

SEQ ID NO: 163811 - DNA, 527 bp, Homo sapiens
  misc_feature: GYAE6OF02FUQ90.47.55.E11.1.454.CMB.1.raw
  modified_base (205)..(205): a, c, t, g, unknown or other
  misc_feature (205)..(205): n is a, c, g, or t
  modified_base (341)..(341): a, c, t, g, unknown or other
  misc_feature (341)..(341): n is a, c, g, or t
  modified_base (476)..(476): a, c, t, g, unknown or other
  misc_feature (476)..(476): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccggnagacggtcaccatctcttgttctggaagcagctccaatatcggaaatgataatgtatactggtaccagcaagtccccagaaccggcccccaaactcctcatctataacaatgatcagcggccctcgaggggtcccnggccgattctctggctccaagtctggcgcctcacgcccaccctggcccatccgaggtcgggcctcccgggcccgaggatggaggctgattatactgtgtaggttggatcgcagcctgactgcttacgtcttcggngcgtgggacctaaggtccaccgtctaggtcacgcccaacggcccaccctcg

SEQ ID NO: 163812 - DNA, 608 bp, Homo sapiens
  misc_feature: GYAE6OF02H7JYP.47.55.E11.1.454.CMB.1.raw
  modified_base (209)..(209): a, c, t, g, unknown or other
  misc_feature (209)..(209): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagcccaccctcagcgtctcggggacccccgggnagacggtcaccatctcttgttctggaagcagctccaatatcggaatgataatgtatactggtacagcaacgtcccaacgaacggcccccaaaactcctcatctataacaatgatcagcggccctcgacgggtcctggccgtattctctggctcaagtctgcgcctcgacgcccaccgtcggaccactcgaggtcgggccgtccgggcccggaaggatagacggcttagatttattacgtggtaggttagggttagggatcgcacgccgttagacgttggacgtttacggtcctttacgggacgtcggtcgggtaacccgaagggttcccgtaacccggttccgttacgggtaccgaacggtaccccccggaaggtacccccctaaaccccgtaacccgg

SEQ ID NO: 163813 - DNA, 520 bp, Homo sapiens
  misc_feature: GYAE6OF02G2H2J.47.55.E11.1.454.CMB.1.raw
  modified_base (357)..(357): a, c, t, g, unknown or other
  misc_feature (357)..(357): n is a, c, g, or t
  modified_base (432)..(432): a, c, t, g, unknown or other
  misc_feature (432)..(432): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgtataaattntgcgtactcgtgaggggcattcagcatctcagagacacggcaagacgtatactgtatctaggaaatgaaacaatntagagagtacgagatacggctgtctatctattgtgtttcgattcgcgttccggtcgcgggtattccgtgggccgtagggaccctcggg

SEQ ID NO: 163814 - DNA, 525 bp, Homo sapiens
  misc_feature: GYAE6OF02F3ECL.47.55.E11.1.454.CMB.1.raw
  modified_base (207)..(207): a, c, t, g, unknown or other
  misc_feature (207)..(207): n is a, c, g, or t
  modified_base (442)..(442): a, c, t, g, unknown or other
  misc_feature (442)..(442): n is a, c, g, or t
tcagagctcacgtacacgaccggtgctcgatttagcactcgcacgttgggtttggggcagcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggnagacggtcaccatctcttgtctggaagcagctccaatatcggaaatgataatgtatactggtaccagcaagtcccacgaacggcccccaaactcctcatctataacaatgatcagcggccctcacggggtccctggcccattctctggctccaagtctggcgcctcagccaccctggccatcaggtgggcctccggccgaggatgaggctgattatactgtgtaggttggatcgnagctgactgcttacgtcttcggacgtcgtgggaccaaggttccaccgttccgtaggtccacggccccaaggccctaacccccg

SEQ ID NO: 163815 - DNA, 521 bp, Homo sapiens
  misc_feature: GYAE6OF02FJP8Q.47.55.E11.1.454.CMB.1.raw
  modified_base (356)..(356): a, c, t, g, unknown or other
  misc_feature (356)..(356): n is a, c, g, or t
  modified_base (406)..(406): a, c, t, g, unknown or other
  misc_feature (406)..(406): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggtttccttgttgctcttttaaaaggtgtccagtgtgaggtgcaggtagtggagtccgggggaggcttagttcagccctggggagtccctgagactctcctgtgtagtctctggaatcagtttcagtacctctggatgcactgggtccccaaactccagtaagggctggtgtgggtctcacgtatcaatcctgatggcagtgttaataaattangcggactcgtgaggggccattcagcatctcagagacaacggcaagagtanactgtatctaggaaatgaaacaatctagagtagtacgaacgatacggctgtctatctattgtgtttcgatcgtccttcggtccgcgggacttcggcggggccagggaccctcggg

SEQ ID NO: 163816 - DNA, 562 bp, Homo sapiens
  misc_feature: GYAE6OF02J1WXV.47.55.E11.1.454.CMB.1.raw
  modified_base (277)..(277): a, c, t, g, unknown or other
  misc_feature (277)..(277): n is a, c, g, or t
  modified_base (349)..(349): a, c, t, g, unknown or other
  misc_feature (349)..(349): n is a, c, g, or t
  modified_base (358)..(358): a, c, t, g, unknown or other
  misc_feature (358)..(358): n is a, c, g, or t
tcagagctcacgtacacgaccggtgctcgatttagcactcgcacgttgggtttggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagccgtggggagtccctgagactctcctgtgtagtctctggaatcagtttcagtaccttntggatgcacgtgggtccgaccaaactccgaggtaagggctgggtgtgggtctcgacgtatcgaatctgtacnggtcaggtnttaataaattgtgcggtactcgtggaggggcctattcgagctatctacaggtacgacgaacggacaagagtatacgttgtatcgtagaatagaacaatactagagtagtacggacgtaagtacgagtagtctatatacttagtgttttacgagttcgtccgttcggtccgtacggtcttcggtcgggtaccgtaggtaacccgg

SEQ ID NO: 163817 - DNA, 570 bp, Homo sapiens
  misc_feature: GYAE6OF02JBH9V.47.55.E11.1.454.CMB.1.raw
  modified_base (364)..(364): a, c, t, g, unknown or other
  misc_feature (364)..(364): n is a, c, g, or t
  modified_base (412)..(412): a, c, t, g, unknown or other
  misc_feature (412)..(412): n is a, c, g, or t
  modified_base (544)..(544): a, c, t, g, unknown or other
  misc_feature (544)..(544): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttcctgttgctcttttaaaaggtgtccagtgtgaggtgcaggtagtggagtccgggggaggcttagttcagcctggggagtccctgagactctcctgtgtagtctctggaatcagtttcagtaccttctggatgcacgtgggtccgccaaactccgaggtaaggggctgggtgtcgggtctcgacgtatcaatccgtgatggcagtagttataaattntgtgacgtcgtggacggggctattcgagcatcctcagagacgaacggnaagagtatacgtagtatcgtaggaactgaactatcgtagagtagtacgaagtacgtaccgcgtagttactattacgtagtttcggttgttttcgattcggtcctttccgggtccgacgggttacgttccggnggggtcccgtacgggtaccctcgggg

SEQ ID NO: 163818 - DNA, 125 bp, Homo sapiens
  misc_feature: GYAE6OF02FW5V4.47.55.E11.1.454.CMB.1.raw
  modified_base (105)..(105): a, c, t, g, unknown or other
  misc_feature (105)..(105): n is a, c, g, or t
tcagagctcacgtacacgaccggtgctcgatttagcactcgcacgttgggtttgggtgccgaagttgctgcctggtcaaggactacttcctacgtgagctctgancgggctggcaaggcgcatag

SEQ ID NO: 163819 - DNA, 563 bp, Homo sapiens
  misc_feature: GYAE6OF02JYKO6.47.55.E11.1.454.CMB.1.raw
  modified_base (323)..(323): a, c, t, g, unknown or other
  misc_feature (323)..(323): n is a, c, g, or t
  modified_base (558)..(558): a, c, t, g, unknown or other
  misc_feature (558)..(558): n is a, c, g, or t
tcagagctcacgtacacgaccggtgctcgatttagcactcgcacgttgggtttgggggtagggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgagggccgattcagcatctccagagacaacggcaaagagtatactgtatctggaaatgaacaatctgagagtcgacgatacggctgtctatcattgtnttttcgatgccttcggtccgcggacttcgtggggccagggaaccctggtcagcgtctcctcacgcctccacacggcccatcggtcttcccctggccgccctcgcgtccagtacgcaccctcgacgacgcacgacgccggcccgtcgggccgtcgacctcgggtacgtaacggaccttaccgttccctacggtcgtacgcgtccgtgacggtcgggctacgggcgtaacgggccgngtacg

SEQ ID NO: 163820 - DNA, 513 bp, Homo sapiens
  misc_feature: GYAE6OF02G6PMF.47.55.E11.1.454.CMB.1.raw
  modified_base (199)..(199): a, c, t, g, unknown or other
  misc_feature (199)..(199): n is a, c, g, or t
  modified_base (322)..(322): a, c, t, g, unknown or other
  misc_feature (322)..(322): n is a, c, g, or t
tcagagctcacgtacacgaccggtgctcgatttagcactcgcacgttgggtttggggagctgtggtagagaagacaggattcaggacaatctccagcatggccggcttccctctcctcctcaccctcctcactcactgtgcagggtcttgggcccagtctgtgctgactcagccaccctcagcgtctgggacccccggnagacggtcaccatctcttgttctggaagcagctccaatatcggaaatgataatgtatactggtaccagcaagtcccacgaacggcccccaaactcctcatctataacaatgatcagcgccctnagggtccctggccgattctctggctccaagtctggcgcctcagccaccctggccatcagtgggctccggcccgaggatgagctgattattactgtgtaggttggatcgcagcctgctgcttacgtcttcggagcgtgggaccaggtcaccgtctaggtcaggcccaaggcccaaccccactcgtcctaccg

SEQ ID NO: 163821 - DNA, 595 bp, Homo sapiens
  misc_feature: GYAE6OF02GVMRS.47.55.E11.1.454.CMB.1.raw
  modified_base (291)..(291): a, c, t, g, unknown or other
  misc_feature (291)..(291): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggagcttagttcagcctggggagtccctgagactctcctgtgtagtctctggaatcagtttcagtaccttctggatgcactgggtccnccaaactccgaggtagggctggtgtggtctcacgtatcaatcctgatggctagttgttaataaatttatggcggactccggtggacggggccgtattcagcatcctccagacgaacaacgggacaaagagtactacgttgtaactcgtaaggaaatacgaaactaattcgtaggaagtagtacgaacgtatacgggtcttgtaccttatacttagtttggtttggttttcgagtttcgtcccgtttcgggtcccggtacggggttacctttcgggacggggtaccgtacgggtaccccttcggg

SEQ ID NO: 163822 - DNA, 640 bp, Homo sapiens
  misc_feature: GYAE6OF02JR2U1.47.55.E11.1.454.CMB.1.raw
tcagagctcacgtacacgaccggtgctcgatttagcactcgcacgttgggtttgggggccggcagccctgggattcccaactgtttctgcttgctgatcaggactgcacacagagagctcaccatggagtctgggctgagctgggttttccttgttgcttcttttaaaggtgtccagtgtgaggtgcaggtagtggaggtccgggggaggcttagtcagccgtggggatccctgagactctcctgtgtagtctcgtggaattctagttttcacgttaccttcgtggatgactacgttcggggtcccaccaaacgtccgaaggggtaaggggcttgggtggtacgggtctacgaagtattgagtgacggtaagtgggtaggaacgctactagttcgtacggtggaaccttccggtagggaacgggtccgttcaccgatcctacgagacgtactaagttcgaggtagcgacgtctgtatactaactaaagtacgaacgtagtactaggacgacgaccggaacggacgaccgggtaccttaagttacgtttacgtagtaggaacttaaggtcttaagtacgactacggtacccgtcccccgtaggacccgttctaccgttttcgttacgttacgtcgtcgggg

SEQ ID NO: 163823 - DNA, 584 bp, Homo sapiens
  misc_feature: GYAE6OF02F9CPT.47.55.E11.1.454.CMB.1.raw
  modified_base (358)..(358): a, c, t, g, unknown or other
  misc_feature (358)..(358): n is a, c, g, or t
  modified_base (450)..(450): a, c, t, g, unknown or other
  misc_feature (450)..(450): n is a, c, g, or t
tcagagctcacgtacacgaccggtgctcgatttagcactcgcacgttgggtttgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatctattgttgttttcgatcgtccttcgggtccgcgggtacttcgngggccagggaccctggtcagtcgtctcctcacgccctccaccgaacgggcccagtccggtccttccccgtggccgccctgcctccgaggacnccaccctccgagacgcacgacgccggcccgtgggcctcggccgtcggtaccaacgggtacccttaccgtttacccgtacggtcggacgtcctccgtggacggccggggcgtgggaccgtaacgggccgacgtag

SEQ ID NO: 163824 - DNA, 710 bp, Homo sapiens
  misc_feature: GYAE6OF02IXRW9.47.55.E11.1.454.CMB.1.raw
  modified_base (178)..(178): a, c, t, g, unknown or other
  misc_feature (178)..(178): n is a, c, g, or t
  modified_base (199)..(199): a, c, t, g, unknown or other
  misc_feature (199)..(199): n is a, c, g, or t
  modified_base (222)..(222): a, c, t, g, unknown or other
  misc_feature (222)..(222): n is a, c, g, or t
  modified_base (239)..(239): a, c, t, g, unknown or other
  misc_feature (239)..(239): n is a, c, g, or t
tcagagctcacgtacacgaccggtgctcgatttagcactcgcacgttgggttggggagcgtgtggtagagaagacaggattcaggacaatctccagcatggccggcttcctctcctccgtcaccctcctcactcactgtgcaggtctcggcccagtctgtgctgactcagccaccctnagccgtctcgggacccccggnagacggtcaccatctcttgttcnggaagcagctacaaatnacggaaatgaataatgtaatactggtaaccagactaagtacccacgaaccgccccaaaagtcctacatacctaataaacaactgactacacgccggccctagaccgggtcctagggccgtaattcctcgtcggacctaccgtaagtccgtggaccgtcccttacgaacggccctaccgtcgtacccataccgaaggttccgggacccgttccccgggacccggaacggtacgtacggtaacggtccgtagttaacgttaacgtttacgtaggtacggttagggttacggtactcgacgtaacggtccctagtaacccgtggttaaccctttacggttccgttaccggggagtacccgtacggggtaacccgtaacgggttccgaaccccggtttaccgtaacggtacccaaacgggtaccccgaaacgggtaccccccaaaccccgtttcgtaccggtacccttaacccgg

SEQ ID NO: 163825 - DNA, 355 bp, Homo sapiens
  misc_feature: GYAE6OF02HK5S9.47.55.E11.1.454.CMB.1.raw
  modified_base (351)..(355): a, c, t, g, unknown or other
  misc_feature (351)..(355): n is a, c, g, or t
tcagagctcacgtacacgaccggtgctcgatttagcactcgcacgttgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccagccctccaccaagggcccatcggtccttcccctggccgccctgcctccaggacgccacctccgagagcacagcggccctgggctgcctggtcaaggactacttcctacgtgagctcgtgacgcgggctggcaaggcgcatagnnnnn

SEQ ID NO: 163826 - DNA, 559 bp, Homo sapiens
  misc_feature: GYAE6OF02HGAAZ.47.55.E11.1.454.CMB.1.raw
  modified_base (292)..(292): a, c, t, g, unknown or other
  misc_feature (292)..(292): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggagcttagttcagcctggggagtccctgagactctcctgtgtagtctctggaatcagtttcagtaccttctggatgcactgggtcccnccaaactcccgaggtaacggggctagggtgtgggtctcgacgtatcaatcctgatggcagtgttataaattatgcggtactcgtggaggggccgattcagcatctccagagacaacggcaagagtatactgtatcgtaggaaatagaaactaatctaggaagtagtacgagtatacggctagtctatctattgttgttttcgattcgtcccgtttcggtccggtcggtacgtttcggtacgggggtcccacgggtaaccccttcggg

SEQ ID NO: 163827 - DNA, 547 bp, Homo sapiens
  misc_feature: GYAE6OF02HE6ON.47.55.E11.1.454.CMB.1.raw
  modified_base (531)..(532): a, c, t, g, unknown or other
  misc_feature (531)..(532): n is a, c, g, or t
  modified_base (534)..(547): a, c, t, g, unknown or other
  misc_feature (534)..(547): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctgggggatccctgagactctcctgtgtagtctctggaatcagtttcagtaccttctggatgcacgtgggtcccgccaaactccgaaggtaagggccagggaaccctggcagcgtctcctcacgcctccaccaacgggcccagtccggtccttcccccgtggccgccctgcctccgaggacgccacccgtccgagacgcaccgacggccggcccgtgggcctcggccctgggtaccaaaggtaccctacttccgtatcgtaactactcgtagacgggccggtcgtcgggaccgaacgggcacgaagtgacgnngnnnnnnnnnnnnnn

SEQ ID NO: 163828 - DNA, 544 bp, Homo sapiens
  misc_feature: GYAE6OF02GG8PK.47.55.E11.1.454.CMB.1.raw
  modified_base (191)..(191): a, c, t, g, unknown or other
  misc_feature (191)..(191): n is a, c, g, or t
  modified_base (353)..(353): a, c, t, g, unknown or other
  misc_feature (353)..(353): n is a, c, g, or t
tcagagctcacgtacacgaccggtgctcgatttagcactcgcacgttggttttggggagagaagacaggattcaggacaatctccagcatggccggcttccctctcctcctcaccctcctcactcactgtgcagggtcttgggcccagtctgtgctgactcagccaccctcagcgtctgggacccccgggnagacggtcaccatctcttgttctggaagcagctcaatatcggaaatgataatgtatactggtaccagcaagtcccacgaacggcccccaaactcctcatctataacaatgatcagcggccctgacggggtccctggccgattctctggctccaagtctggcncctcacgccaccctggccatcagtgggcctccggcccgaggactggacggctgattacttactgtgttaggttgggatcgcagcctgactgtcttacgtcttcggagtcgtggacctaaggtccaccggtaccgtaggtccacggccccaaggcccaaccccgcttcgccactcctccgttccccgtcccc

SEQ ID NO: 163829 - DNA, 555 bp, Homo sapiens
  misc_feature: GYAE6OF02GS47J.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctgggggagtccctgagactctcctgtgtagtctctggaatcagtttcagtaccttctggatgcactgggtccgccaaactccgaggtaagggctggtgtgggtctcacgtatcaatcctgatggcagtgttaataaattatgcgactccgtgaggggccgattcagcatctccagagacgaacggcaagagtatactgtatctagaaatgaacaatctagaagacgtacgaacgagtacggctgtactatctagtttgttggtttcgattcggtcccgtttcgggttccgttagggtcctttcggtcggggtacccgtacgggtacccgttcggg

SEQ ID NO: 163830 - DNA, 720 bp, Homo sapiens
  misc_feature: GYAE6OF02GA8FN.47.55.E11.1.454.CMB.1.raw
tcagagctcacgtacacgaccggtgctcgatttagcactcgcacgttgggtttggggagcttcagctgtggtagagaagacaggattcaggacaatctccagcatggccggcttccctctcctcctccaccctcctcactcactgtgcagggtcttgggcccagtctgtgctgactcagcccaccctcagcgtctcgggacccccgggcagacggtcaccatctcttgttctggaagcagctaccaatactacggaaatgaataatgtaatactggtaccagacaacgtccccaacggaacccgacccccaaactccctacactactaataacaatgaactcagccgccctgacggggtcctggccgtattctctggcctaccgtaagtcgtcggcccgtcctcgaccgccctacccgtcggaccctacgtcgacgggtccggggcccgttaccccggggacccggagggtacgtcgggtaacgggtcttaggttaactttacgttacgttgggttagggttaggggtttcggggaactccgggtaccgaacggtcccgttacggtaaccgttcggttacccgtttacggttaccgtttaccggggtacggtccgggttaacgggggaaaccctaacggggttacccgtaacccggtttacccggttacgggtacccgaaccggacccccgaaccgggtaccccccaaacccccgtccgg

SEQ ID NO: 163831 - DNA, 747 bp, Homo sapiens
  misc_feature: GYAE6OF02HBT72.47.55.E11.1.454.CMB.1.raw
  modified_base (178)..(178): a, c, t, g, unknown or other
  misc_feature (178)..(178): n is a, c, g, or t
  modified_base (201)..(201): a, c, t, g, unknown or other
  misc_feature (201)..(201): n is a, c, g, or t
tcagagctcacgtacacgaccggtgctcgatttagcactcgcacgtttggggttttgggggaggtagaagacaggaggttccaggacaatctccagcatggccgcttcctctcctccttcaccctctcactcactgtgcagggtcttcggcccagtcaggtgctgactcagccacctnagcgttcgtcgggacccccggtnaggtacggtcaccattcctcttgttctaggaacgcgacggtcctaccaatattaccggaaatgaataatgtaactacgtacggtaccagactaaacgtacccaacgaacccggaacccccaaatccctacactacgtaactaacaatagaactcgaagccgtaccgtcgacgggtaccctaggtaccgtattccgtacgtcggacctaccgtaacgtccgtcggtcctccgtacacggccgtacccgtcggaccctagtccgacggttccggtccgtcccggaccggacggtaccgtacgggaaccggtccttaggtacgtttaccgtttacgtcggttacggttacggttcggactccggtacgacgtccctaggtaccgtaccggttacgttaccgtaccgttcggaccgttccggtacgggtaaccctacgggtcccgtaccggttacgtaaccggtacctaaccggaccccgtaaccggaaccccgaccccgtaggttacccggtacctacccggtccggttccccgttccccggtaccccg

SEQ ID NO: 163832 - DNA, 559 bp, Homo sapiens
  misc_feature: GYAE6OF02HTO2Z.47.55.E11.1.454.CMB.1.raw
  modified_base (543)..(545): a, c, t, g, unknown or other
  misc_feature (543)..(545): n is a, c, g, or t
  modified_base (547)..(559): a, c, t, g, unknown or other
  misc_feature (547)..(559): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggaggtccgggggaggcttagttcagccgtggggagtccctgagactctcctgtgtagtctctggaatctagtttcagttaccttctggtatgcacgtcgggtcccgacctaaacctccgaagggtaacggggccgaacggggaaccctggtacgagccgtctcctcacgcctaccaccgaacggcccacgtccggtcccttccccgtcggccgtcccgtcgcctccgacggacgccacccgtccgacgacgccacgcggccggccgtgggctcgccgtggtaccaacggtacctacttccgtacgtcgacgctcgagacggcgggctgggactaacgggcacgagtagnnngnnnnnnnnnnnnn

SEQ ID NO: 163833 - DNA, 599 bp, Homo sapiens
  misc_feature: GYAE6OF02GR0H2.47.55.E11.1.454.CMB.1.raw
  modified_base (207)..(207): a, c, t, g, unknown or other
  misc_feature (207)..(207): n is a, c, g, or t
  modified_base (304)..(304): a, c, t, g, unknown or other
  misc_feature (304)..(304): n is a, c, g, or t
  modified_base (350)..(350): a, c, t, g, unknown or other
  misc_feature (350)..(350): n is a, c, g, or t
  modified_base (369)..(369): a, c, t, g, unknown or other
  misc_feature (369)..(369): n is a, c, g, or t
tcagagctcacgtacacgaccggtgctcgatttagcactcgcacgttgggtttggggagcttcagctgtggtatagaagacaggattcaggacaatctccagcatggccggcttccctctcctcctcaccctcctcactcactgtgcagggtcttgggcccagtctgtgctgactcagcccaccctcagcgtctgggacccccgggnagacggtcaccatctcttgttctggaagcagctccaatatcggaaatgataatgtatactggtaccagcaagtcccacgaaccggccccaaactccncatctataacatgatcagccgcctcgaggggtccctggccatttcnctggctccaagtctggccncctcacgcccaccctggccatcaggtcgggcctccgggccgaggactggacggtctgtatttattacgtggttaggttagggttgggacttccggctacggtcctaggtaccgttgtaccgttacgtcgttacgggacgtccggtacggggaaccgtaagggtccctaacccggttccgttaacgggtccaacgggtaccccgaaacggtacccccgaaacccccgtacg

SEQ ID NO: 163834 - DNA, 562 bp, Homo sapiens
  misc_feature: GYAE6OF02IVF5U.47.55.E11.1.454.CMB.1.raw
  modified_base (536)..(536): a, c, t, g, unknown or other
  misc_feature (536)..(536): n is a, c, g, or t
  modified_base (555)..(555): a, c, t, g, unknown or other
  misc_feature (555)..(555): n is a, c, g, or t
tcagagctcacgtacacgaccggtgctcgatttagcactcgcacgttgggtttggggggaagaggaagactgacggtcctgccacaggtggtgctgggcacggtgggcactcgacacaacatttgcgctcaactgtcttgctcaccatggagtctgggctgagctgggttttccttgttgctcttttaaaaggtgtccagtgtgaggtgcaggtagtggagtccgggggaggcttagttcagccgtggggagtccctgagactctcctgtgtagtctctggaatcagtttcagttaccttctggatgcacgtgggtccgccaaactccgagggtaaggggctgggtgtgggtctcacgtatcaatcctgatggcagtgttaataaattagtgcggtactccggtggacggggccgtattcgagtcatcctaccgagacgacgaacggacaaggagttatactgtatcgtaggaaatgaaactaagtcgtagagagtacgacgagtacgcttagtctatcgtatttgttgtttacgnttcgtccgttcggtccggnggtaccg

SEQ ID NO: 163835 - DNA, 126 bp, Homo sapiens; identical to SEQ ID NO: 163319
  misc_feature: GYAE6OF02F41DP.47.55.E11.1.454.CMB.1.raw
  modified_base (126)..(126): a, c, t, g, unknown or other
  misc_feature (126)..(126): n is a, c, g, or t

SEQ ID NO: 163836 - DNA, 728 bp, Homo sapiens
  misc_feature: GYAE6OF02IR12R.47.55.E11.1.454.CMB.1.raw
  modified_base (205)..(205): a, c, t, g, unknown or other
  misc_feature (205)..(205): n is a, c, g, or t
  modified_base (216)..(216): a, c, t, g, unknown or other
  misc_feature (216)..(216): n is a, c, g, or t
  modified_base (226)..(226): a, c, t, g, unknown or other
  misc_feature (226)..(226): n is a, c, g, or t
  modified_base (230)..(230): a, c, t, g, unknown or other
  misc_feature (230)..(230): n is a, c, g, or t
  modified_base (295)..(295): a, c, t, g, unknown or other
  misc_feature (295)..(295): n is a, c, g, or t
  modified_base (302)..(302): a, c, t, g, unknown or other
  misc_feature (302)..(302): n is a, c, g, or t
tcagagctcacgtacacgaccggtgctcgatttagcactcgcacgttgggtttggggcagcttcagctgtggtagagaagacaggattcaggacaatctccagcatggccggcttccctctcctcctcaccctcctcactcactgtgcagggtcttgggcccagtctgtgctgactcagccacctcagcgtctgggacccccggnagacgtcaccntctcttgtcnggancagctcaatatcggaatgataatgtatactggtaccagcaagtcccacgaacggccccaaatccncatctanaacaatgatcagcgccctcacgggggtccctgggacccgtattccgttcgtgggtcctacctaaacgtcgtcggccgtaccctcgacgcccctaccccgtggacccaattccgaacgggttcgggccgttccccggggacccgtaagggacgttcggaacgggtccttagggtaaccgttttaatttaaccggtggtttacgggttaacggggtttaggggtaacttccgggtaccgtaacggttccccgttaaggtaccgttacgtaccgttttaacccggtttccggtttaccgggtacgggttaccgggttacccgggtaaaccggtaaacccggggttcccgttaaccccgggtttaccggttaaccgggtacccgtaaccggaacccccgggtaaaccgggtacccccctaaaccccccgg

SEQ ID NO: 163837 - DNA, 695 bp, Homo sapiens
  misc_feature: GYAE6OF02J1ARW.47.55.E11.1.454.CMB.1.raw
  modified_base (539)..(539): a, c, t, g, unknown or other
  misc_feature (539)..(539): n is a, c, g, or t
tcagagctcacgtacacgaccggtgctcgatttagcactcgcacgttagggttggggccgcagccctgggatcccagctgttctgctgctgatcaggactgcacacagacgagcctcgaccactggagtcctgggctcgagcgtgggtttccttgttcgctacgtttaaaggtcgtccagtgtcgaggtgcaggtagtggagtccggggagcttagtcagcctgggatccctgacgactctccgtgtgtagtctctggaatcgagtttcacgtaccttcgtggatcggacctagtcgggtacccgtaccgtaaacgtcccgaagggttaacggggccttgggttcggtacgggtactaccgtaacgggttatacgaaaccttccgtagtagtcgggactaggtacgttaactaaaagtttgcggtaccgtaacttccggtcggtaccggggtcccgatttccgagtccgtaacgttccgtaccgtagacggtaacgaacggtcgaaggtagtaacgtacgtgtaacgtcgtagtaacgngtaactagtcgtagtacgtaggtacgacggtaacgtcggtcttacgtacgtagttcgtattcggttgtttaccggtattccggttcccgttaccgggttaccggtccgggttaaccgtccgggttaccgggaccgttaccgggtacccgttacggg

SEQ ID NO: 163838 - DNA, 503 bp, Homo sapiens
  misc_feature: GYAE6OF02G81RS.47.55.E11.1.454.CMB.1.raw
  modified_base (411)..(411): a, c, t, g, unknown or other
  misc_feature (411)..(411): n is a, c, g, or t
  modified_base (489)..(494): a, c, t, g, unknown or other
  misc_feature (489)..(494): n is a, c, g, or t
  modified_base (496)..(503): a, c, t, g, unknown or other
  misc_feature (496)..(503): n is a, c, g, or t
tcagagctcacgtacacgaccggtgctcgatttagcactcgcacgttgggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaatcctcatctataacaatgatcagcggccctcaggggtccctggccgattctctggctccaagtctggcgcctcacgccaccctggccatcagtgggcctccggcccgaggatggaggctgattatactgtgtaggttggatcgcagcctgactgtcttacgtcttcggagcgtgggaccaggtcaccgtctaggtcagcccaaggcccaacccntgtccactctcgtccccgccttcctctacgtgactctcgtgacgcgggtctcgggactaacgggccgacagtagctgnnnnnngnnnnnnnn

SEQ ID NO: 163839 - DNA, 525 bp, Homo sapiens
  misc_feature: GYAE6OF02F8P0O.47.55.E11.1.454.CMB.1.raw
  modified_base (206)..(206): a, c, t, g, unknown or other
  misc_feature (206)..(206): n is a, c, g, or t
  modified_base (447)..(447): a, c, t, g, unknown or other
  misc_feature (447)..(447): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccgggnagacggtcaccatctcttgttctggaagcagctccaatatcggaaatgataatgtatactggtaccagcaagtcccacgaaccggcccccaaactcctcatctataacaatgatcagcggcctcgacggggtccctggccgattctctggctcaagtctggcgcctcacgccaccctggccatcagtcgggctccgggcccgaggactggaggctgattattactgtgtaggttggatcgnagctgactgcttacgtcttcggagtcgtgggaccaggtccaccgtcctaggtccacgcccaacggccccaaccctacg

SEQ ID NO: 163840 - DNA, 760 bp, Homo sapiens
  misc_feature: GYAE6OF02GAV7Y.47.55.E11.1.454.CMB.1.raw
  modified_base (132)..(132): a, c, t, g, unknown or other
  misc_feature (132)..(132): n is a, c, g, or t
  modified_base (134)..(134): a, c, t, g, unknown or other
  misc_feature (134)..(134): n is a, c, g, or t
  modified_base (139)..(139): a, c, t, g, unknown or other
  misc_feature (139)..(139): n is a, c, g, or t
tcagagctcacgtacacgaccggtgctcgatttagcactcgcacgttgggtttggggccgcagccctgggattcccagctgtttctgcttgctgatcaggactgcacacagagagctcaccatggagtccgngntagcnggtttcgtttcttgtgtctttaacgtttaagtctacgtagtgtaggtaggtcgaggtaggttaggtagggtaccgggggtacggggagttacgtttacgtacgacgtccgggtagggtcccttccgtaggacgtccttcctcgtgtacgacgtccgtccttcggtcgttcctaccttaccttaactaaaatttaatttagtcgtacttagtcgacgtacggggttcccgggtacccgtacggacggtccctaccggacggaacggggtaaccgggtagtaggtaggggttcgggtacgggtccggtataagtcgttcccgtacgtaggtacgaactacgttccgtacgtaagtttacgtaccgagtaccgtacccgttcggtaggggaccgggtacttacttaccgaacttactccctacgagacgaaacttaccggtaacccgaacgtcgttactactcgtcgacctactacgacgacttccgaagaaaccgtacgtacggaaccgtaaccgtacgttccttacctaccgttaccttacggtcggtcggtaaacggaaggtaacggtttacggtaacggtaacgttacggttaacttaggttttcggacgtacgtttcgg

SEQ ID NO: 163841 - DNA, 533 bp, Homo sapiens
  misc_feature: GYAE6OF02FS8EG.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccgaggtaaggggctggtgtgggtctcacgtatcaatcctgatggcagtgttataaattatgcgactccgtgaggggccgattcagcatctcagagacaacggcaagagtatactgtatcgtagaaatgaacaatctagagagtacgacgagtacggctagtcgtatctattgtgttttcgattgtccgttcggtccggcggtacgttcgtcggggccgtacgggacccgtcgg

SEQ ID NO: 163842 - DNA, 524 bp, Homo sapiens
  misc_feature: GYAE6OF02H26N3.47.55.E11.1.454.CMB.1.raw
  modified_base (510)..(524): a, c, t, g, unknown or other
  misc_feature (510)..(524): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggccagggaaccctggtcagcgtctcctcagccctccaccaacgggcccatcggtctcccctggccgccctgcctccaggagccacctccgagacgcacgacggccggcccgtgggcctcggcccgtgggtccaacgggaccttaccgttccctacgtgacgctcgtggacggccgggctgggccaagggccgacagtagnnnnnnnnnnnnnnn

SEQ ID NO: 163843 - DNA, 750 bp, Homo sapiens
  misc_feature: GYAE6OF02G9I66.47.55.E11.1.454.CMB.1.raw
  modified_base (207)..(207): a, c, t, g, unknown or other
  misc_feature (207)..(207): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctcgggacccccgggnagacggtcaccatctcttgttctggaagcagctccaatatcggaaatgataatgtatactggtaccagcaagtcccacgaaccggcccccaaactcctcatctataacatgatcagccggccctcgacggggtccctggccgtatttccgtacgttcggcccttacccgaaaggttccttcgggcccgccccgttaccgaaccgccccgtaaccccgttcgggccccaacgttccgaacgggttcggggcccgttcccgggaccccgggtaagggtacgttcgggacgggtccgttaggtaactttaacgtttaccgttggtttacgggtttaaggggtttcggggtactttccgggacgttaaccggtcccgtttacggtaccgttacggtacccgttttaaccgggtttccgtttaccgggtaaggtcccggttaacgggggtaaaccccgtaaacgggttccccgtaaccccggtttccggttaaccgggttccaaccggtacccccgaaacgggtacccccctaaacccccgtacccgg

SEQ ID NO: 163844 - DNA, 554 bp, Homo sapiens
  misc_feature: GYAE6OF02HNW5C.47.55.E11.1.454.CMB.1.raw
  modified_base (294)..(294): a, c, t, g, unknown or other
  misc_feature (294)..(294): n is a, c, g, or t
  modified_base (362)..(362): a, c, t, g, unknown or other
  misc_feature (362)..(362): n is a, c, g, or t
  modified_base (395)..(395): a, c, t, g, unknown or other
  misc_feature (395)..(395): n is a, c, g, or t
  modified_base (408)..(408): a, c, t, g, unknown or other
  misc_feature (408)..(408): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctgggggagtccctgagactctcctgtgtagtctctggaatcagtttcagtaccttctggatgcactgggtcccnccaaactccgaggtaaggggctggtgtgggtctcacgtatcaatcctgatggcagtgttaataaattntgcggtactcgtggaggggccattcagcatccncagagacaacggnaagagtatactgtatcaggtaaatgaacaatctaggagacgtacgacgtatacggctcgtcttatctagtttgttcggttttacgattcgtccgttccggtccggtccgggtaccttcggacgggggccctacgggacccgttcgg

SEQ ID NO: 163845 - DNA, 576 bp, Homo sapiens
  misc_feature: GYAE6OF02G1Q3Z.47.55.E11.1.454.CMB.1.raw
  modified_base (328)..(328): a, c, t, g, unknown or other
  misc_feature (328)..(328): n is a, c, g, or t
  modified_base (341)..(341): a, c, t, g, unknown or other
  misc_feature (341)..(341): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagcgtggtttcgtgtagctctttaaagtgtcagtgtgaggtgcaggtagtggagtccgggggaggcttagttcagccgtggggagtccctgagactctcctgtgtagtctctggaatctagtttcagttaccttctggatgcacgtgggtaccaccaaactccgaagggtaacgggctgggtgtgggtctnacgtatcaatccngatggctagttagtaataaattatgcgtactcgtgacgggctatcagctaatctacagaacacgaacggtacaagacgtaatacgtgttaatacgtagaaatgaaactaagtctaagagacgtcgaaacgtagtacgtctgtaccttagtactagtttgttacgttagtattccggtcccgttacggtccggtacggttacgttccgggtcggggaccgtacggggaaccctggg

SEQ ID NO: 163846 - DNA, 952 bp, Homo sapiens
  misc_feature: GYAE6OF02JDDG1.47.55.E11.1.454.CMB.1.raw
  modified_base (253)..(253): a, c, t, g, unknown or other
  misc_feature (253)..(253): n is a, c, g, or t
tcagagctcacgtacacgaccggtgctcgatttagcactcgcacgttgggtttggggagcttcagctgtggtagagaagacaggattcaggacaatctccagcatggccggcttcccctctcctcctcctaccctcctcactcacgtgtcgacggtacggttcgtccgggacctagttcgttggtcgtcgtacgtacctacgaccgacccctaccctagacggtccgttcgggtaccccgggggacccccggnaacgggtaccggtccaacctacttccttcgtttcgttccggtaagggaacgccgtaacgtccctaacctaaagttacggtaaacggtaaagtaggtaaattaagttagttaacttacggttacgggttaacccacggtaacgtaaccgtaccccgaacggaaacccccggaaccccccgtaaaccttccctactaacttacttaaactaaacctaagttagtaaccttaccgaacgggtccccggtaccccttacggggtaacccggggttccccgtacgggtaacccgttacgttttaccgtccggttacggttaccctaccggttaaacgttcgggtacggtcccgtaccctacgaccgtacccctacccggtaccggaccctacgtacgtaacggggtccgggttacccgtacccggggacccgaacgggtagtaccgggtaccgggtacgttacgttaacgtttttaacgttacgtttcgggtttaaggggtttacggggtttagggtaacccgttccggaaccggtaccggttccgttacgggtaacttccggtttaccttaccgggttttccggttacgggaccggttaccggtaaccggggtaaaccgtacggttcccggtaacccggttttacggaacccgttacggaaccccggtaaccgggacccggtaaccccctaaccccgttacgg

SEQ ID NO: 163847 - DNA, 542 bp, Homo sapiens
  misc_feature: GYAE6OF02HPY5D.47.55.E11.1.454.CMB.1.raw
  modified_base (390)..(390): a, c, t, g, unknown or other
  misc_feature (390)..(390): n is a, c, g, or t
  modified_base (415)..(415): a, c, t, g, unknown or other
  misc_feature (415)..(415): n is a, c, g, or t
  modified_base (515)..(515): a, c, t, g, unknown or other
  misc_feature (515)..(515): n is a, c, g, or t
  modified_base (522)..(522): a, c, t, g, unknown or other
  misc_feature (522)..(522): n is a, c, g, or t
  modified_base (526)..(526): a, c, t, g, unknown or other
  misc_feature (526)..(526): n is a, c, g, or t
  modified_base (528)..(529): a, c, t, g, unknown or other
  misc_feature (528)..(529): n is a, c, g, or t
  modified_base (531)..(534): a, c, t, g, unknown or other
  misc_feature (531)..(534): n is a, c, g, or t
  modified_base (536)..(542): a, c, t, g, unknown or other
  misc_feature (536)..(542): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctggtttcctgtgctcttttaaaaggtgtccagtgtgaggtgcaggtagtggagtccgggggagcttagttcagcctggggatccctgagactctcctgtgtagtctctggaatcagtttcagtaccttctggatgcacgtgggtcccgaccaaactccgagggtaacggggccaaggggtaaccctggtcacggtcgtctccgtcacgtcctaccgaaccgaacgggcccaagtccggtaccttccccgnggccgcccttgccttaccgaggacnccaccgtccgagacgcaccgacgccggcctggcctgcctggaccaacggtctacgttcgagacgtctcgtggacggcgggtctcgggactaagggcctanacgtagnacgncnngnnnncnnnnnnn

SEQ ID NO: 163848 - DNA, 602 bp, Homo sapiens
  misc_feature: GYAE6OF02GYDFL.47.55.E11.1.454.CMB.1.raw
  modified_base (207)..(207): a, c, t, g, unknown or other
  misc_feature (207)..(207): n is a, c, g, or t
  modified_base (376)..(376): a, c, t, g, unknown or other
  misc_feature (376)..(376): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctcgggacccccgggnagacggtcaccatctcttgttctggaagcagctccaatatcggaaatgataatgtatactggtaccagcaagtcccacgaaccggcccccaaactcctcatctaataacaatgatcagcggccctcgacggggtccctggccgattctcgtggctaccaagtctggccncctcacgcccacccgtcggccatcaggtcgggcctccgggcccgaggactggaggctgtacttattacgtggtggttagggttgggatccggcgacgtcctagtaccgttgccgtttaccgtcgttacgggacgtccggttcggggaaccctaagggtccctaacccggttccgttaacgggttccaaccggtacccccgaaacgggcccccaaaccccgtaccgg

SEQ ID NO: 163849 - DNA, 597 bp, Homo sapiens
  misc_feature: GYAE6OF02GMASJ.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaggtgtccagtgtgaggtgcaggtagtggagtccgggggaggcttagttcagcctggggagtccctgagactctcctgtgtagtctctggaatcagtttcagtaccttctggatgcactcgggtccgccaaactccgagggtaacggggctggtggtgggtctcacgtatcaatcctgatggactagtgttaataattatgcgactcgtgaggggcctattcagcatctaccgagacgacgaacggacaagagtactactgtatcgtaggaaatcgaaataactacgtagagtacgtacgaagtacgtacggacttcgtactatctagtttgttcggtttttacgacgttacggtcccggtttccgggtacccggtacgggttccgtttaccgggtaccggggtaccggttaccggggtaccccgttacggg

SEQ ID NO: 163850 - DNA, 532 bp, Homo sapiens
  misc_feature: GYAE6OF02GRJMN.47.55.E11.1.454.CMB.1.raw
  modified_base (316)..(316): a, c, t, g, unknown or other
  misc_feature (316)..(316): n is a, c, g, or t
  modified_base (383)..(383): a, c, t, g, unknown or other
  misc_feature (383)..(383): n is a, c, g, or t
  modified_base (525)..(525): a, c, t, g, unknown or other
  misc_feature (525)..(525): n is a, c, g, or t
tcagagctcacgtacacgaccggtgctcgatttagcactcgcacgttgggtttggggggaagaggaagactgacggtcctgccacaggtggtgctgggcacggtgggcactcgacacaacatttgcgctcaactgtcttgctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccnccaaactccaggtaaggggctggtgtgggtctcacgtatcaatcctgatggcagtgttaataaattntgcggactccgtggaggggccgattcagcatctccagacgacaacggacaagagtatactgtatcgtaggaaatgaaactaatctagagagtcgacgatacggctgtctatctattgttgtttcgatcgtccgtcggtccgnggtaccg

SEQ ID NO: 163851 - DNA, 488 bp, Homo sapiens
  misc_feature: GYAE6OF02IDMKP.47.55.E11.1.454.CMB.1.raw
  modified_base (326)..(326): a, c, t, g, unknown or other
  misc_feature (326)..(326): n is a, c, g, or t
  modified_base (366)..(366): a, c, t, g, unknown or other
  misc_feature (366)..(366): n is a, c, g, or t
  modified_base (409)..(409): a, c, t, g, unknown or other
  misc_feature (409)..(409): n is a, c, g, or t
  modified_base (451)..(451): a, c, t, g, unknown or other
  misc_feature (451)..(451): n is a, c, g, or t
  modified_base (474)..(474): a, c, t, g, unknown or other
  misc_feature (474)..(474): n is a, c, g, or t
  modified_base (478)..(488): a, c, t, g, unknown or other
  misc_feature (478)..(488): n is a, c, g, or t
tcagagctcacgtacacgaccggtgctcgatttagcactcgcacgtagggtcttgggcccagtctgtgctgactcagccaccctcagcgtctgggaccccgggcagacggtcaccatctcttgttctggaagcagctccaatatcggaaatgataatgtatactggtaccagcaagtcccacgaaccggccccaaactcctcatctataacaatgatcagccggccctcaggggtccctggccgattcctctggctccaagtctggcgcctcagccaccctggccatcagtggcctccggcccgaggatggaggctgattattacngtgtaggttgggatcgcagctgactgcttacgcttcgganctgggaccaaggtccacgtctaggtcacgccaaggccaacccnctcgtcactctcgttcccgcccttcctctacgtgacgctcgngacgcgggcgtggcaaggcgacntagnnnnnnnnnnn

SEQ ID NO: 163852 - DNA, 586 bp, Homo sapiens
  misc_feature: GYAE6OF02GD4O9.47.55.E11.1.454.CMB.1.raw
  modified_base (416)..(416): a, c, t, g, unknown or other
  misc_feature (416)..(416): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggaggtccgggggagcttagttcagcctggggagtccctgagactctcctgtgtagtctctggaatcagtttcagttaccttctggatgcacgtcgggtcccgacctaaacgtccgaaggggtaacggggcttgggtggtgggtctcgacgtatcaatcctgatggctagtagttaataaattagtcgacggtactcggtggacggggcctattcagctatcncgaagacgacgaacggacaaggtacgtactacgtagtactacgtaggaaatcgaaactaatcgtagagtacgtcgaacgtacgtacgcttagtactatcttagttgtttacgtttgacttcgtccgttcgggtccgcggttacttccggagggaccgtacgggaccctgg

SEQ ID NO: 163853 - DNA, 641 bp, Homo sapiens
  misc_feature: GYAE6OF02JT3AU.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggttttccttgttgcttacttttaaaaggtgtccagtgtgaggtgcaggtagtggaggtccgggggaggcgttagttcagccgtggggacgtcccgtgagactctcctgtgtagtctctggaatctagttcacgtaccttctggatcgctacgtcgggtcccgaccaaactccgagggtaagggctgggtcgtgggtctcgtacgtatcaactccgtgagtggctagtagtttaataaagttagtgcggtacgttccggtaggacggggtccattcgagctacgtctaccgaagagtaccgacggacaagtatatacgtgtactacgaaggtaaatacgaaactaagttcgtaaggagtacgtacgaacgtaacgttacggcttacgtactacgttacgttagttttagttttaccggaagttccgtccgtttccgggtaccggtacgggttacctttcgggacggggtaccctaaccggggtacccgttgggtacgg

SEQ ID NO: 163854 - DNA, 506 bp, Homo sapiens
  misc_feature: GYAE6OF02F7K4O.47.55.E11.1.454.CMB.1.raw
  modified_base (493)..(506): a, c, t, g, unknown or other
  misc_feature (493)..(506): n is a, c, g, or t
tcagagctcacgtacacgaccggtgctcgatttagcactcgcacgttgggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtcgggctccggcccgaggatgaggctgattatactgtgtaggttggatcgcagcctgactgcttacgtcttcggagcgtagggaccaagggtccaccgtccgtaggtcacgccccaaggcccaaccccactcgtccactcctcgttcccccgcccttcctcctaccgtgacgtcttcgtgacgcgggctggcaaggcgcatagnnnnnnnnnnnnnn

SEQ ID NO: 163855 - DNA, 674 bp, Homo sapiens
  misc_feature: GYAE6OF02GLXSO.47.55.E11.1.454.CMB.1.raw
  modified_base (197)..(197): a, c, t, g, unknown or other
  misc_feature (197)..(197): n is a, c, g, or t
  modified_base (220)..(220): a, c, t, g, unknown or other
  misc_feature (220)..(220): n is a, c, g, or t
  modified_base (225)..(225): a, c, t, g, unknown or other
  misc_feature (225)..(225): n is a, c, g, or t
  modified_base (379)..(379): a, c, t, g, unknown or other
  misc_feature (379)..(379): n is a, c, g, or t
tcagagctcacgtacacgaccggtgctcgatttagcactcgcacgttgggtttggggagagaagacaggattcaggacaatctccagcatggccggcttccctctcctcctcaccctcctcactcactgtgcagggtcctgggcccagtctcgcccccgactcacgcccaccctcagcgtcgtcggggacccccggnagacggtcatcatctcttgttcnggaancagctcaatatacggaaatgataatgtatacgtggtaccagcaacgtccccaacggaacccggcccccaaactcctacactctaataacaatgatcgagccggccctgacgggtccctggcctattctcgtcggcctaccgaagtcgtcggccncctcgacgcccgtaccgtgacctagtcgaggtccgggccctcccgggacccggaaggtacgtacggacggtcttaggtaactttacgttaccgttggtagggtttagggttacgggacgttccgacgtacggtcctaggtacttacggtaccgtttacggtccgtttcgggacgttccggtacgggaaccctaacgggtccgtaccgttaccgtaggaccgaaccggcccgaaaccggacccccaacccgtgtaccgtacctaccgttccgttcccgttaccccctacccttccg

SEQ ID NO: 163856 - DNA, 602 bp, Homo sapiens
  misc_feature: GYAE6OF02FN774.47.55.E11.1.454.CMB.1.raw
  modified_base (190)..(190): a, c, t, g, unknown or other
  misc_feature (190)..(190): n is a, c, g, or t
  modified_base (285)..(285): a, c, t, g, unknown or other
  misc_feature (285)..(285): n is a, c, g, or t
  modified_base (327)..(327): a, c, t, g, unknown or other
  misc_feature (327)..(327): n is a, c, g, or t
  modified_base (392)..(392): a, c, t, g, unknown or other
  misc_feature (392)..(392): n is a, c, g, or t
  modified_base (411)..(411): a, c, t, g, unknown or other
  misc_feature (411)..(411): n is a, c, g, or t
tcagagctcacgtacacgaccggtgctcgatttagcactcgcacgttgggtttggggagagaagacaggattcaggacaatctccagcatggccggcttccctctcctcctcaccctcctcactcactgtgcagggtcttgggcccagtctgtgctgactcagccaccctcagcgtctgggacccccggnagacggtcaccatctcttgttctggaagcagctccaatatcggaaatgataatgtatactggtaccagcaagtcccacgaacgccccaaatcctnatcataacatgatcagccgcctgacgggtcctggccgattcnctggcctcaagtctggccgcctgacgcccacctggcccaatccgaggtcggctccggccgagganggaggctgacttattacgngttggtaggttgggactcggctagccgtgacgtgttccgttacgtcgtttcgggagtccgttcggggaacctaacgggtctacccggttccgtaacgggtccaccggtaccccgaaaccgggtacccccaaaccccgtaccgttaccgttacccgacccgtttcccgttaccggttaccccccctaccccg

SEQ ID NO: 163857 - DNA, 545 bp, Homo sapiens
  misc_feature: GYAE6OF02F1Q9W.47.55.E11.1.454.CMB.1.raw
  modified_base (368)..(368): a, c, t, g, unknown or other
  misc_feature (368)..(368): n is a, c, g, or t
  modified_base (390)..(390): a, c, t, g, unknown or other
  misc_feature (390)..(390): n is a, c, g, or t
  modified_base (452)..(452): a, c, t, g, unknown or other
  misc_feature (452)..(452): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctcgggacccccgggcagacggtcaccatctcttgttctggaagcagctccaatatcggaaatgataatgtatactggtaccagcaagtcccacgaaccgcccccaaatcctcatctatacgaatatcagcgtcctcgagggtcctgaccgtattctctggcctacgaagtctggcncctcagcccaccgtggccatcnggtcgggcctcccggcccgaggctggacggctgtattattacgtgttgtagggttggatcgnacgcctgactgcgttacgtcttcggagcgtacgggacctaggtcctacccggtacgtaggtcaccggccctaacggcccctaacccgtcgtcg

SEQ ID NO: 163858 - DNA, 539 bp, Homo sapiens
  misc_feature: GYAE6OF02IXMTE.47.55.E11.1.454.CMB.1.raw
  modified_base (269)..(269): a, c, t, g, unknown or other
  misc_feature (269)..(269): n is a, c, g, or t
  modified_base (310)..(310): a, c, t, g, unknown or other
  misc_feature (310)..(310): n is a, c, g, or t
  modified_base (436)..(436): a, c, t, g, unknown or other
  misc_feature (436)..(436): n is a, c, g, or t
  modified_base (523)..(524): a, c, t, g, unknown or other
  misc_feature (523)..(524): n is a, c, g, or t
  modified_base (527)..(539): a, c, t, g, unknown or other
  misc_feature (527)..(539): n is a, c, g, or t
tcagagctcacgtacacgaccggtgctcgatttagcactcgcacgtagggtcttgggcccagtctgtgctgactcagccacccctcagcgtctgggacccccgggcagacggtcaccatctcttgttctggaagcagctccaatatcggaaatgataatgtatactggtaccagcaagtcccacgaacggccccaaactcctcatctataacaatgatcagccggccctcacggggtccctggccgattctctggctccaagtctggcncctcacgccaccctggccatcagtggcctccggcccgaggntggaggctgattattactgttgtaggttgggactcgcagccgtgactgtctttacgtcttcggagtcgtcgggaccgtaaggtccaccgtcccgtaggtccacggccccaacggccccaaaccccncgtcgtccaccttcttccgttccccaccccttcctcctacgtcgagtcctcgtgacggccgggtctgggcaacgggccgacagtagnncgnnnnnnnnnnnnn

SEQ ID NO: 163859 - DNA, 517 bp, Homo sapiens
  misc_feature: GYAE6OF02FZF64.47.55.E11.1.454.CMB.1.raw
  modified_base (348)..(348): a, c, t, g, unknown or other
  misc_feature (348)..(348): n is a, c, g, or t
  modified_base (499)..(499): a, c, t, g, unknown or other
  misc_feature (499)..(499): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtnttataaattatgcggactcgtgaggggccgattcagcatctccagagacaacggcaagagtatactgtatctggaaatgaacaatctgagagtcgaagagtacgctgtctatctattgtgtttcgattgtccttcggtcgcgggacttcgngggccacgggtacctcgg

SEQ ID NO: 163860 - DNA, 529 bp, Homo sapiens
  misc_feature: GYAE6OF02FJ1E2.47.55.E11.1.454.CMB.1.raw
  modified_base (408)..(408): a, c, t, g, unknown or other
  misc_feature (408)..(408): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaagggctggtgtgggtctcacgtatcaatcctgatggcagtgttaataaattatgcggactccgtgaggggccatcagcatctcagagacaggacaagagtanactgtatctagaatgaaacatctgaagagtcgagtacgtacggctagtctatacagttgttgtttcgattcgtccgttccggtcggcgggtacttcgtcggggcctacgggacccttcggg

SEQ ID NO: 163861 - DNA, 553 bp, Homo sapiens
  misc_feature: GYAE6OF02FM7A2.47.55.E11.1.454.CMB.1.raw
  modified_base (192)..(192): a, c, t, g, unknown or other
  misc_feature (192)..(192): n is a, c, g, or t
  modified_base (313)..(313): a, c, t, g, unknown or other
  misc_feature (313)..(313): n is a, c, g, or t
  modified_base (323)..(323): a, c, t, g, unknown or other
  misc_feature (323)..(323): n is a, c, g, or t
  modified_base (346)..(346): a, c, t, g, unknown or other
  misc_feature (346)..(346): n is a, c, g, or t
  modified_base (350)..(350): a, c, t, g, unknown or other
  misc_feature (350)..(350): n is a, c, g, or t
  modified_base (354)..(354): a, c, t, g, unknown or other
  misc_feature (354)..(354): n is a, c, g, or t
  modified_base (520)..(520): a, c, t, g, unknown or other
  misc_feature (520)..(520): n is a, c, g, or t
tcagagctcacgtacacgaccggtgctcgatttagcactcgcacgttgggtttggggagagaagacaggattcaggacaatctccagcatggccggcttccctctcctcctcaccctcctcactcactgtgcagggtcttgggcccagtctgtgctgactcagccaccctcagcgtctggggacccccgggnagacggtcaccatctcttgtctggaagcagctccaatatcggaaatgataatgtatactggtaccaacaagtcccacgaacggcccccaaactcctcatctataacaatgatcagcgcctnaggggtcccnggccgattctctggctccagtcnggcncctnacgccacctggccatcagtcgggctccgggcccgaggatggaggtccgtagtattacgttactggtgttagggttgggatcgcagcctgtactcgcttacgtcgttcggagtcgtcgggaccaaggtccaccgttccgtaggcgagacccgaacggcccaaccccngtcgtccacgttcctcgtacccctccctacccg

SEQ ID NO: 163862 - DNA, 554 bp, Homo sapiens
  misc_feature: GYAE6OF02I52U8.47.55.E11.1.454.CMB.1.raw
  modified_base (207)..(207): a, c, t, g, unknown or other
  misc_feature (207)..(207): n is a, c, g, or t
  modified_base (234)..(234): a, c, t, g, unknown or other
  misc_feature (234)..(234): n is a, c, g, or t
  modified_base (245)..(245): a, c, t, g, unknown or other
  misc_feature (245)..(245): n is a, c, g, or t
  modified_base (349)..(349): a, c, t, g, unknown or other
  misc_feature (349)..(349): n is a, c, g, or t
  modified_base (366)..(366): a, c, t, g, unknown or other
  misc_feature (366)..(366): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagcccaccctcagcgtctgggacccccgggnagacggtcaccatctcttgtctggaancagctccaatntcggaaatgataatgtatactggtaccagcaagtcccacgaacggcccccaaactcctcatctataacaatgatcagcggcctcaggggtccctgaccgattcnctggctcaagtctgacncctcagccctcctcgccatcagtgggcctcggtccgaggactgaggctagtatttattattgtgacaacgagtcgggattagtacgtcctgtaggtagtgttgggttttcggcgggtagggaacctaaacgtcggtaaccgtcccgttaggtaccacggcccgtaacggcttccggcccccgttccgg

SEQ ID NO: 163863 - DNA, 694 bp, Homo sapiens
  misc_feature: GYAE6OF02ILBRY.47.55.E11.1.454.CMB.1.raw
  modified_base (207)..(207): a, c, t, g, unknown or other
  misc_feature (207)..(207): n is a, c, g, or t
  modified_base (347)..(347): a, c, t, g, unknown or other
  misc_feature (347)..(347): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctcgggacccccgggnagacggtcaccatctcttgttctggaagcagctcaatatacgaatgataatgtatacgtggtaccagcaacgtcccaacggaaccggcccccaaactcctcatctaataacaatgatcagccggccctgacggggtcccnggccgtattctcgtggcctaccgtaagtcgtggccgtcctaccacggccctacccgtggaccctacgtccgtagggtccggggcccgttaccccggggcccggaagggtattacgggacggttccgttaggtaacttttagtttaccgttggttacgggtttaggggtttacgggtaacgtccggtacgtaccggtaccgttacgtaccgttggttacccgttttaccggttccggtttacgggacggtcccggttacggggaacccgtaaacggttcccgtacccggtttaccgttaccgggtacccaacggtacccccgaaagggtcccccctaaaccccgtccg

SEQ ID NO: 163864 - DNA, 547 bp, Homo sapiens
  misc_feature: GYAE6OF02GM3SH.47.55.E11.1.454.CMB.1.raw
  modified_base (205)..(205): a, c, t, g, unknown or other
  misc_feature (205)..(205): n is a, c, g, or t
  modified_base (233)..(233): a, c, t, g, unknown or other
  misc_feature (233)..(233): n is a, c, g, or t
  modified_base (459)..(459): a, c, t, g, unknown or other
  misc_feature (459)..(459): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccggnagacggtcaccatctcttgttctggaancagctccaatatcggaaatgataatgtatactggtaccagcaagtcccacgaaccggcccccaaactccctcatctataacaatgatcagcggccctcgagggtccctggccgtattcctcgtcggtctaccaagtctggccgcctcacgcccacccgtgccatcgagtcgggcctccggcccgaggacgtgaggtctgattattactgtgtaggttgggatcgcngcctgactgtcttacgtcgttcggagtcgtgggaacctaggtcctaccggtccgtaggtccacggcccgaacggacccaacccgtacg

SEQ ID NO: 163865 - DNA, 629 bp, Homo sapiens
  misc_feature: GYAE6OF02H04PS.47.55.E11.1.454.CMB.1.raw
  modified_base (247)..(247): a, c, t, g, unknown or other
  misc_feature (247)..(247): n is a, c, g, or t
  modified_base (270)..(270): a, c, t, g, unknown or other
  misc_feature (270)..(270): n is a, c, g, or t
  modified_base (370)..(370): a, c, t, g, unknown or other
  misc_feature (370)..(370): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagcgtggtttcgtgtagctctttaaaggtgtcagtgtgagtgcaggtagtggagtccgggggagtcttaggttcagcctggggactccctgagactctctgtgtagtctntggaatctagtttcagttccttntggatgcacgttgggtcccaccaaactccgaggttaaggggctgggtgtcgggtctacgacgtatcaatccgtggatggactagttgttaaataaagttntcggcggtaacttccgggaggtacggggccctaattccgaggacctacgttctaccaaggtaacgaacgaacggacgaaagacgttaatacgtaagtattacgtagggaaatagaaacctaagttcgtaggaagtacgtacgaacgtagtaccgtcgttagtactagtctgtttcgttggtttacgtacgttcgtcccggttttacggcccggttacggtaccggtttcgtccggggtaccggtaccggtaccgttcgg

SEQ ID NO: 163866 - DNA, 773 bp, Homo sapiens
  misc_feature: GYAE6OF02JU5KD.47.55.E11.1.454.CMB.1.raw
tcagagctcacgtacacgaccggtgctcgatttagcactcgcacgttgggtttgggggtaggccgcagccctgggattcccagctgtttctgcttgctgatcaggactgcacacagagagctcaccatggagtctgggctgagctgggttttccttgttgctcttttaaaaggtgtccagtgtgaggtgcaggtagtggaggtccgggggaggcttagttcagcctggggagtccctgagactctcctgtgtagtctcgtggaatcagtttcagttaccttcgtggatgctacgtggggtcccacaaactccgaaggtaaggggctagggtgtcgggtctcgacgtatcaatcctggatcggctagttagttaataaaatttagtcggaccgtacgtccgtggacggggacctattcaggtacacgttcctaccgagtacggaacgtaaaccgggactaaaaggtacgttaacgtaacgttacggtaacgttaccgtaaagggtaaaacttacggaaaactaaaacgtttcgtaaggtaacgggtaccggttaaccggaaaccgggttaacgttaaccgggggtacctttaagggttaaccttaaacgttaccgttttaaaggttttttccgggtttttaccggaaacggtttccggtttaccccccggtttaccgggggttaccccgggttaccgggggttaacccggttttcccgggttaaccgggggggtacccccggttaaccggggggttaaaccccccgtttggggg

SEQ ID NO: 163867 - DNA, 575 bp, Homo sapiens
  misc_feature: GYAE6OF02G92DF.47.55.E11.1.454.CMB.1.raw
  modified_base (301)..(301): a, c, t, g, unknown or other
  misc_feature (301)..(301): n is a, c, g, or t
  modified_base (451)..(451): a, c, t, g, unknown or other
  misc_feature (451)..(451): n is a, c, g, or t
tcagagctcacgtacacgaccggtgctcgatttagcactcgcacgttgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttataaattatgcgactccgtgaggggccgattcagcatctccaganacaacggcaagagtatactgtatctggaaatgaacaatctgagagtcgacgatacggctgtctatcattgtgttttacgatgccctttcgggtcccgcgggtaccttcgtcggggccgtagggaaccctgggtcaggtccgtcgtcctcngccctccaccacgggcccagtccggtccttcccctggccgccctgccctccgaggcgctacccgtccgacgacgccaccgacgccggcccgtggggtacctcggccgttcgggtcgtaaccggg

SEQ ID NO: 163868 - DNA, 618 bp, Homo sapiens
  misc_feature: GYAE6OF02I9XJ5.47.55.E11.1.454.CMB.1.raw
  modified_base (201)..(201): a, c, t, g, unknown or other
  misc_feature (201)..(201): n is a, c, g, or t
  modified_base (241)..(241): a, c, t, g, unknown or other
  misc_feature (241)..(241): n is a, c, g, or t
  modified_base (368)..(368): a, c, t, g, unknown or other
  misc_feature (368)..(368): n is a, c, g, or t
tcagagctcacgtacacgaccggtgctcgatttagcactcgcacgttgggtttggggagctgtggtagagaagacaggattcaggacaatctccagcatggccggcttccctctcctcctcaccctcctcactcactgtgcagggtcttgggcccagtctgtgctgactcagccaccctcagcgtcgtcgggacccccggnagacggtcaccatctcttgttctggaagcagctaccaatntacggaaatgataatgtatactggtaccagcaagtcccacgaaccggcccccaaactcctcatctataacatgatcagccgccctcgacgggtccctggccgtattctcgtgctccaagtctggccncctcacgcccacccgtcggccctatccgaaggtcgggccgttccccgggcccggaggacgtacggacgggtcgtagtactttagtttaccgttggttaggttagggtttcgggacttcggcacgtcccgtgaccttgtaccgtttaccgttccgtttcgggacgtccgtacgggaacctaacgggtccacccggttaccgtaggtaccgacgacccgacggaccccaaccccgcgttccgtacctacccg

SEQ ID NO: 163869 - DNA, 553 bp, Homo sapiens
  misc_feature: GYAE6OF02GRTUX.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcacgtgggtcccgccaaactccgaaggtaagggctggtgtgggtctcacgtatcaatcctgatggcagttgttaataaattatgcggtactccggtaggacggggccattcgagcatcctccagacgacgaacggacaagatatactgtatcgtagaatagaacaatctagagagtacgacgagtacgctagtctatctagttgttagtttcgattcgtcccgttcggtccggcgggtacgttccggtacggggcccgtacgggtaccctgg

SEQ ID NO: 163870 - DNA, 609 bp, Homo sapiens
  misc_feature: GYAE6OF02I8L36.47.55.E11.1.454.CMB.1.raw
  modified_base (376)..(376): a, c, t, g, unknown or other
  misc_feature (376)..(376): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccggcagacggtcaccatctcttgttctggaagcagctccaatatacggaaatgataatgtatactggtaccagcaagtcccaacgaaccggcccccaaactcctcatactataaacaatgatcagcggccctgacggggtcctggccgtattctcgtggctacgaagtctggccncctacacgcccaccgtggacccagtcgacggtcgggcccgtccgggacccgagggtatcggagggtcttaggtaactttagttacgttggtaggttagggttagggtactcggactacggccttagaaccttgtaccgtttacgtcgttacggacgtcggtacgggacctaacgggtcctacccggttaccgtaggttaccgaccggaccccgaacggccccaaccccgtacg

SEQ ID NO: 163871 - DNA, 547 bp, Homo sapiens
  misc_feature: GYAE6OF02GQL1T.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagttaccttctggatgcacgtgggtcccgaccaaactccgagggtaaggggctggtgtgggtctcacgtatcaatcctgatggcagtgttaataaattatgcggactccggtggacggggcctattcagcatctccagacgacaacggcaagagtatactgtatcgtagaaatgaacatctagagtagtacgacgagtacggctgtactatctattgttgtttcgattcgtccgttcggtccggtacggtacttcggcggggtacctacgggacccgtcgg

SEQ ID NO: 163872 - DNA, 633 bp, Homo sapiens
  misc_feature: GYAE6OF02HNK4Y.47.55.E11.1.454.CMB.1.raw
  modified_base (205)..(205): a, c, t, g, unknown or other
  misc_feature (205)..(205): n is a, c, g, or t
  modified_base (380)..(380): a, c, t, g, unknown or other
  misc_feature (380)..(380): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccggnagacggtcaccatctcttgttctggaagcagctccaatatacggaaatgataatgtatactggtaccagcaacgtcccaacgaaccggacccccaaactccctacatactataacaatgatcacgcggccctcgacgggtcctggcctattctcgtggcctacagtcgtcggccncctcacgcccacccgtcggaccactcgaggtcgggcctcccgggaccgaggacgtggacggtctagtatttatacgttggtgggttagggttgggacttccgacgtcgtccgttgtactcggtccgtttaccgttcgttacgggtacgtccgggttacgggaacccgtacgggttacccgtacccggttacccgttacgggttacccgaaccggtacccccggtaaaccgggtaccccctaaaccccgtaccg

SEQ ID NO: 163873 - DNA, 510 bp, Homo sapiens
  misc_feature: GYAE6OF02G3QS8.47.55.E11.1.454.CMB.1.raw
  modified_base (205)..(205): a, c, t, g, unknown or other
  misc_feature (205)..(205): n is a, c, g, or t
  modified_base (365)..(365): a, c, t, g, unknown or other
  misc_feature (365)..(365): n is a, c, g, or t
  modified_base (404)..(404): a, c, t, g, unknown or other
  misc_feature (404)..(404): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccggnagacggtcaccatctcttgttctggaagcagctccaatatcggaaatgataatgtatactggtaccagcaagtccccacgaaccggcccccaaactcctcatctataacaatgatcagcgcctcagggtccctggccgattctctggctcaagtctggcncctcacgccaccctggccatcagtggcctccggccgagntgagctgattattactgtgtaggttggatcgcagcctgactgcttacgtcttcggagcgtgggaccaaggtcaccgtcctaggtcacgcccaaggcccaaccctcg

SEQ ID NO: 163874 - DNA, 570 bp, Homo sapiens
  misc_feature: GYAE6OF02FQ3TZ.47.55.E11.1.454.CMB.1.raw
tcagagctcacgtacacgaccggtgctcgatttagcactcgcacgttgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaaactccaggtaagggctggtgtgggtctcacgtatcaatcctgatggcagtgttataaattatgcggactccgtgaggggccgattcagcatctccagagacaacggcaagagtatactgtatctggaaatgaacaatctgagagtcgacgatacggctgtctatcattgtgttttcgatgccttcggtccgcgggacttcgtgggccagggaccctggcagcgtctcctcacgccctccaccacgggcccagtccggtccttcccccgtggccgccctcgcctccgacgacgccaccctccggaacgacgccaaccgtacggcccggtccccgtggggcccttcggcccgttgggtacctaaacggg

SEQ ID NO: 163875 - DNA, 664 bp, Homo sapiens
  misc_feature: GYAE6OF02J1K2G.47.55.E11.1.454.CMB.1.raw
  modified_base (359)..(359): a, c, t, g, unknown or other
  misc_feature (359)..(359): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgcttcttttaaaaggtgtccagtgtgaggtgcaggtagtggaggtccgggggaggtcttagttcagccgtggggagtccctgagactctcctgtgtagtctctggaatctagtttcacgttaccttctggattgccacgtcggggtcccaccaaactccgaaggtaacggggctgggtgtcgggtctacgagtatacaacttcnggtatggctaggttagtttaattaaacttagtcgacggtacttaccgggtaggacggggtcgtattcgagtacactctacgaagacgaacgaacggtacaaaggtacgtaatacgtagttacttacgtaggtaaactgtaaacatacgtaggaacgacgttcgaaacgtcgttaacgtcgttacgttacgtacttacttagtttcgtttacggttttacgtacgttcggttaccccggtttcgggtcccgggtcgggttaccgttcgggttccggggtaacccgtaccggggtaaccccgttggg

SEQ ID NO: 163876 - DNA, 625 bp, Homo sapiens
  misc_feature: GYAE6OF02HV8W9.47.55.E11.1.454.CMB.1.raw
  modified_base (228)..(228): a, c, t, g, unknown or other
  misc_feature (228)..(228): n is a, c, g, or t
  modified_base (233)..(233): a, c, t, g, unknown or other
  misc_feature (233)..(233): n is a, c, g, or t
  modified_base (301)..(301): a, c, t, g, unknown or other
  misc_feature (301)..(301): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctcgggacccccggcagacggtcaccatctcttttcnggaancagctcaatatcggaaatgataatgtatactggtaccagcaagtcccacgaaccgaccccaaactccncatctataacaatgatcagcgcctcgacgggtccctggccgtattctctggcctaccgaagtctggcctccctcgacgcccacccgtcggaccagtcgaggtcgggcctcccgggcccgaagggacttcgggacggcttaggtatttaacgttacttgggtagtttaggggttgggacttccggcacgtcccgtaggaccttcggtacctttaccggttccgtttcgggacgtccgtacggggaaccctaagggtccctaacccggttccgtaagggttaccaaccggtaccccgaaacgggaccccctaaccccgacttccgg

SEQ ID NO: 163877 - DNA, 543 bp, Homo sapiens
  misc_feature: GYAE6OF02GNQIE.47.55.E11.1.454.CMB.1.raw
  modified_base (358)..(358): a, c, t, g, unknown or other
  misc_feature (358)..(358): n is a, c, g, or t
  modified_base (466)..(466): a, c, t, g, unknown or other
  misc_feature (466)..(466): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccgaggtaagggctggtgtgggtctcacgtatcaatcctgatggcagtgttataaattntgcggactcgtgaggggcattcagcatctacagagacaacgcaaagagtatactgtatacgtaggaatgaactaatctagagagtcgaacgatacggctagtactatnatttgtcgttttcgattcgtaccgtttcggcccgtacgggtacctttcggacggggaccgtacgggacccgtacggg

SEQ ID NO: 163878 - DNA, 495 bp, Homo sapiens
  misc_feature: GYAE6OF02FKP0C.47.55.E11.1.454.CMB.1.raw
  modified_base (479)..(479): a, c, t, g, unknown or other
  misc_feature (479)..(479): n is a, c, g, or t
  modified_base (483)..(495): a, c, t, g, unknown or other
  misc_feature (483)..(495): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctgggggagtccctgagactctcctgtgtagtctctggaatcagtttcagtaccttctggatgcactgggtccgccaaactccaggtaaggggccagggaaccctggtcagcgtctcctcagcctccaccaaggcccatcggtccttcccctggccgccctgcctccgaggacgccacctccgagacgcacacgcggccctgggcctgcctggtcaaggctacttcctacgtgagctctgagcgggctggcaagggcacntagnnnnnnnnnnnnn

SEQ ID NO: 163879 - DNA, 551 bp, Homo sapiens
  misc_feature: GYAE6OF02HALFV.47.55.E11.1.454.CMB.1.raw
  modified_base (191)..(191): a, c, t, g, unknown or other
  misc_feature (191)..(191): n is a, c, g, or t
  modified_base (356)..(356): a, c, t, g, unknown or other
  misc_feature (356)..(356): n is a, c, g, or t
tcagagctcacgtacacgaccggtgctcgatttagcactcgcacgttgggtttggggagagaagacaggattcaggacaatctccagcatggccggcttccctctcctcctcaccctcctcactcactgtgcagggtcttgggcccagtctgtgctgactcagccaccctcagcgtctgggacccccgggnagacggtcaccatctcttgttctggaagcagctccaatatcggaaatgataatgtatactggtaccagcaagtcccacgaaccggcccccaaactcctcatctataacaatgatcagcggccctcgaggggtccctggccgtattctctggctccaagtctggcncctcacgccaccctgccatcgagtcgggctccggcccgaggatggagctgattattactgtggtaggttgggactcgcacgctgacttgctttacgtcttcggagtcgtgggaacctaaggtccaccgtccgtaggtcacgacccgaaggccccaacccgtctcggtaccaccgttcttaccgttccccgtcccc

SEQ ID NO: 163880 - DNA, 593 bp, Homo sapiens
  misc_feature: GYAE6OF02G843G.47.55.E11.1.454.CMB.1.raw
  modified_base (385)..(385): a, c, t, g, unknown or other
  misc_feature (385)..(385): n is a, c, g, or t
tcagagctcacgtacacgaccggtgctcgatttagcactcgcacgttgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaaactccaggtaaggggctggtgtgggtctcacgtatcaatcctgatggcagtgttaataaaattatgcggactccgtgaggggccgattcagcatctccagagacaacggcaaagagtatactgtaatctaggaaatgaaacaaatctagagagtcgaacgatacggctgtctatcatttgtnttttcgatgcctttcggtcgcgggtacttcgtcgggcgacgggaacctgggtcagccgttctccgtcacgcctaccaaccaacgggccccaagttcccgggttcccttacccccgtcggcccgtacccctcggcctcccgaggacgccacctccggaagacgcgaaccacggccggcccgtgggcctcggcccgtcggtaccaacggg

SEQ ID NO: 163881 - DNA, 661 bp, Homo sapiens
  misc_feature: GYAE6OF02IDEQY.47.55.E11.1.454.CMB.1.raw
  modified_base (187)..(187): a, c, t, g, unknown or other
  misc_feature (187)..(187): n is a, c, g, or t
  modified_base (209)..(209): a, c, t, g, unknown or other
  misc_feature (209)..(209): n is a, c, g, or t
  modified_base (238)..(238): a, c, t, g, unknown or other
  misc_feature (238)..(238): n is a, c, g, or t
  modified_base (322)..(322): a, c, t, g, unknown or other
  misc_feature (322)..(322): n is a, c, g, or t
  modified_base (345)..(345): a, c, t, g, unknown or other
  misc_feature (345)..(345): n is a, c, g, or t
  modified_base (358)..(358): a, c, t, g, unknown or other
  misc_feature (358)..(358): n is a, c, g, or t
  modified_base (401)..(401): a, c, t, g, unknown or other
  misc_feature (401)..(401): n is a, c, g, or t
tcagagctcacgtacacgaccggtgctcgatttagcactcgcacgttgggtttggggcgagcttcagctgtggtagagaagacaggattcaggacaatctccagcatggccggcttccctctcctcctcaccctcctcactcactgtgcaggtcttgggcccagtctgtgctgactcagccaccctnacgcgtctacgggacccccggnagacggtcaccatctctttgtcgtggaancagctccaaatagacggaaatgataatgtatactggtacagacaacgtcccaacggaaccgcccccaaactcctcaatcctaanaaacaatgactcacgccggtccncgtaggggtcccnggtacccattctacgtcggctaccgagtcttggccgacccttnaccgcccaccgtcgacctacgtaccgtacggtcggacccgtccggaccccggaggacgttacggacggtcctagtacgtttaactttcgtaaggtttggttaacgggttagggtacgtccgacggtcgtacccgttgaccgttcgtacgtttaaccgttccgttacggtcggccgttacgggaacccgtaaacgggttacccgtaccggtttacccgaacgggtccgtaacccgggacccaaccggtacccccgaacccg

SEQ ID NO: 163882 - DNA, 554 bp, Homo sapiens
  misc_feature: GYAE6OF02GM5CL.47.55.E11.1.454.CMB.1.raw
  modified_base (352)..(352): a, c, t, g, unknown or other
  misc_feature (352)..(352): n is a, c, g, or t
tcagagctcacgtacacgaccggtgctcgatttagcactcgcacgttgggtttggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcacgtgggtccgccaaactccgaggtaaggggctggtgtgggtctcacgtatcaatcctgatggctagtnttaataaattatgcggactccgtggaggggcctattcgagcatctccgagacgacaacggcaagagtatatagtatcgtaggaaatgaacaatcgtagagagtacgacgtaatacggctgtactatctatttggttcgttttacgattcgtccgtttcgggtcccgtcgggtacttccggcggggtaccgagggtaacccgg

SEQ ID NO: 163883 - DNA, 578 bp, Homo sapiens
  misc_feature: GYAE6OF02IPMTB.47.55.E11.1.454.CMB.1.raw
  modified_base (342)..(342): a, c, t, g, unknown or other
  misc_feature (342)..(342): n is a, c, g, or t
tcagagctcacgtacacgaccggtgctcgatttagcactcgcacgttgggttttccttgttgctcttttaaaaggtgtccagtgtgaggtgcaactgttggagtatgggggagacttagtacaccctggggggtccctgagactctcctgtgcagcctctggactcacctttagcaactctgtcatgggctgggtccgccaggctccggggaagggctgggagtgggtctcaagtattgatgagaatgggtggaagcacattctacgtggactccgtgaagggccggttcaccatctccagagacaatttcaggagcacgctgtatctaacaaaatgaaacngcctgagagccgaggacacggcgtatatttctgtgacgaaagtctaatagcagtcgccccctaggccgctactttctttgtacttcgtcggggccaagggattccgtgtccaccgtctccacctcgccctacccaccgaacgggccctagttccggttccttccccgtcgggcccgccctcgcctccgacggacgccaccgtccgagcgacaccgacggccggtcccgtgggtccg

SEQ ID NO: 163884 - DNA, 175 bp, Homo sapiens
  misc_feature: GYAE6OF02IEH4P.47.55.E11.1.454.CMB.1.raw
  modified_base (175)..(175): a, c, t, g, unknown or other
  misc_feature (175)..(175): n is a, c, g, or t
tcagagctcacgtacacgaccggtgctcgatttagcactcgcacgttgggtttgggggaagaggaagactgacggccctgctccaggagcacctctgggggcacagcggccctgggctgcctggtcaaggactacttcctacgtgagctctgagcgggctggcaaggcgcatagn

SEQ ID NO: 163885 - DNA, 569 bp, Homo sapiens
  misc_feature: GYAE6OF02I8LQG.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttcctgttgctcttttaaaaggtgtccagtgtgaggtgcaggtagtggaggtccgggggaggcttagttcagcctgggggagtccctgagactctcctgtgtagtctctggaatctagtttcagtaccttctggatgcacgtgggtccgccaaactccgaggtagggctggtgtggtctcacgtatcaatcctgatggctagtgttaataattatgacggtactccggtgacggggccgtagttcgagcactctccgagacgacaacggacaagagtatactgtatctaggaaatgaacatctagagtacgtacgaacgtacgtacggctagtactatactagtttgttggttttcagttcgtccgtttccggtcggtaccgggttaccgttcggtcggggaccgtacggggtacccttcggg

SEQ ID NO: 163886 - DNA, 515 bp, Homo sapiens
  misc_feature: GYAE6OF02FNBGU.47.55.E11.1.454.CMB.1.raw
  modified_base (293)..(293): a, c, t, g, unknown or other
  misc_feature (293)..(293): n is a, c, g, or t
  modified_base (503)..(515): a, c, t, g, unknown or other
  misc_feature (503)..(515): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctgggggagtccctgagactctcctgtgtagtctctggaatcagtttcagtaccttctggatgcactgggtccnccaaactccaggtaaggggccagggaaccctggtcagcgtctcctcagcctccaccaacgggcccatccggtccttccccctggccgccctgcctccaggacgccacccgtccgagacgccacacggccgggccctgggcctgcccgtggtaccaagggaccttacttcctacgtgacgctctgacgcgggctgggcaaggcgacatagnnnnnnnnnnnnn

SEQ ID NO: 163887 - DNA, 587 bp, Homo sapiens
  misc_feature: GYAE6OF02IJZAK.47.55.E11.1.454.CMB.1.raw
tcagagctcacgtacacgaccggtgctcgatttagcactcgcacgttgggtttggggggaagaggaagactgacggtcctgccacaggtggtgctgggcacggtgggcactcgacacaacatttgcgctcaactgtcttgctcaccatggagtctgggctgagctgggttttccttgttgctcttttaaaaggtgtccagtgtgaggtgcaggtagtggagtccgggggagcttagttcagccgtggggagtccctgagactctcctgtgtagtctctggaatcagtttcagtaccttctggatgcacgtgggtccaccaaactccgagggtaagggctggtgtgggtctcgacgtatacaatccgtgagtggctagtgttaataaattatcgtcggtacttccggtaggacggggcccgtagtttacagtctacttcctaccgacgaacgaaccaacgggacaaggagtaatactaggtatcgtaggaaatgaaactaatcgagaggtaagtacgaacgtagtacggtacttgtacttaatctagttgtttgtttacgattcgtccgtcggttccggtcggtacgg

SEQ ID NO: 163888 - DNA, 669 bp, Homo sapiens
  misc_feature: GYAE6OF02I5O79.47.55.E11.1.454.CMB.1.raw
  modified_base (207)..(207): a, c, t, g, unknown or other
  misc_feature (207)..(207): n is a, c, g, or t
  modified_base (234)..(234): a, c, t, g, unknown or other
  misc_feature (234)..(234): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctcgggacccccgggnagacggtcaccatctcttgtctggaancagctccaatatcggaaatgataatgtatactggtaccagcaagtcccacgaaccggcccccaaactcctcatctataacaatgatcagccggccctcgaggggtccctggccgtatttctcgtcggccttaccgaacgttcgtcggccgtccctacgacgcccacccgtggcccatccgaggtcgggccgtcccgggacccgagggtacgtggaacggtcttagtaatttacgttacgttggttagggttaaggggttgggtaacttccggacgtacggtcccgttaggtaccgttcggtaccgtttaaccgttccgtttacgggaccggtccggtaacggggtaaccccgtaaggggttaccccgtaccggtttcccgttaacgggttccgaaccggacccccgaaacgggtaccccccaaaccccgtaccgg

SEQ ID NO: 163889 - DNA, 605 bp, Homo sapiens
  misc_feature: GYAE6OF02JDGRB.47.55.E11.1.454.CMB.1.raw
  modified_base (585)..(585): a, c, t, g, unknown or other
  misc_feature (585)..(585): n is a, c, g, or t
  modified_base (589)..(589): a, c, t, g, unknown or other
  misc_feature (589)..(589): n is a, c, g, or t
  modified_base (594)..(594): a, c, t, g, unknown or other
  misc_feature (594)..(594): n is a, c, g, or t
  modified_base (599)..(600): a, c, t, g, unknown or other
  misc_feature (599)..(600): n is a, c, g, or t
  modified_base (603)..(604): a, c, t, g, unknown or other
  misc_feature (603)..(604): n is a, c, g, or t
tcagagctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggcctccaagtctggcgcctcagccaacctggccatcagtgggctccggcccgaggatgaggctgattatactgtgtaggttggatcgcagcctgactgcttacgtcgttcggagtcgtagggaccaagggtccaccggttcctagggtccacggaccccgaaagggccccaaacccccgtacttcggtacccaaccttccgttaccggttttaccccccgccccctttacccgttcccgttaacccggttggaaccgtccttcccgttacggacgggtcccggggtccgttacggggaccaaaccggggccgaccgtaagttacggctagcgncgcngtgcncgcgnntcnnc

SEQ ID NO: 163890 - DNA, 595 bp, Homo sapiens
  misc_feature: GYAE6OF02JBMGC.47.55.E11.1.454.CMB.1.raw
  modified_base (203)..(203): a, c, t, g, unknown or other
  misc_feature (203)..(203): n is a, c, g, or t
  modified_base (242)..(242): a, c, t, g, unknown or other
  misc_feature (242)..(242): n is a, c, g, or t
  modified_base (350)..(350): a, c, t, g, unknown or other
  misc_feature (350)..(350): n is a, c, g, or t
  modified_base (361)..(361): a, c, t, g, unknown or other
  misc_feature (361)..(361): n is a, c, g, or t
  modified_base (365)..(365): a, c, t, g, unknown or other
  misc_feature (365)..(365): n is a, c, g, or t
  modified_base (406)..(407): a, c, t, g, unknown or other
  misc_feature (406)..(407): n is a, c, g, or t
tcagagctcacgtacacgaccggtgctcgatttagcactcgcacgttgggtttggggagcgtgtggtagagaagacaggattcaggacaatctccagcatggccggcttccctctccctcctcaccctcctcactcactgtgcagggtcttgggcccagtctgtgctgactcagcccaccctcagcgtctcgggacccccggnagacggtcaccatctcttgttctggaagcagctcaaatntacggaaatgataatgtatactggtaccagacaagtcccacgaaccgccccaaactcctcatcctaataacaatgatcagcgccctgacgggtcctggccgattctcngtctacagtcnggcnctcacgccaccgtgccatccagtcggccgtccggcccgagnnggagctgtacttagtacgtggttacgtaggttcggattccgcgtacgtcgtacgtactagtcctttaacggtccttacgggacgtccggttagggaacccgtaacgggttccgtaacccggttcgtacggttaccgaaccggtaccccgaacggtacccccaacccctacgtaccgttacgtaccccg

SEQ ID NO: 163891 - DNA, 514 bp, Homo sapiens
  misc_feature: GYAE6OF02FENOA.47.55.E11.1.454.CMB.1.raw
  modified_base (346)..(346): a, c, t, g, unknown or other
  misc_feature (346)..(346): n is a, c, g, or t
  modified_base (494)..(514): a, c, t, g, unknown or other
  misc_feature (494)..(514): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggtttccttgttgcttacttttaaaaggtgtccagtgtgaggtgcaggtagtggagtccgggggagtcttagttcagccgtggggactccctgacgactctcctgtgtacgtctctggaatcagtttcagttaccttctggatgcacgtcgggtccaccaaactccagcctacccacaacgggcctagtccgtccttccccgnggccgccctgccgtccgaggacgcccaccgtccgagacgcacgacggccggcccgtgggctcgcgtgggtacaaacggccttaccttccgtacgttggactccgttcgcgacggggggcgtactcgggactaacgggcacgtagtagnnnnnnnnnnnnnnnnnnnnn

SEQ ID NO: 163892 - DNA, 635 bp, Homo sapiens
  misc_feature: GYAE6OF02HLENM.47.55.E11.1.454.CMB.1.raw
  modified_base (565)..(565): a, c, t, g, unknown or other
  misc_feature (565)..(565): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaggtgtccagtgtgaggtgcaggtagtgggaggtccgggggaggcttagttcagccgtggggagtccctgagactctccgtgtgtagtctcgtggaatcagtttcagtaccttctggatgcactgggtccgaccaaactccgagggtaacggggctgggtgtgggtctcgtacgtatctaatcctagagtggctagttagttaataaagttatgacggacgttcgtggacggggtccgattcgagctactcctaccgaagacgacgaacggacaaagtagtaataccgtagttaacgttactaaggtaaaattacgaaactaagttcgtaggaaggtagtaccggaacgtaagttaccggtagttcgtaacttagtcttagtttggtttcggttttacgnttcgtcccgtttcgggtacccgtcggggtacctttcggtccggggtaccgtaccggggtacccttacggg

SEQ ID NO: 163893 - DNA, 573 bp, Homo sapiens
  misc_feature: GYAE6OF02GV8TB.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcacgtcgggtcccgaccaaactccgagggtaaggggctgggtggtcgggtctcgacgtatcaatcctgatggcagtagttaataaattatcggacggtactcgtggacggggccgtattcgagcatcctcagacgacgaacgacaagagtatacgtgttatcgtaggaatagaaactaatcgtagtagtacgtagaacgagtacggtctgtctaatcttagtttgttagttttacgatcggtccgtttcggccggtacggtcgttcgtaccggggccgtacgggtccgtcgg

SEQ ID NO: 163894 - DNA, 672 bp, Homo sapiens
  misc_feature: GYAE6OF02GVWVL.47.55.E11.1.454.CMB.1.raw
tcagagctcacgtacacgaccggtgctcgatttagcactcgcacgttgggttttccttgttgctcttttaaaaggtgtccagtgtgaggttcaggtagtggagtccggggggaggcttagttcagcctggggagtccctgagactctcctgtgtagtctctggaatcagtttcagtaccttctggatgcactgggtccgccaaactccaggtaaggggctggtgtgggtctcacgtatcaatcctgatggcagtgttaataaattatgcgactccgtggaggggccgattcagcatctccagagacaacggcaagagtatactgtatctaggaatagaacaatctgagagtcgacgagtacgctgtctatctattgttgttttcgagttcgtccgtttcgggtccggcgggtactttcggtcggggccgacggggaacccgttggtccgacggtccgttcctcccgtcgaccgcccttacccgaaccgtaccgggcccctaggttcccggttccccttaccccccggtgggccccgtccccgttacggtcccctacccggaacggaccgacccctaccccgtccggtaacgaccgacccgtaaccgacgggtccccggtaccccggtcgggcccgttcggcccgtttacggggtaccgaaacggttaccccg

SEQ ID NO: 163895 - DNA, 593 bp, Homo sapiens
  misc_feature: GYAE6OF02H8F4B.47.55.E11.1.454.CMB.1.raw
  modified_base (181)..(181): a, c, t, g, unknown or other
  misc_feature (181)..(181): n is a, c, g, or t
  modified_base (373)..(373): a, c, t, g, unknown or other
  misc_feature (373)..(373): n is a, c, g, or t
tcagagctcacgtacacgaccggtgctcgatttagcactcgcacgttgggtttggggagctgtggtagagaagacaggattcaggacaatctccagcatggccggcttccctctcctcctcaccctcctcactcactgtgcagggtcttgggcccagtctgtgctgactcagcccaccctnagcgtctgggacccccggagacggtcaccatctcttgttctggagcagctccaatatcggaaatgaataatgtatactggtaaccagcaacgtccccacgaaccgcccccaaactcctcatctataacaatgatcagccggccctcgacggggtccctggaccgtattcctcgtggcctcgaagtctggccncctcacgcccacccgtggcccatcgagtcgggcctccggcccgaggatcggaggtctagtattagttactgtagttagggtggtactcgcacgtcctcgacgtgtctttacggtcgttacggacgtcgttgggaacctacggtccgtaacccgttccgtaacgggttaccacggaccccgaacggtaccccctaacccccgtacttccggtccttacccg

SEQ ID NO: 163896 - DNA, 648 bp, Homo sapiens
  misc_feature: GYAE6OF02G5MR2.47.55.E11.1.454.CMB.1.raw
  modified_base (208)..(208): a, c, t, g, unknown or other
  misc_feature (208)..(208): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagcccaccctcagcgtctcgggacccccgggnagacggtcaccatctcttgttctggaagcagctccaatatacggaatgataatgtatactggtaccagcaagtcccaacgaaccgccccaaactcctcatctataacatgatcagccgcctcgacgggtcctggcctattctctcggctccgaagtcgtcggccgtcctcacgccctacccgtcggacccatccgaggtcgggccttcccgggcccgaggacgtcggaacggtctagtaatttacttacgttggttaggttaagggtttggggaacttcggaccgaacggtccgttacggaccgttcgtaccgttttaccggtccgtttaccgggacggtccggttaacgggggaaccctaacgggttccgtaaccccggttccggttacgggttacccgaccggtaaccccggaaccgggtaccccaacccccgtacgg

SEQ ID NO: 163897 - DNA, 752 bp, Homo sapiens
  misc_feature: GYAE6OF02HXI2N.47.55.E11.1.454.CMB.1.raw
  modified_base (278)..(278): a, c, t, g, unknown or other
  misc_feature (278)..(278): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggaggtccgggggagcttagttcagccgtgggagtcctgagactctcctgtgtagtctctggaatctagttttcagttaccttcnggatgctacgtggggtacccacaaacgtccgaaggggtaaggggctgggttgtacgggtcctacgtacgtatactaatcctgatggactagttagttaataaattgtcggacggtacgtcggtgggacgggccgtagttcgaacgtctaatcccgtaccgaaggtacgaaaccgtaacgggaactaaaggttaacggtaattacgtagttaaacgttaccgtaaagggtaaaacctaggtaaaactaacggttacgtaaggtaaggtaaccggttacggaaacggtaacgttaacggggccttaaagtccgtttaaactcgtttaaggttttcggttttttaaccgggttttcggaaactttccgggtacccccggtttttacccggggtacccgggttaccgggggttaaccttttacccgggggtaccggggtaaccccgggttaaccccgggggttaaccccgttcggggg

SEQ ID NO: 163898 - DNA, 675 bp, Homo sapiens
  misc_feature: GYAE6OF02HJPQJ.47.55.E11.1.454.CMB.1.raw
  modified_base (191)..(191): a, c, t, g, unknown or other
  misc_feature (191)..(191): n is a, c, g, or t
tcagagctcacgtacacgaccggtgctcgatttagcactcgcacgttgggtttggggagagaagacaggattcaggacaatctccagcatggccggcttccctctcctcctcaccctcctcactcactgtgcagggtcttgggcccagtctgtgctgactcagccaccctcagcgtctcgggacccccggnagacggtcaccatctcttgttctggaagcagcctaccaaatatacggaaatgaataatgtatacgtggtaccagcaagtcccaacgaaccggaccccccaaactcctcactctaataacaatgatcagccggccctcgacggggtccctggccgtattcgtctggcctaccgaagtctggccgcctcacgcccacccgtgacctagtcaggtcgggccgtcccgggccccgaggactggacggtctagtacttagttacgtggttaggttagggtttggacttccggacgagtccgttagtaccgttcgtaccgttaccgttcgttaccgggagttccggtacgggtaacccgtaacgggttacccacccgggttaccgttaacgggtccgaaccggtacccgaaacccgggtaccccctaaaccccgtccgttacggtacccctacccgtttaccccggttccggttacccccccgtaccccg

SEQ ID NO: 163899 - DNA, 580 bp, Homo sapiens
  misc_feature: GYAE6OF02GSBHJ.47.55.E11.1.454.CMB.1.raw
  modified_base (437)..(437): a, c, t, g, unknown or other
  misc_feature (437)..(437): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactggggtcccgccaaactccgaggtaacggggctggtggtgggtctcacgtatcaatcctgatggcagttgttaataaattatgacggtactccggtaggaggggccgtattcagtcatctacgagagaacaacggcaaagagtatactgtatntaggaaatagaactaatcgtagagacgtacgaacgagtacggtctgttactatactagtttgttagttttcgaattcggtccctttccgggtaccggtccgggttacttcgggtcggggtacccgtacgggaacccgttcggg

SEQ ID NO: 163900 - DNA, 774 bp, Homo sapiens
  misc_feature: GYAE6OF02GUWUC.47.55.E11.1.454.CMB.1.raw
tcagagctcacgtacacgaccggtgctcgatttagcactcgcacgttgggtttggggccgcagccctgggattcccagctgttctgcttgctgatcaggactgcacacagagagctcaccatggagtctgggctgagctgggttttccttgttgcttcttttaaaaggtgtccagtgtgaggtgcaggtagtggagtccggggagtcttagttcagccgtggggacgtccctgacgtacctctccgttgtgttagtcctcgtaggaactcgtagttcagttaccttctggatcgactacgtcgggtccgaccgtaaacgtccgtaagggttaacgggccgtaacggggtaacccttgggtaccacggtccgttaccgtaccgtcgtaacgtccctaccgaaccgtaacgggtcccctaagttccggttcccgtccccgtcggcccgtcccgtcgtacccgtaccgacgggtaccgccgtaacccgtaccggacggtaaccgccgaaccgtacggtcccgggtacccctgggggtacccttcgggacccgttacgggtaacccgtaaacgggttcccctttaaaccgggtttcccggtaaacggttccggtaaaccgttcccggttaaccggtacggggtaacgggtccccggggtaaacgttccggggaaaccgtaaacccgggggtccgtaaaccgtaacggttaagggccttacggaaccgtgtaccgtaccgacgtaatcggtacgtacgtatacgtcggtacctcgtcgg

SEQ ID NO: 163901 - DNA, 604 bp, Homo sapiens
  misc_feature: GYAE6OF02GKA26.47.55.E11.1.454.CMB.1.raw
  modified_base (295)..(295): a, c, t, g, unknown or other
  misc_feature (295)..(295): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagttaccttctggatgcacgtgggtcccnccaaacgtccgaggtaagggctggtgtgggtctcacgtatcaatcctgatggctagtgttaataaattatgcggtactcgtgacggggcctatcagcatctcagagacgaacggcaagtatatactgttatcgtaggaaatgaaactatacgtgagacgtcgaacggtatacggtacgtagtactattacgtagttttggttacggtttttcgaacgtttccggttacccgttttcccgggacccggttaccggggtacctttccggggttaccgggggacccgttaccggggtaacccccgttcgggg

SEQ ID NO: 163902 - DNA, 348 bp, Homo sapiens
  misc_feature: GYAE6OF02HD6H3.47.55.E11.1.454.CMB.1.raw
  modified_base (343)..(348): a, c, t, g, unknown or other
  misc_feature (343)..(348): n is a, c, g, or t
tcagagctcacgtacacgaccggtgctcgatttagcactcgcacgttgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccagcctccaccaagggcccatcggtcttccccctggcgccctgctccaggagcacctccgagagcacagcggccctgggctgcctggtcaaggctacttcctacgtgagctctgagcgggctggcaaggcgcatagnnnnnn

SEQ ID NO: 163903 - DNA, 551 bp, Homo sapiens
  misc_feature: GYAE6OF02HVGSW.47.55.E11.1.454.CMB.1.raw
  modified_base (293)..(293): a, c, t, g, unknown or other
  misc_feature (293)..(293): n is a, c, g, or t
  modified_base (362)..(362): a, c, t, g, unknown or other
  misc_feature (362)..(362): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctgggggagtccctgagactctcctgtgtagtctctggaatcagtttcagtaccttctggatgcactgggtccnccaaactccagggtaaggggctgggtgtgggtctcacgtatcaatcctgatggcagtgttaataaattntgcggactcggtgagggccattcagcatctacagagacacggcaagagtactactgtatctaggaaatgaaactatcgtagagtagtacgaacgtagtacggctagtactatcctagttttgttagttttcgagttcgtccgttcgggtccgcgggttacttccggtggggaccctagggtaccctggg

SEQ ID NO: 163904 - DNA, 676 bp, Homo sapiens
  misc_feature: GYAE6OF02IG2SS.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttcctgttgctcttttaaaaggtgtccagtgtgaggtgcaggtagtggagtccgggggaggcttagttcagccgtggggatccctgacgactctcctgtgtagtctcgtggaatctagtttcagttaccttctggatgcacgtcgggtcccgacctaaacctccgaaggggtaaggggtctgggtggtgggtctacacgtactctaactcctgatggctaagttgtttaaataaagttagtacggacggtacttcgggtaggacgggggtccgtaacgttcgagtactactcctaccgaaggacgaaaccgaaacggactaaaggtaacgttaacttaccgtagttaacttacgtaaggaaactagtaaactaagtcgtaggtagacgtacgaacgtaacgtaccggtctagtactattctagtttcgttacgttttacggacgttcggttcccggtttccgggtacccgggtcggggttaacctttccgggtaccgggggtacccgtaaccggggtaccccgttcgggg

SEQ ID NO: 163905 - DNA, 598 bp, Homo sapiens
  misc_feature: GYAE6OF02FWKIU.47.55.E11.1.454.CMB.1.raw
  modified_base (458)..(458): a, c, t, g, unknown or other
  misc_feature (458)..(458): n is a, c, g, or t
  modified_base (503)..(503): a, c, t, g, unknown or other
  misc_feature (503)..(503): n is a, c, g, or t
tcagagctcacgtacacgaccggtgctcgatttagcactcgcacgtttggggtttgggggccgcacgccctgggattcccagctgtttctgcttgctgatcaggactgcacacagagagctcaccagtggagtctgggcttgagcttgggttttccttgttgcttcttttaaaaggtgtccagtgtgaggtgcaggtagtggaggtccgggggagtcttagttcaggccgtggggactccctgagtactctcctgtgtagtctctggaatctagttcagttaccttctggtatcgctacgtcgggtacccgactaaacgtccgaagggtagggtcttggtggtggtactacacgtatcaagtcctagagtcgcgtagtagttaataagttgtgacgtactccgtggacggtcattcagctactactacgagacgacgaaggcaaagatatactagtanacgtaggaactacgaatactgtagacgtagacgacgtacgtacgntgtactatcttagttgttacgtttgacttcggtcccgttacggtccggtcggttacctttaccgggaccggggtacctaacgggtacccttaggg

SEQ ID NO: 163906 - DNA, 585 bp, Homo sapiens
  misc_feature: GYAE6OF02GZVUL.47.55.E11.1.454.CMB.1.raw
  modified_base (199)..(199): a, c, t, g, unknown or other
  misc_feature (199)..(199): n is a, c, g, or t
  modified_base (238)..(238): a, c, t, g, unknown or other
  misc_feature (238)..(238): n is a, c, g, or t
tcagagctcacgtacacgaccggtgctcgatttagcactcgcacgttgggtttggggagctgtggtagagaagacaggattcaggacaatctccagcatggccggcttccctctcctcctcaccctcctcactcactgtgcagggtcttgggcccagtctgtgctgactcagccaccctcagcgtctgggacccccggnagacggtcaccatctcttgttctggaagcagctccaatntcggaaatgataatgtatactggtaccagcaagtcccacgaaccggcccccaaactcctcatctataacaatgatcagcgccctcgagggtccctggccgattctctcggctccaagtctcggcgcctcacgcccacccgtggcccatccgaggtcgggcctcccgggcccggaggcgtggaggtctgtattattactgttgtagggttgggatcggcagcctgactgtaccgttacgtcgttcggacgtcgtcgggaccgtaacgggtccctacccggttcccgtaagggtacccaacggtaccccggaacggacccccgaacccccacgttaccgtccgtacccg

SEQ ID NO: 163907 - DNA, 663 bp, Homo sapiens
  misc_feature: GYAE6OF02HSSAK.47.55.E11.1.454.CMB.1.raw
  modified_base (304)..(304): a, c, t, g, unknown or other
  misc_feature (304)..(304): n is a, c, g, or t
  modified_base (322)..(322): a, c, t, g, unknown or other
  misc_feature (322)..(322): n is a, c, g, or t
  modified_base (474)..(474): a, c, t, g, unknown or other
  misc_feature (474)..(474): n is a, c, g, or t
  modified_base (502)..(502): a, c, t, g, unknown or other
  misc_feature (502)..(502): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagcggtggtttcgtgtaggctactttaaaaggtgtcagtgtgaggtgcaggtgtggaggtccgggggagcttagtcgagcgtgggacgtccctgagactctcctgtgtagtctgtggaactctagtttcaagtcttcgtggatgactagttcgggcctacctaaacnccgtaagggtaacgggtntggtgtggtctacgtagtactaccaagttccgtagagtggtacctaggttaacttaagttaaattacgtggaccggtacgtccggtagggacggtacgtacgtacgtacgataactcgtaccgaagaaggacaacggacgagtaagtactanaggttattacgaaggaacttagaaaacncttaggaagtaacggtggtaccaaagggtacgtacggttcgttagtacctagttacctaggttttagtttaggtttccacggtttccgtcccggtttcccgggaagtttcccggggtaacttccgggtaccgggggtaaccacccggggttaccttacggg

SEQ ID NO: 163908 - DNA, 600 bp, Homo sapiens
  misc_feature: GYAE6OF02G9ME9.47.55.E11.1.454.CMB.1.raw
  modified_base (218)..(218): a, c, t, g, unknown or other
  misc_feature (218)..(218): n is a, c, g, or t
  modified_base (397)..(397): a, c, t, g, unknown or other
  misc_feature (397)..(397): n is a, c, g, or t
tcagagctcacgtacacgaccggtgctcgatttagcactcgcacgttgggtttgggggggggaagctcagcttcagctgtggtagagaagacaggattcaggacaatctccagcatggccggcttccctctcctcctcaccctcctcactcactgtgcagggtcttgggcccagtctgtgctgactcagccaccctcagcgtctcgggacccccgggnagagggtcactatctcttgttctggaagcagctccaacatacgaaaaaattttgtatactggtatcagcaactcccaggaaccggcccccaaactcctcatgtctaggaataatcagcggccctcgagggtccctgaccgattctctggctccaagtctcggcacctcacgccctcccnggccatcgagtgggcctccgggtcgaggatcggaggctaggtacttattacgttgtcgcagctagtgggtatcgacacggcctcgtccgtaggtccgttaggtttgggggttcggttccggggtaccgggggaacgggtaacccggaacggtccggttacggtaccccggttacccggtacgggttaccgacggtacccccgg

SEQ ID NO: 163909 - DNA, 567 bp, Homo sapiens
  misc_feature: GYAE6OF02F5QO4.47.55.E11.1.454.CMB.1.raw
  modified_base (191)..(191): a, c, t, g, unknown or other
  misc_feature (191)..(191): n is a, c, g, or t
  modified_base (219)..(219): a, c, t, g, unknown or other
  misc_feature (219)..(219): n is a, c, g, or t
  modified_base (337)..(337): a, c, t, g, unknown or other
  misc_feature (337)..(337): n is a, c, g, or t
  modified_base (354)..(354): a, c, t, g, unknown or other
  misc_feature (354)..(354): n is a, c, g, or t
tcagagctcacgtacacgaccggtgctcgatttagcactcgcacgttgggtttggggagagaagacaggattcaggacaatctccagcatggccggcttccctctcctcctcaccctcctcactcactgtgcagggtcttgggcccagtctgtgctgactcagccaccctcagcgtctgggacccccgggnagacggtcaccatctcttgttctggaancagctccaatatcggaaatgataatgtatactggtaccagcaagtcccaacgaaccggcccccaaactcctacatctaataacatgatcagcgccctcgaggggtccctggtcattcnctggctcaagtctggcnctcacgccacccgtgccatcgaggtcgggccgtcccggcccgaggatggaggctgtatttacttactggttggttagggttggatcgcacgcctgactgtcttacggtcgttcggagtcgtacgggaccaaggtccgaccgttccgtaggtccacggaccccaacggaccctaaccccgcttcgtacctacctccgttccgttccccgtcccc

SEQ ID NO: 163910 - DNA, 246 bp, Homo sapiens
  misc_feature: GYAE6OF02FNRHJ.47.55.E11.1.454.CMB.1.raw
  modified_base (240)..(246): a, c, t, g, unknown or other
  misc_feature (240)..(246): n is a, c, g, or t
tcagagctcacgtacacgaccggtgctcgatttagcactcgcacgttgggtttgggggaagaggaagactgacggtcccccaggagttcaggtgctgaggaagagatggaggtggacgtgtcagcacccggctggggcctgtccctggatgcaggctactctagggcacagcggccctgggctgcctggtcaaggactacttcctacgtgagctctgagcgggctggcaaggcgcatagnnnnnnn

SEQ ID NO: 163911 - DNA, 553 bp, Homo sapiens
  misc_feature: GYAE6OF02I0MR0.47.55.E11.1.454.CMB.1.raw
  modified_base (217)..(217): a, c, t, g, unknown or other
  misc_feature (217)..(217): n is a, c, g, or t
  modified_base (244)..(244): a, c, t, g, unknown or other
  misc_feature (244)..(244): n is a, c, g, or t
tcagagctcacgtacacgaccggtgctcgatttagcactcgcacgttgggtttggggggggaagctcagcttcagctgtggtagagaagacaggattcaggacaatctccagcatggccggcttccctctcctcctcaccctcctcactcactgtgcagggtcttgggcccagtctgtgctgactcagccaccctcagcgtctcgggacccccgggnagacggtcaccatctcttgtctggaancagctccaatatcggaaatgataatgtatactggtaccagcaagtcccacgaacggcccccaaactcctcatctataacaatgatcagccggccctcgacggggtccctggccgattctcgtggctccgaagtcctggccgtcctcacgcccacccgtggccctatcaggtcgggcctcccgggcccgaggactggacgctgatttatacgtgtgtaggttggatcgcagcctgactgtctttacgtcgttcgggacgtcgtagggaacctaaggtccaccggttccgtaggcctacggccctaaccgg

SEQ ID NO: 163912 - DNA, 582 bp, Homo sapiens
  misc_feature: GYAE6OF02GOCRV.47.55.E11.1.454.CMB.1.raw
  modified_base (553)..(559): a, c, t, g, unknown or other
  misc_feature (553)..(559): n is a, c, g, or t
  modified_base (561)..(582): a, c, t, g, unknown or other
  misc_feature (561)..(582): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctgggggatccctgagactctcctgtgtagtctctggaatcagtttcagtaccttctggatgcactgggtccgccaaactccacgcctccaccaacgggcccatccggtccttccccctggccacccctcctaccaacgacgccacctcgtcgggggcacgacggccgggtccccgtggggcctcggcccgttcgggtaccgaacggggtaacccttaacccgttttcccgtttaaagttacggtttaacttaacccgtttccgttacgggaacgggtcccgggggccgttacgggggacccgaaacggggccggtaccaaaggttaacggcgnnnnnnngnnnnnnnnnnnnnnnnnnnnnn

SEQ ID NO: 163913 - DNA, 789 bp, Homo sapiens
  misc_feature: GYAE6OF02IRTE0.47.55.E11.1.454.CMB.1.raw
  modified_base (191)..(191): a, c, t, g, unknown or other
  misc_feature (191)..(191): n is a, c, g, or t
tcagagctcacgtacacgaccggtgctcgatttagcactcgcacgttgggtttggggagagaagacaggattcaggacaatctccagcatggccggcttccctctcctcctcaccctcctcactcactgtgcagggtcttggcccagtctgtgctgactcagccaccctcagcgtctcgggacccccgggnagacggtcaccatctcttgttctggaagcagctccaatatcggaaatgataatgtatactggtaccagcaagtcccaacgaacgcccccaaatcctcatctataacaatgatcagccgcctgacgggtccctggcctattcctcgtcggctaccgaagttcgtcggccgtcccttacgaccggtcccctaacccgttgggacccctaagttaccgacgggtttccgggacccgtcccgggacccccggaagggtaacgttcggaacgggtcttagggtaactttacgttaccgttggttacgggttacggggtttacgggacgtttaccggaccgtaacgggtcccgttacggtaaccgttccgggttacccgtttttaacccgggttccgtttaccggggtacgttcccgggtttacgggggaaaccccttaaacggggtttccccgaaccccggggtttacccgttaacgggggttacccctaaccccgggtaaccccgtaaacccgggtaccccccctaaaacccccggttaccgtttcggttacccccttaaccgtttccccggtttacccggtttaaccccccggttcccccc

SEQ ID NO: 163914 - DNA, 569 bp, Homo sapiens
  misc_feature: GYAE6OF02IL8FB.47.55.E11.1.454.CMB.1.raw
  modified_base (206)..(206): a, c, t, g, unknown or other
  misc_feature (206)..(206): n is a, c, g, or t
  modified_base (354)..(354): a, c, t, g, unknown or other
  misc_feature (354)..(354): n is a, c, g, or t
tcagagctcacgtacacgaccggtgctcgatttagcactcgcacgttgggtttggggcagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccggnagacggtcaccatctcttgttctggaagcagctccaatatcggaaatgataatgtatactggtaccagcaacgtcccaacgaaccggcccccaaactcctacatctataacatgatcagcgccctgacggggtccctggcctattccncgtcggctaccaagtcctaggccgccctcgacgcccacccgtggcccagtccaggtcgggcctccgggcccgaggactggacggctgaatttagttactgttggtagggttgggtactcgctagccctgtacctgtaccttacggtcgttcggagtcgtacgggaacctaggtccgaccgttcgtaggtccaccgaccgaaccggcccaaccccg

SEQ ID NO: 163915 - DNA, 661 bp, Homo sapiens
  misc_feature: GYAE6OF02I00VF.47.55.E11.1.454.CMB.1.raw
  modified_base (584)..(584): a, c, t, g, unknown or other
  misc_feature (584)..(584): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctctttaaaggtgtccagtgtgaggtgcgaggtagtggaggtccgggggagtcgttagttcagccgtggggagtcccgtgagactctctgtgtagtctctggaatctagtttcacgttaccttcgtaggatcgctacgtcggtccgaccaaacgtccggaaggtaacgggcttggtaggtgggtctacgtacgtactcaactccgtagacgtggacgtagttacgtttaaataaagttagtcggtacggtaccgttccgggtagggacgggtccgtaacgttcgacgtactacgttacctaccgaagtaacgaaccgtaacgacgtaaacggtagttaacttacgtagttagtaaccgttaaggtaaaactacgtaaactagtcggtagtaacgaacggtcgaacgtacgtacgcgtagtactagttntacgttagtttcgttacggactcgtaccgttccggccggtacggttaccgttggacgggtcccgacggtccgtacgg

SEQ ID NO: 163916 - DNA, 821 bp, Homo sapiens
  misc_feature: GYAE6OF02JMGMB.47.55.E11.1.454.CMB.1.raw
tcagagctcacgtacacgaccggtgctcgatttagcactcgcacgttgggtttgggggccggcagccctgggattcccagctgtttctgcttgctgatcaggactgcacacagagagctcaccatggagtctgggctgagcgttgggttttccttgttgctcttttaaaaggtgtccagtgtgaggtgcaggtagtggaggtccgggggaggcttagttcagccgtggggagtccctgagactctcctgtgtagtctctggatcgtagtttcagttaccttcgtggtagtgacacgtcggggttcccacctaaacccgtccgaagggtaacggggctcgggttggtcggggttaccgtcgtaccgtacgtacaagttcccgtaggtaagtcgggactaggttagtttaaattaaacgtttagcgtacgggtaccgttccgggtaagggtacgggggtccgtaatttccggaagttccgaatcccgtaccgaggtaacgtaaccgaaacggacgaagtaagtatacgtagttatacgtaggtaaacgtacgtaaactaacgttacgtagggtaacgtaacgggtaccgtaaacggaacgttaccggggtacttaacgggttacccgttaaatttacccgtagtttttacgggttttaccggttttacgggttaagttttcccggggttaacccccggtttaccggggggttacccgggttaaccccgggggttttacccggttttaacccggggggttaccccgggggggtttaacccccgggttaaacccgggggtttaaacccccgggttttaccggggg

SEQ ID NO: 163917 - DNA, 604 bp, Homo sapiens
  misc_feature: GYAE6OF02GGDKW.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaggtgtccagtgtgaggtgcaggtagtggagtccgggggaggcttagttcagcctggggagtccctgagactctcctgtgtagtctctggaatcagtttcagtaccttctggatgcacgtcgggtccgaccaaacgtccgagggtaacggggctgggtggtgggtctcgacgtatcaatcctgatggcagtgttaataaattatgcggtactccggtaggacggggccgtattcgagcatcctcagacgacaacggacaaggtagtatacgtagttagtcgtaggtaaatagaaactatacgtaggaagtacggtacgaacgacgttaaccggcttagtaccttatctagtttggtttggttttcgattcggtcccgtttacgggtcccggcgggttaccttccggtacgggggacccgttacggggtaccccgttggg

SEQ ID NO: 163918 - DNA, 545 bp, Homo sapiens
  misc_feature: GYAE6OF02HF87Z.47.55.E11.1.454.CMB.1.raw
  modified_base (528)..(528): a, c, t, g, unknown or other
  misc_feature (528)..(528): n is a, c, g, or t
tcagagctcacgtacacgaccggtgctcgatttagcactcgcacgttgggtttgggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgaccaaactccaaggtaaggggctgggtgtgggtctcacgtatcaatcctgatggcagtgttaataaattatgcggactccgtggaggggccgattcagcatctccagagacaaacggcaaagagtaatactgtatctaggaaatgaaacaatctagagagtcgacgatacggctgtactatctaatttggttgttttacgattcgtaccgttcggtccgcggggtacttccggnggggccagggtaacccg

SEQ ID NO: 163919 - DNA, 605 bp, Homo sapiens
  misc_feature: GYAE6OF02HSDDI.47.55.E11.1.454.CMB.1.raw
  modified_base (191)..(191): a, c, t, g, unknown or other
  misc_feature (191)..(191): n is a, c, g, or t
  modified_base (364)..(364): a, c, t, g, unknown or other
  misc_feature (364)..(364): n is a, c, g, or t
tcagagctcacgtacacgaccggtgctcgatttagcactcgcacgttgggtttggggagagaagacaggattcaggacaatctccagcatggccggcttccctctcctcctcaccctcctcactcactgtgcagggtcttgggcccagtctgtgctgactcagcccaccctcagcgtctcgggaccccggnagacggtcaccatctcttgttctggaagcagctccaatatcggaaatgataatgtaatactggtaccagcaacgtccaacgaaccgccccaaactcctcatctaataacaatgatcaggcggccctcgacggggtccctggccgtattctcgtggcctaccgaagtctggccncctcacgccacccgtgccatcgaggtcgggccgtccggcccgagacgtggacgctagtacttattacgtgttggtaggttgggatcgacgagtaccgtgtactcgtacgttacgtcgttcggacgtcgtacggaaccgtaacggtccacccggttaccgtacgggtaccaccggaaccccgaaccggacccctaaccccgaccttcggtaccctaccgttaccttcccgttccccctcccc

SEQ ID NO: 163920 - DNA, 549 bp, Homo sapiens
  misc_feature: GYAE6OF02F53FI.47.55.E11.1.454.CMB.1.raw
  modified_base (199)..(199): a, c, t, g, unknown or other
  misc_feature (199)..(199): n is a, c, g, or t
  modified_base (343)..(343): a, c, t, g, unknown or other
  misc_feature (343)..(343): n is a, c, g, or t
  modified_base (362)..(362): a, c, t, g, unknown or other
  misc_feature (362)..(362): n is a, c, g, or t
  modified_base (366)..(366): a, c, t, g, unknown or other
  misc_feature (366)..(366): n is a, c, g, or t
  modified_base (540)..(540): a, c, t, g, unknown or other
  misc_feature (540)..(540): n is a, c, g, or t
tcagagctcacgtacacgaccggtgctcgatttagcactcgcacgttgggtttggggagctgtggtagagaagacaggattcaggacaatctccagcatggccggcttccctctcctcctcaccctcctcactcactgtgcagggtcttgggcccagtctgtgctgactcagccaccctcagcgtctgggacccccggnagacggtcaccatctcttgttctggaagcagctccaatatcggaaatgataatgtatactggtaccagcaagtccccacgaaccggcccccaaatcctcatctataacaatgatcagcgccctcgaggggtccctggccattcncgtggctccaagtctggcncctnacgccaccctggcccatcagtcgggcctcccgggcccgaggatggacggtctgtactttattacgttgttggttagggttgggatcgctacgccgtgactgtccttacgtcgttcggagcgtagggaccaaggtcctaccgttcgtacggtcacgcccaacggcccaaccccgntcgcctacg

SEQ ID NO: 163921 - DNA, 531 bp, Homo sapiens
  misc_feature: GYAE6OF02H63XH.47.55.E11.1.454.CMB.1.raw
  modified_base (395)..(395): a, c, t, g, unknown or other
  misc_feature (395)..(395): n is a, c, g, or t
  modified_base (443)..(443): a, c, t, g, unknown or other
  misc_feature (443)..(443): n is a, c, g, or t
tcagagctcacgtacacgaccggtgctcgatttagcactcgcacgttgggtttggggggaagaggaagactgacggtcctgccacaggtggtgctgggcacggtgggcactcgacacaacatttgcgctcaactgtcttgctcaccatggagtctgggctgagctgggttttccttgttgctcttttaaaaggtgtccagtgtgaggtgcaggtagtggagtccgggggaggcttagttcagcctggggagtcctgagactctcctgtgtagtctctggaatcagttttcagtaccttctggatgcacgtgggtccgaccaaacgtccaggtaaggggctggtgtgggtctcgacgtatcaattcctgatggcagtgtataaattatgcgatcgngagggcgattcagcatctcaagagacaacggcaagagtatactgtatntaggaaatgaaacaatctagagagacgacgatacggctagtctattcatttgtgtttcgagttcgtccgttcggtcccggtggtaccg

SEQ ID NO: 163922 - DNA, 585 bp, Homo sapiens
  misc_feature: GYAE6OF02F20SL.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtatctggaatcagtttcagtaccttctggatgcacgtgggtccaccaaactccgaggtaaggggctggtgtgggtctcgacgtatcaatcctgatggcagtagttaataaattagtgacggtactcggtggacgggccgtagttcagtcactctccgagacgacgaacgcaagagtactactgtatcgaggtaaatagaaactatctaggaagacgtacgaacgtagtacggcttggtactagtctagtttggttacgtttcgacgttcggtcccgtttccggtaccggtcgggttaccttcgggtacggggacccgtacggggtacccgttcggg

SEQ ID NO: 163923 - DNA, 808 bp, Homo sapiens
  misc_feature: GYAE6OF02I4YWW.47.55.E11.1.454.CMB.1.raw
  modified_base (266)..(266): a, c, t, g, unknown or other
  misc_feature (266)..(266): n is a, c, g, or t
  modified_base (647)..(647): a, c, t, g, unknown or other
  misc_feature (647)..(647): n is a, c, g, or t
tcagagctcacgtacacgaccggtgctcgatttagcactcgcacgttgggtttgggagcttcagctgtggtagagaagacaggattcaggacaatctccagcatggccgcttccctctcctcctcaccctcctcactcactgtgcgaggtcgttcggccagtctgtgctgactcacgcccacctcacgcgtcgccgggaccccggcacggacggtccaccatccgttctttgttcgtaggaacgtcacgtactaccaatacgtaanccgggaaaattagagtaaatcgttagtaactgggtacccaagtcccaaagtaccccgacccgtaaaacggcccccctaaaactaccgtcctaaattaacccgtaaattaaaccgaaacttccgaaacgttaccgaaccgtaccgggaaccccgtttaccgaacgggggttcccccttaagggtaccccgtaacgtttccgtaccgttaccgggtaaccttaccgtaaacgggttcccgttaccgggacccgtacccgttacccgaaaccggtcccgtaaccccgtaacgggtacccgtaacgttaccggaccggttaccgggtacccgtaccgggtacccggtaacggtaacggtacggtaacggtacgttacgttaacgnttacgttaacgttaggttacggttaacgggttacgggtaacgtaccggtaccgtaacgtacccgtacggtaaccgttacgtaccgtttacgtccggttacggtacggtaccgtacggtaccgtacggtaccgtaccgtaccgtaccggtaccgaccgaccg

SEQ ID NO: 163924 - DNA, 651 bp, Homo sapiens
  misc_feature: GYAE6OF02IELUB.47.55.E11.1.454.CMB.1.raw
  modified_base (633)..(633): a, c, t, g, unknown or other
  misc_feature (633)..(633): n is a, c, g, or t
  modified_base (635)..(635): a, c, t, g, unknown or other
  misc_feature (635)..(635): n is a, c, g, or t
  modified_base (637)..(637): a, c, t, g, unknown or other
  misc_feature (637)..(637): n is a, c, g, or t
  modified_base (639)..(639): a, c, t, g, unknown or other
  misc_feature (639)..(639): n is a, c, g, or t
  modified_base (641)..(651): a, c, t, g, unknown or other
  misc_feature (641)..(651): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggtttttccttgttgtcttacgtttttaaaaggtgtccagtgtgaggtgcaggtagtggaggtccgggggaggcttagttcaggccgtggggacgtccctgacgactctccgtgtgtgtctcgtggatctagtttacagttaccttcgtggatgactacgtcgggtacccgacctaaaccgtccgaacgggtaacggggaccgaacggggtaacccgtggtcgacggtccgtcctccctccacgtccctacccgaaccgaaccggccctacgtcccggtcccttcccccgtcggcctcccgtcgccctccgacggacgaccctacccgtccgaagaccgaccgaccgacggcccggtcccgtacgggcctacggtcccggttacggtaccgaaaccggttacccttaaccgttaccccgttagggtacgaccgttccgtcgtacgggcgggcccggggtcgtacgggccgaagggcccgagtaagcggancngncngnnnnnnnnnnn

SEQ ID NO: 163925 - DNA, 853 bp, Homo sapiens
  misc_feature: GYAE6OF02JSR8M.47.55.E11.1.454.CMB.1.raw
  modified_base (126)..(126): a, c, t, g, unknown or other
  misc_feature (126)..(126): n is a, c, g, or t
  modified_base (197)..(197): a, c, t, g, unknown or other
  misc_feature (197)..(197): n is a, c, g, or t
  modified_base (219)..(219): a, c, t, g, unknown or other
  misc_feature (219)..(219): n is a, c, g, or t
  modified_base (232)..(232): a, c, t, g, unknown or other
  misc_feature (232)..(232): n is a, c, g, or t
  modified_base (242)..(242): a, c, t, g, unknown or other
  misc_feature (242)..(242): n is a, c, g, or t
  modified_base (249)..(249): a, c, t, g, unknown or other
  misc_feature (249)..(249): n is a, c, g, or t
  modified_base (271)..(271): a, c, t, g, unknown or other
  misc_feature (271)..(271): n is a, c, g, or t
  modified_base (677)..(677): a, c, t, g, unknown or other
  misc_feature (677)..(677): n is a, c, g, or t
tcagagctcacgtacacgaccggtgctcgatttagcactcgcacgttgggtttggggggggaagctcagcttcagctgtggtagagaagacaggattcaggacaatctccagcatggccgcttccnctctacctcaccctctcactcactgtcgcgaggtccttagggcccagtctgtgcttgactcagccaccctnaggctccgtcgggacccccggnagaccgtcaaccnttctcttgtntcggaancagcctaaccatagtacggaancgtataagtctactacgtggaaccagaccgtaaacgccctaaacggacccgaccccgaaacttcctacgtaacttacctaagttaaaaaccgagtttacgaacgtaccccgtacgaccccgggttaccctaccgggtaacgggggttcccctaacgggttacccggttaacgtttacccgtttccgacgggtttaaccccacgttaaaccggttcccgtacgggtcccgttacctaaccggaaccgtacccccgtaaccgttccggaacctaaccgttacgttacggggtccgggtaaacccgtccccggaccgggtaagttacgttaccgggaagtccgtttaacgtacgtttttaaccgttacgggagggttttaccgtttaaggggttaccgacgttaaccgnggttaaaccccgttcgttaggtaacccggtttagttcccgttttaaaccgggtttccgtcggggggttaaacctttccggggaacccggttttaaaacccgggtcgtttacccccggttaaaccggtttcccgggtaacgtttaaccccggtaccgggtacccccgttaaaaccgg

SEQ ID NO: 163926 - DNA, 745 bp, Homo sapiens
  misc_feature: GYAE6OF02GJQWJ.47.55.E11.1.454.CMB.1.raw
tcagagctcacgtacacgaccggtgctcgatttagcactcgcacgttgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaagggctggtgtgggtctcacgtatcaatcctgatggcagtgttataaattatgcggactccgtgaggggccgattcagcatctccagagacaacggcaagagtatactgtatcgtaggaaatgaacatctgagtagtcgaacgagtacggctagtctactcatttgttgttttacgattcgtcccgtttcgggtccgtcgggtacctttcggtcgggggaccctaaggggtaaccccttgggtccgtaacggtcccggttacccttcccgtaccgaccgtccccttacccgaacccggtaaacggggtccccctaaggttcccccgggtttccccttttacccccccgggtgggtcccccggtccccgttacggtccccgttaccccggaagggtacccgtacccgaaccccggttacccggtaacggaccgtacccgtaaaccggacccggggtaccccggggtccccccggttagggggtaccccgttgggtacccccgggtttagggtaccccgttaaaaacccgggggg

SEQ ID NO: 163927 - DNA, 702 bp, Homo sapiens
  misc_feature: GYAE6OF02IX128.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagcgtggtttcgtgtaggctctttaaaggtgtcagtgtgaggtgcaggtgtggaggtccggggaggcttagtcagccgtggggatccctgagctctcctgtgtagtctctggaatctagtttcagttaccttgtggacttcgcgtacgttcggggtaccccgacctaaaacgtccggaaggggttaacggggcttgggtggtagggtcctacgtaacgtatcgaattccgtagagtcggatagttagtttaaataaatttgcgggtacggtaaccgttccgggtaggacgggggtacccgtatttaccgacgctaacttccgtaccgaaggtaacgaaccgtaaccgggactaaaggtaacgttagtacctagttactacggtaagaaattacgaaactagtagtacggagtaacgacgaacgaacgttacgggtcttaacggtctaacgttcgttagttttcggtttacgtcgttccggtccggtttcccgggtacccggttaacgggtttccttacggggtacccgggtacccgtaacggggttaacccccgttgggtacccg

SEQ ID NO: 163928 - DNA, 646 bp, Homo sapiens
  misc_feature: GYAE6OF02GNWI8.47.55.E11.1.454.CMB.1.raw
  modified_base (201)..(201): a, c, t, g, unknown or other
  misc_feature (201)..(201): n is a, c, g, or t
  modified_base (230)..(230): a, c, t, g, unknown or other
  misc_feature (230)..(230): n is a, c, g, or t
tcagagctcacgtacacgaccggtgctcgatttagcactcgcacgttgggtttggggagcgtgtggtagagaagacaggattcaggacaatctccagcatggccggcttccctctcctcctcaccctctcactcactgtgcagggtcttgggcccagtctgtgctgactcagcccaccctcagcgtctcgggacccccggnagacggtcaccatctcttgttctaggaancagctacaaatctacggaaatgataatgtaattactacggtaaccagtacgaacgtcccacgaaccggaccccccaaatccctcactactaactaactaatgactcgacgcggtaccctgacgggttcccctggtaccgattccgtacgtcggcctaccgtaagttcgtcggccgtcctcgacgccctacccgtgtacccatccgagtccgggccgtcccggacccggtagtagacggaggtcctagtatttacgttacgttggttagttagggtggtacgtcgacgtgtccgtagtacgttcgtacgtttaccgtcgttacggcggtaccgtacggggaacctacggtaccgtaccgttccgtaacggtaccaccggtacccgaacggtaccccaaccctgttaccgcctacccg

SEQ ID NO: 163929 - DNA, 615 bp, Homo sapiens
  misc_feature: GYAE6OF02GJOJX.47.55.E11.1.454.CMB.1.raw
  modified_base (171)..(171): a, c, t, g, unknown or other
  misc_feature (171)..(171): n is a, c, g, or t
  modified_base (191)..(191): a, c, t, g, unknown or other
  misc_feature (191)..(191): n is a, c, g, or t
  modified_base (214)..(214): a, c, t, g, unknown or other
  misc_feature (214)..(214): n is a, c, g, or t
  modified_base (219)..(219): a, c, t, g, unknown or other
  misc_feature (219)..(219): n is a, c, g, or t
  modified_base (347)..(347): a, c, t, g, unknown or other
  misc_feature (347)..(347): n is a, c, g, or t
  modified_base (367)..(367): a, c, t, g, unknown or other
  misc_feature (367)..(367): n is a, c, g, or t
tcagagctcacgtacacgaccggtgctcgatttagcactcgcacgttgggtttggggagagaagacaggattcaggacaatctccagcatggccggcttccctctcctcctcaccctcctcactcactgtgcagggtcttgggcccagtctgtgctgactcagccaccctnagcgtctcgggacccccggnagacggtcaccatctcttgttcnggaancagctaccaatatacggaaatgaataatgtaatactggtaccagcaacgtcccaacgaaccggcccccaaactcctacatctaataacaatgatcacgccggcctcgacggggtcctggccgtattcnctggctacgaagtctggccncctcacgccacccgtggccagtcaggtcgggccgtccggacccggaggagtcggacggtctgtaacttacttacgtggtggttagggttggactcgctacgtccgtgactgtccgtttaccgtcgttcgggagtccggtacggaaccgtaacggtcctaccggttaccgtaggtcccaaccggacccgtaaaccggtaccccaacccgtcgttcgtaccctaccgttccgttcccgtccccgtccccg

SEQ ID NO: 163930 - DNA, 795 bp, Homo sapiens
  misc_feature: GYAE6OF02H6CEQ.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgcttcttttaaaaggtgtccagtgtgaggtgcaggtagtggaggtccgggggaggcttagttcaggccgtggggacgttcccgtgagacctctccgtgtgcacgcctctggcttctaccttacaattaattatcgtacttagtgcgtaggttcggggtcccgtccgacggtcctaccgaggtacggaaggggtctagggtagggttggggtcgggtcggtactattacgtccgtccgaggtacggactacgttctttacgaagtttacttaccggacaacggtaccttaccccggtagggaccgggggttcccgtaagtttaccccgaacccgttacgttccccgtaacccggaaacggtaaacgtaaccctaaaacccgttttacccgaaaccggttaaaacccgtaccgggttttaccttaaacttcccgttaacgtaccccgtaacccgttacggaaccctaaccggccgttaaccggaaacgtaaccggtacgtaaacccggtacctaacccgtttacctttacccttaccgtttaacccgttacggttacggtaccggtaaccggtaagggtaagttaaccgggtttacggaacccggttaagtttacggttaacggtttcgggtacgtaaccgg

SEQ ID NO: 163931 - DNA, 661 bp, Homo sapiens
  misc_feature: GYAE6OF02HPNX7.47.55.E11.1.454.CMB.1.raw
  modified_base (186)..(186): a, c, t, g, unknown or other
  misc_feature (186)..(186): n is a, c, g, or t
  modified_base (206)..(206): a, c, t, g, unknown or other
  misc_feature (206)..(206): n is a, c, g, or t
  modified_base (371)..(371): a, c, t, g, unknown or other
  misc_feature (371)..(371): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctnagcgtctggggacccccggnagacggtcaccatctcttgttctggaagcagctccaatatcgaaatgataatgtatactggtaccagcaagtcccacgaaccggcccccaaactcctcatctataacaatgatcagcggccctcgacgggtccctggccgattctcgtcggctcaagtctggccncctcacgcccacccgtcgcccactcgaaggtcggggccttcccgggacccggtacgggaagtcggagggtcttaggtacttttaagttacgttaggttacgggttagggtttgggggtaacgttccggcgtaacggtcccgttcgggtaacgttcggtaccgtttaccggttccgtttacggggacggttccggtacgggggaacccgtaacgggtacccgtacccggttcccggttaacgggtccggtaaccggccccgtaaacgggaccccctaacccccgtacccgg

SEQ ID NO: 163932 - DNA, 632 bp, Homo sapiens
  misc_feature: GYAE6OF02FNDGX.47.55.E11.1.454.CMB.1.raw
tcagagctcacgtacacgaccggtgctcgatttagcactcgcacgttgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaagggctggtgtgggtctcacgtatcaatcctgatggcagtgttataaattatgcggactccgtgaggggccattcagcatctccagagacaacggcaagagtatactgtatctaggaaatgaaacatctagagagtcgacgatacggctgtctaatcatttgttgttttcgagttcgtcccgtttcgggtccgtcgggtactttcgtcggggtacccgacgggtaacccgtcgggtccgacggtcgtccgttcctcgtacgtcccctacccgaacccgtaaccgggcccctacgttccggttccctttcccccgtcggtcccgcccgttcgccgtcccgacggacgtccgaccgtccggtcggggccaccggcggcccggcccgtcgggccgtccggtccgtcggtaccgaacggtaccc

SEQ ID NO: 163933 - DNA, 785 bp, Homo sapiens
  misc_feature: GYAE6OF02FYFLR.47.55.E11.1.454.CMB.1.raw
  modified_base (206)..(206): a, c, t, g, unknown or other
  misc_feature (206)..(206): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctcgggacccccggnagacggtcaccatctcttgttctggaagcagctaccaatatacggaaatgaataatgtatacgtggtaccagcaagtcccaacggaaccgacccccaaactcctcactctaataacaatgatcacgccgccctagacggggtccctggcccgtattcctcgtcggtacctaccgtaaagttccgtcggccgtcccttaccgacggaccccacccgttcgggaccctaacgtccgtaacggggtttccggggcccgttaccccgggggacccggtaaaggggtaacgttcgggaaccgggttacctaggtttaaacgttttaacggtttaaccgttggtttaggggtttaacgggggtttacgggaaacgtttcccggaacgttaaccggtccccgttaaggtaacccgtttcggtacccgtttttaacggtcccggtttacggggaacggtaccggtttaacgggggaaaccccgtttaaacggggttacccccgttaaccggttaacccgttaacggggttacccgtaaaccgggaccccccggtaaaaccgggtaccccctaaacccccgttaccgg

SEQ ID NO: 163934 - DNA, 558 bp, Homo sapiens
  misc_feature: GYAE6OF02H87PR.47.55.E11.1.454.CMB.1.raw
  modified_base (368)..(368): a, c, t, g, unknown or other
  misc_feature (368)..(368): n is a, c, g, or t
  modified_base (415)..(415): a, c, t, g, unknown or other
  misc_feature (415)..(415): n is a, c, g, or t
  modified_base (499)..(499): a, c, t, g, unknown or other
  misc_feature (499)..(499): n is a, c, g, or t
  modified_base (531)..(531): a, c, t, g, unknown or other
  misc_feature (531)..(531): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtgggagtccgggggaggcttagttcagcctggggatccctgagactctcctgtgtagtctctggaatcagtttcagtaccttctggatgcacgttggggtcccaccaaactccgagggtaacggggctggtgtggtctcgacgtatcaatcctgatggcagttgttaataaagttngcgactcggtagaggggcctatcgagtcatctccagacgacaacggnaaagagtatacgtgtatcgtaaggaaattagaaactaattctagaagtagacgacgagtacgctgactatctatttgtttacgnttcggtccgttccggtccgcgggtacttcggnggggtacccacgggtaccctggtaccg

SEQ ID NO: 163935 - DNA, 606 bp, Homo sapiens
  misc_feature: GYAE6OF02IFBQX.47.55.E11.1.454.CMB.1.raw
  modified_base (209)..(209): a, c, t, g, unknown or other
  misc_feature (209)..(209): n is a, c, g, or t
  modified_base (381)..(381): a, c, t, g, unknown or other
  misc_feature (381)..(381): n is a, c, g, or t
tcagagctcacgtacacgaccggtgctcgatttagcactcgcacgttggggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctcggggacccccgggnagacggtcaccatctcttgttctggaagcagctccaatatcggaaatgataatgtatactggtaccagcaacgtcccacgaaccggcccccaaactcctacatctaataacaatgatcagccgtccctgacggggtccctggccgtatttctcgtggctccaagtctggccncctcacgcccacccgtggcccatcgacggtcgggcccgtccgggcccgaggtacgtggacggtctagtaatttacttacgtgttaggttgggtgggtatcggcgacgtccgtagtcgtgtaccgttacgttcgttacgggacgtcggtacgggtaccctaagggttcccaccggttaccgtacggtaccgaccgtaccccggaacggaccccctaacccgtaccg

SEQ ID NO: 163936 - DNA, 679 bp, Homo sapiens
  misc_feature: GYAE6OF02H2EMY.47.55.E11.1.454.CMB.1.raw
  modified_base (551)..(551): a, c, t, g, unknown or other
  misc_feature (551)..(551): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagcgttgggttttccttgttgcttacttttaaaaggtgtccagtgtggaggtgcaggtagtggaggtccgggggaggcttagttcagccgtggggacgtccctgagactctcctgtgtagtctctggaatctagtttcacgtaccttctggtatcgctacgttcgggtcccgaccaaaccgtccgaagggtaaggggcgttgggtggtgggtctcgtaacgtatacactctgatggctagttagttaattaaagtatacggcggtacgtaccggtggaacggggcgtatcgagctatcctacgaagaacgacgaaacggacaaaggtatagtaacgttgtaagttacgtaaggtaaatacgaaactaagtacgtaggtaacggaagtaccgaacgtaacgtacggtcttacgtnttaacttacgttaggtttcgttttaggtttacgttacgttccggttacccggtttcccggttacccgggtacgggtttaccggttccggggttaaccgggggacccggtaccggggttacccgtcggg

SEQ ID NO: 163937 - DNA, 623 bp, Homo sapiens
  misc_feature: GYAE6OF02F4TZZ.47.55.E11.1.454.CMB.1.raw
  modified_base (519)..(519): a, c, t, g, unknown or other
  misc_feature (519)..(519): n is a, c, g, or t
tcagagctcacgtacacgaccggtgctcgatttagcactcgcacgttgggtttggggagccgcagccctgggattcccagctgtttctgcttgctgatcaggactgcacacagagagctcaccatggagtctgggctgagctgggttttcctgttgctcttttaaaagtgtccagtgtgaggtgcaggtagtggaggtccgggggaggcttagttcagccgtggggagtcccgtgagactctcctgtgtagtctctggaatcagtttcagtaccttctggatgcacgtcgggtcccacctaaacgtccgaaggtaaggggctggtgtgggtctcgacgtatcaatcctgatcggctagtgttaattaaagtatggacggacgttccggtggacggggccgtattcgagtaccatccgtaccaaggacgtacaaacgggcaaagacgtactaattgtaacttcgtaagggaaatacggaactaagttcgaagacggtacgtacggaacgtagtaccggtntacgttctagttctagttttggtttcggttttagacgttccgtcccgtttcgggcccgtccggggttaccttccgggtacgggggacctaccggggttaacccg

SEQ ID NO: 163938 - DNA, 680 bp, Homo sapiens
  misc_feature: GYAE6OF02G3FAH.47.55.E11.1.454.CMB.1.raw
  modified_base (209)..(209): a, c, t, g, unknown or other
  misc_feature (209)..(209): n is a, c, g, or t
  modified_base (233)..(233): a, c, t, g, unknown or other
  misc_feature (233)..(233): n is a, c, g, or t
  modified_base (318)..(318): a, c, t, g, unknown or other
  misc_feature (318)..(318): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagcccaccctcagcgtctcggggacccccgggnagaccggtcaccatctcttgttcnggaagcagctcaatatcgaaatgataatgtatactggtaccagacaacgtcccacggaaccggacccccaaactcctcatctaanaacaatgatcagccggccctcgacggggtccctggcccgtattctcgtggtcctaccgaaggtctcgggcctcctcgacgccccacccgtcggaccctagtccgtacgggtccggggtcccgtacccgggacccgggtagggtacgtacggaacgggtccgttaggtaacttttaacgttacgtttgggttacgggttaggggtttacggggtacgttcggtaccgacggtcccgtttagtacccgttgtacccgtttaccgtcgtttccgggagtccggttacggggaaccctaacgggtccgtaacccggttccgtaccggtcctaaccggaccccgaacggaccccctaaacccgtccg

SEQ ID NO: 163939 - DNA, 655 bp, Homo sapiens
  misc_feature: GYAE6OF02I7EIH.47.55.E11.1.454.CMB.1.raw
  modified_base (377)..(377): a, c, t, g, unknown or other
  misc_feature (377)..(377): n is a, c, g, or t
tcagagctcacgtacacgaccggtgctcgatttagcactcgcacgttgggtttggggagagaagacaggattcaggacaatctccagcatggccggcttccctctcctcctcaccctcctcactcactgtgcagggtcttgggcccagtctgtgctgactcagccaccctcagcgtctcgggacccccgggcagacggtcaccatctcttgttctggaagcagcctaccaatactacggaaatgataatgtatactgtaccagcaacgtcccaacgaaccgcccccaaactcctacatctaataacaatgtatacgacgccgccctacggacggggtccctggccgtattcgcgtggcctacgaagtccgtcggccnctcacgtcccaccgtggccagtcgaggtcggccgtcccggaccgtaggagtcggaggtcgtagtactttagttacgtggttaggttagggttacgggacttcggaccgtacggtccgtagtacgttcgttaccgtttaccgttcggttcgggacgtacggtaccgggaacctaacgggtcccgtaccggttaccgtacgggtccaaaccggacccgaaaccggccccctaaacccgtcgttacgtacccgtacgttcccgttccgtcccccgtccccg

SEQ ID NO: 163940 - DNA, 759 bp, Homo sapiens
  misc_feature: GYAE6OF02JOTHK.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggaggtccgggggaggcgttagttcaggccgtgggggagtcccgtgagactcctccgtgtgtagtctcgtggaatcgtagtttcagttaccttcgtggatgctacgtcgggtcccgaccaaaccgtcgaggtaacgggccgtgggtgtcgggtctcgtacgtactacaacttccgtagactggcgtagtagtttaagtaattagtcgacggtacgtcggtaggacggggtaccgagttcgacgtctaacgttccgtaccgaagtaacggaaccgtaaccggacaaaggtaacgttaacgttaacgttacggttaattaccggttaagggtaaacttaacggtaaacctaaagttaccgtaagggtaaacgtaacggtaccggaaaaccggttacgttaaccgggtacgttacgttaccgttaagttaccgttaagtttttcggttttaacggtaacggtttacggttaccccggtttaaccggggtacccgttaccggggtttaccgttaccgggttaccgggggtacccgttaaccgggggttaacccgtttcgggttaacccgg

SEQ ID NO: 163941 - DNA, 586 bp, Homo sapiens
  misc_feature: GYAE6OF02I3O1O.47.55.E11.1.454.CMB.1.raw
  modified_base (206)..(206): a, c, t, g, unknown or other
  misc_feature (206)..(206): n is a, c, g, or t
  modified_base (246)..(246): a, c, t, g, unknown or other
  misc_feature (246)..(246): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctcgggacccccggnagacggtcaccatctcttgttctggaagcagctccaatancgaaatgataatgtatactggtaccagcaagtccccaacgaaccggcccccaaactcctcatctataacaatgatcacgcggccctgacggggtccctggcccgtatttcctctgggcctacccgtaagtcctgggcccgtacctccaacgccccacccgtcggccctatccaggtcgggccgtcccgggacccgaggtactggacggctgtaatttactactggtcgtaggttggattcgcagtcctagaccgtgtcgttacgtcgtcggtacgcgtcgggacctaggtcctaccggttccgtacggtccgacgacccgtaacggacccaacccctacg

SEQ ID NO: 163942 - DNA, 577 bp, Homo sapiens
  misc_feature: GYAE6OF02JES5W.47.55.E11.1.454.CMB.1.raw
  modified_base (191)..(191): a, c, t, g, unknown or other
  misc_feature (191)..(191): n is a, c, g, or t
  modified_base (316)..(316): a, c, t, g, unknown or other
  misc_feature (316)..(316): n is a, c, g, or t
  modified_base (326)..(326): a, c, t, g, unknown or other
  misc_feature (326)..(326): n is a, c, g, or t
  modified_base (334)..(334): a, c, t, g, unknown or other
  misc_feature (334)..(334): n is a, c, g, or t
  modified_base (401)..(401): a, c, t, g, unknown or other
  misc_feature (401)..(401): n is a, c, g, or t
  modified_base (441)..(441): a, c, t, g, unknown or other
  misc_feature (441)..(441): n is a, c, g, or t
tcagagctcacgtacacgaccggtgctcgatttagcactcgcacgttgggtttggggagagaagacaggattcaggacaatctccagcatggccggcttccctctcctcctcaccctcctcactcactgtgcagggtcttgggcccagtctgtgctgactcagccaccctcagcgtctcgggacccccggnagacggtcaccatctcttgttcaggagcagctaccaatatcggaaatgataatgtatactggtaccagtcaagtcccaacggaacgcccccaaatcctacatctataacaatgatcacgcgcccngacgggtccngcgattcnctcggctaccagtctggcctctcagcccacctggccatcacggtcggccgtccggacccgaggtacncgaggtctagtattacttcgtagttggtacggtgggtacncgacgacgtcgtgacgtgtcgttacgtcgtcgagtaccgtacggaaccgtagtcctaccgttcgtacggtacaccggacccgtaaccgacccctaaccctcgtacgttcctaccgttccgttcccgttccccgtcc

SEQ ID NO: 163943 - DNA, 624 bp, Homo sapiens
  misc_feature: GYAE6OF02IT96P.47.55.E11.1.454.CMB.1.raw
  modified_base (170)..(170): a, c, t, g, unknown or other
  misc_feature (170)..(170): n is a, c, g, or t
  modified_base (290)..(290): a, c, t, g, unknown or other
  misc_feature (290)..(290): n is a, c, g, or t
  modified_base (603)..(603): a, c, t, g, unknown or other
  misc_feature (603)..(603): n is a, c, g, or t
  modified_base (606)..(606): a, c, t, g, unknown or other
  misc_feature (606)..(606): n is a, c, g, or t
  modified_base (608)..(608): a, c, t, g, unknown or other
  misc_feature (608)..(608): n is a, c, g, or t
  modified_base (617)..(617): a, c, t, g, unknown or other
  misc_feature (617)..(617): n is a, c, g, or t
  modified_base (623)..(623): a, c, t, g, unknown or other
  misc_feature (623)..(623): n is a, c, g, or t
tcagagctcacgtacacgaccggtgctcgatttagcactcgcacgttggggtttgggggccgcagccctgggattcccagctgttctgcttgctgatcaggactgcacacagagagctcaccatggacgtctgggctgagctgggttttcctgttgctcttttaaaaggngtccagtgtgagtgcaggtagtggagtccggggagcttagttcagcctggggagtccctgagactctcctgtgtagtctctggaatcagtttcagtaccttctggactgcactcggtccncaactccaggtaaggggccagggaccctggtcacgcgtctcctcacgcctaccgaccaacgggcccagtccggtcttccccgtggccgcccgtagcctaccaggacgaccacctccgagacgaccacgacggccggacccttggggcctacgggtcccgttaggggtaacctaaacgggttaccctttaaccgttcccggtaacggttacggaacggtcccttaacggttacggaaaccgggtcccggggtacccgttagggacccgtaaaacggggtcccgaccgaaggttaccgagcgtaccgagacgtancgngngcgcgacgngcgcgnc

SEQ ID NO: 163944 - DNA, 622 bp, Homo sapiens
  misc_feature: GYAE6OF02FSJNT.47.55.E11.1.454.CMB.1.raw
  modified_base (199)..(199): a, c, t, g, unknown or other
  misc_feature (199)..(199): n is a, c, g, or t
  modified_base (223)..(223): a, c, t, g, unknown or other
  misc_feature (223)..(223): n is a, c, g, or t
  modified_base (228)..(228): a, c, t, g, unknown or other
  misc_feature (228)..(228): n is a, c, g, or t
  modified_base (240)..(240): a, c, t, g, unknown or other
  misc_feature (240)..(240): n is a, c, g, or t
tcagagctcacgtacacgaccggtgctcgatttagcactcgcacgttgggtttggggagctgtggtagagaagacaggattcaggacaatctccagcatggccggcttccctctcctcctcaccctcctcactcactgtgcagggtcttgggcccagtctgtgctgactcagccaccctcagcgtctgggacccccggnaggacggtcaccatctcttgttcnggaancagctccaatancggaaatgataatgtatactggtaccagcaagtccccacgaaccggccccccaaactcctcatctataacaatgatcagcgcctgagggtccctggccattcctctggctccaagtctggcgcctcacgcccacctcggcctatccgaggtcgggcctccggcccggaggacgtcggaggtcctaggtaatttacgtacgttggttagtacggggtttagggacgttccggaccgtacggtcccgtggtaccttgggttcctttaccggtccgtttacgggacgtccgtgggaacccgtaacgggttccgacccggttacccgtaacggttccgaccggtaccccaagggtacccccaaccccgacgttccgtcctaacccg

SEQ ID NO: 163945 - DNA, 534 bp, Homo sapiens
  misc_feature: GYAE6OF02FQAC2.47.55.E11.1.454.CMB.1.raw
  modified_base (351)..(351): a, c, t, g, unknown or other
  misc_feature (351)..(351): n is a, c, g, or t
  modified_base (361)..(361): a, c, t, g, unknown or other
  misc_feature (361)..(361): n is a, c, g, or t
tcagagctcacgtacacgaccggtgctcgatttagcactcgcacgttgggtttggggagccgcagccctgggattcccagctgtttctgcttgctgatcaggactgcacacagagagctcaccatggagtctgggctgagctgggttttcctgttgctcttttaaaaggtgtccagtgtgaggtgcaggtagtggagtccgggggaggcttagttcagcctggggagtccctgagactctcctgtgtagtctctggaatcagtttcagtaccttctggatgcacgtgggtccgaccaaactccgaggtaagggctggtggtgggtctcgacgtatcaatcctgatgcagtnttaataattntgcgactcgtgagggccatcgagcactctacgagagacgaacggacaagagtatactgtatacgtagaatgaaactatcagagagtacgaacgtagtacggctgtactatctagttgttgtttgatcgtccgttcggtccgcggtaccttcggtcgggtaccgacgggtaccg

SEQ ID NO: 163946 - DNA, 604 bp, Homo sapiens
  misc_feature: GYAE6OF02FOFC0.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccgaggtaagggctggtgtgggtctcgacgtatcaatccgtgagtgactagttgttaattaattgaggacgtactcggtggacgggtctattcgacgtactactccacgagacgaacgacggacaagtatactatagtatgtaagtaatagaaactagtacgtagaaggtagtacgaagtacgtacggtactagttacgtacttcttagtttcgtttacggtattccgtcccggttccggttacccggaccggtttaccgttccgggtccgggtaacccggaccgggttacccgtggtaacccgg

SEQ ID NO: 163947 - DNA, 726 bp, Homo sapiens
  misc_feature: GYAE6OF02IH5B8.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggttttccttgttgcttacgttttaaaaggtgtccagtgtggaggtgcaggtagtggaggtccgggggaggtcgttagttcagccgtggggagtcccgtgagactctcctgtgtagtctcgtggaatctagtttcacgttaccttcgtggatggacctacggtcgggtacccgacccaaaccgtccggtaagggtaacggggcgttgggtggtcggttcctcgtacgtatacgaactcgtgagtggactagtgttaataaattcgaggtaccgtacgttcggtaggtacggggtacctagttacgacgtctactaccgtacgaagaacggaacgtaaccggtaacgtaaggtaacgttaacgtaacgttagttaacgttacgtaacgtaaaacgtaacgtaaacgtaacgttaccgtaagtaacgtaacggttaaccggacgttaacgtacgggttccttaagtccgttaagtacctagtttacggtttcgtttaacggtaacgtttccggtcccggttaccgggttccggtacgggtaaccgttccggtaacggggtcccgtaccggggtaccgttaccggg

SEQ ID NO: 163948 - DNA, 712 bp, Homo sapiens
  misc_feature: GYAE6OF02HOVTE.47.55.E11.1.454.CMB.1.raw
  modified_base (268)..(268): a, c, t, g, unknown or other
  misc_feature (268)..(268): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagcgtggtttcctgtagctctttaaagtgtcagtgtgaggtgcaggtagtggagtccggggagcttagttcagcctggggagtccctgagactctcctgtgtagtctctggaatctagttcagtaccttcnggatgcactcgggtccacctaaactccgaggtaacggggctgggtgtgggtctcgacgtagtcaacttccgtagagtggctagttagtttaataaagtttatcggaccggtaacttccgggtagggtacgggggtcccgttagttccgaagtaccacgttacccgtacgaaggaacgtaaccgaaacggtacaaaagggtacgttaacttacgtagttacgtaccgtagggtaaacttaggaaactaacgttcgaaggtaaggtacgtaccggaacggtaacgttaccgggtacgttagttaaccgttacgtttaccgttagttttggttttaccgggtttttacgtacgtttccggttccccggttttacccggggtcccgggttaccggtttacccggttgggttacccgggggacccggtaaccggggtcccgttacgggg

SEQ ID NO: 163949 - DNA, 571 bp, Homo sapiens
  misc_feature: GYAE6OF02FJMAN.47.55.E11.1.454.CMB.1.raw
  modified_base (214)..(216): a, c, t, g, unknown or other
  misc_feature (214)..(216): n is a, c, g, or t
  modified_base (218)..(218): a, c, t, g, unknown or other
  misc_feature (218)..(218): n is a, c, g, or t
  modified_base (220)..(221): a, c, t, g, unknown or other
  misc_feature (220)..(221): n is a, c, g, or t
  modified_base (228)..(228): a, c, t, g, unknown or other
  misc_feature (228)..(228): n is a, c, g, or t
  modified_base (247)..(247): a, c, t, g, unknown or other
  misc_feature (247)..(247): n is a, c, g, or t
  modified_base (254)..(254): a, c, t, g, unknown or other
  misc_feature (254)..(254): n is a, c, g, or t
  modified_base (256)..(257): a, c, t, g, unknown or other
  misc_feature (256)..(257): n is a, c, g, or t
  modified_base (264)..(264): a, c, t, g, unknown or other
  misc_feature (264)..(264): n is a, c, g, or t
  modified_base (267)..(267): a, c, t, g, unknown or other
  misc_feature (267)..(267): n is a, c, g, or t
  modified_base (271)..(271): a, c, t, g, unknown or other
  misc_feature (271)..(271): n is a, c, g, or t
  modified_base (273)..(273): a, c, t, g, unknown or other
  misc_feature (273)..(273): n is a, c, g, or t
  modified_base (275)..(275): a, c, t, g, unknown or other
  misc_feature (275)..(275): n is a, c, g, or t
  modified_base (277)..(278): a, c, t, g, unknown or other
  misc_feature (277)..(278): n is a, c, g, or t
  modified_base (280)..(281): a, c, t, g, unknown or other
  misc_feature (280)..(281): n is a, c, g, or t
  modified_base (283)..(283): a, c, t, g, unknown or other
  misc_feature (283)..(283): n is a, c, g, or t
  modified_base (292)..(292): a, c, t, g, unknown or other
  misc_feature (292)..(292): n is a, c, g, or t
  modified_base (295)..(295): a, c, t, g, unknown or other
  misc_feature (295)..(295): n is a, c, g, or t
  modified_base (309)..(309): a, c, t, g, unknown or other
  misc_feature (309)..(309): n is a, c, g, or t
  modified_base (311)..(311): a, c, t, g, unknown or other
  misc_feature (311)..(311): n is a, c, g, or t
  modified_base (314)..(314): a, c, t, g, unknown or other
  misc_feature (314)..(314): n is a, c, g, or t
tcagagctcacgtacacgaccggtgctcgatttagcactcgcacgttggggatcggcaggcctccgacctggtccttaacggtctttcggagcttggggaccaaggtcaccgtcctaggtcagcccaaggccaaaccccactgtcactctgtttcccggccctcctctacgtggtacgtctctgagttacggggctcggctaaggcgcgatagnnngngnntgggagntgcagctggggcctgagcnctctgcncnnctctgtntcnctcntntntnntnncnctcgcgcgngcncgaggagagtgatntntcngagtatagtaagtagagactaataatatatattatgactaactactagtaggacggatatactactactactactacgtacggactactacaacgaacgacgtactatacttactactacgtaggcgtacgacgagagacgacgtacgacgacgtaccggtacgtagtagttagtacggtggtagggaggtaagggtacggtaggtaggttacgggttaacgggttacgggttacgggtaccgggtacgggtacggg

SEQ ID NO: 163950 - DNA, 601 bp, Homo sapiens
  misc_feature: GYAE6OF02G9FM2.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaactgttggagtctgggggagacttagtacacccgtggggggtccctgagactctcctgtgcagcctctggactcacctttagcaactctgtcagtgggctgggtccgccaggccgtccggggaagggctgggagtgggtctcaagtattgatgagatgggtagaagcaacagttctacgtggacctccggtaggaacggggtcccggttcaaccctatcctccgaagacgaactaatttcgaggagcacgctagtactactaacaagtagaacacgcctagaggacgccggaaggaccgaccgggtaccgttaattacgtttacctggtacgacgtaaacgttcgtaagtacgactacggtcccgacccccgtacgcccgtaccttacctttccgtttcgtcctttaaaccggg

SEQ ID NO: 163951 - DNA, 703 bp, Homo sapiens
  misc_feature: GYAE6OF02H35F7.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggtttccttgttgctcttttaaaaggtgtccagtgtgaggtgcaggtagtggagtccgggggaggcttagttcagcctggggagtccctgagactctcctgtgtagtctctggaatctagtttcagtacctttctggatgcacgttcggtccgaccaaaccgttccgagggtaagggggtctgggtggtgggtctcgacgtatactaatcctgatggctagttagtttaataaattatggacgtactccggttggacggggtccgtagttccgagtctacgtctcccgaagtaacgaaccgtaaacggacgtaaaggtaagtaacttacgttagtaacttaccgtaaggtaaaacttacggaaactaagtccgttaggaaggtacggtaccgaaggtaaccttacgggtacttaggtttcctaatttacgtagtttttacggtttaggttttaccggtaacgtttccggtacccggttttccggggtacccgggttaccgggggtttacctttccgggtaccgggggggtaccctacccggggggtaaccccttaccgggg

SEQ ID NO: 163952 - DNA, 737 bp, Homo sapiens
  misc_feature: GYAE6OF02IZ0SP.47.55.E11.1.454.CMB.1.raw
  modified_base (402)..(402): a, c, t, g, unknown or other
  misc_feature (402)..(402): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgcttcttttaaaaggtgtccagtgtgaggtgcaggtaggtggaggtccgggggaggcttagttcagccgtggggagtccctgacgactctccgtgtgtagtatctggaatctaggtttctagttacctttcgtaggatgcctaacgtcgggtccgaccctaaaacgtcccgagggttaaggggccgtgggtggtcggggtctcgaacgtatcactctagactgcgtagttagtttaactaaattagnggtcggaccgttcgggaggtacgggggccttaagttcaacgtcgtactccgtaaccaacgaagtaaccgtaaacggacgtaaaggagttaaactacgttacgttaaacgttccgttaaaggtaaaactaaggaaaaccctaagtaccgtaaggtaagtaacggtacgaaacggtaacgttaaccggtacgttacgttaaccgttaattacccgttagttttggtttttacgttttacggtaactttacccgggttccgtttacccggggtacccggtacgggtttaccgttaccgggtccggggtaacccgtaaccggggtacccgttaccgggg

SEQ ID NO: 163953 - DNA, 655 bp, Homo sapiens
  misc_feature: GYAE6OF02IJF0O.47.55.E11.1.454.CMB.1.raw
  modified_base (377)..(377): a, c, t, g, unknown or other
  misc_feature (377)..(377): n is a, c, g, or t
tcagagctcacgtacacgaccggtgctcgatttagcactcgcacgttgggtttgggggcccgcagccctgggattcccagctgtttctgcttgctgatcaggactgcacacagagagctcaccatggagtctgggctgagctgggttttcctgttgctcttttaaaaggtgtccagtgtgaggtgcaggtagtggagtccgggggaggcttagttcagccgtgggggagtccctgagactcctcctgtgtagtctcgtggaatcagtttcagttaccttctggatgcacgtgggtcccgaccaaactccgagggtaaggggctgggtgtggggtctcacgtatcaatcctgatggctaagttgtttaaataaagttntcggacggtactccggtaggacgggggccattcgagtctactcctaccgaagacgtaaccgaacgggtacaaaaggtataaagttactagttactacgttaaggaaatacgaaaactaattacgtagtaaggtacgtacggaacgtaacgtaccgcgttggttaaccttattacctagtttggtttgttttaccggacgttcgttacccgttccgggttacccggccgggttaccgttccggtaccgggggtaccctaccggggtaccccgttacggg

SEQ ID NO: 163954 - DNA, 898 bp, Homo sapiens
  misc_feature: GYAE6OF02I4RIO.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagctggttttctgttgctctttaaaggtgtcagtgtgaggtgcaggtagtggagtccgggggagcttagttcagccgtggggagtccctgagactctcctgtgtagtctctggaactctagtttcagttaccttcgtaggatcgcacgttcgggtaccaccgtaaacgtccggtaagggttaacggggccgttggggttcggttacggggttcctacgtaaccggttaacttaccgtaaacgttcccgtaggtagttacgggtacctaaggtttacgtttaaaacgtttaaaacgtttacggtttcggtaacccgggttaaccgtttacccggggttacggggtaaaccgggggggtacccgtttaacgtttaccgggtaacggttaacccgtaacgttaaccccgttaccggaaagggtaaaccgtaaacccggtaaaccgggtaacgtaaaagggttaacgttaacgttaaccggtttacgggttaaacgtttacggttaaacgggtaaaacgttaaccgggaaaccttaaggttaccgtaacggtaacgggttaacggtaccggtaaaccggtacggttaaaccgggttcttacggttaaccttacggtttactacggttttttcggtttaggtttttaacccgtaacggtttcccgggttaacccgtttccggggttaccccgggtaccgggttttacccggtttaccggggaccggggggttaacccctaaccggggggttacccctttacggggg

SEQ ID NO: 163955 - DNA, 125 bp, Homo sapiens
  misc_feature: GYAE6OF02GVENS.47.55.E11.1.454.CMB.1.raw
  modified_base (125)..(125): a, c, t, g, unknown or other
  misc_feature (125)..(125): n is a, c, g, or t
tcagagctcacgtacacgaccggtgctcgatttagcactcgcacgttgggttgggtgccgaagttgctgcctggtcaaggactacttcctacgtgagctctgagcgggctggcaaggcgcatagn

SEQ ID NO: 163956 - DNA, 788 bp, Homo sapiens
  misc_feature: GYAE6OF02F454V.47.55.E11.1.454.CMB.1.raw
  modified_base (535)..(535): a, c, t, g, unknown or other
  misc_feature (535)..(535): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtcgtgggctgagtcgttgggttttccttgttgtcttacgttttaaaggtgtccagtgtgtaggtgcgaggtaggtgggacgggtccggggggaggtcgtttagttcgacggtccggtgggggtacgtcccgtaggacgtacctctccgttggtgtacgtctcgtaggtaactcgtagtttctacgttaccttcgtaggtatcgctacggtcgggtacccgacctaaaccgtccggaaggggtacgggtcggttgggtcggtcggtcctcgtacgtatacctaagtccgtagtagtcggtcgtaagttagtttaaattaattagtaggtccggtacgtacggtagggtacgggtacgtacgttacgacgtctacgttcctaaccgaaggtaaccgaacgtaaacgganaaacggtatacgtacgttggtaactacgtaaggtaaatacggtaaactagtacggtaagaacggtagtaaccggtaacgtaacggtccggttacttaggttaccttaaatttccggtttagttttccggttttaacgggttttccgacgtttccgggttaccccgggtttcccggggtacccgggttacccgggtttaccgttccgggggttaccggggtaccccggttaacccgggggttcccttaccgggg

SEQ ID NO: 163957 - DNA, 502 bp, Homo sapiens
  misc_feature: GYAE6OF02GP6YK.47.55.E11.1.454.CMB.1.raw
  modified_base (487)..(502): a, c, t, g, unknown or other
  misc_feature (487)..(502): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctgggggatccctgagactctcctgtgtagtctctggaatcagtttcagtaccttctggatgctacgtgggtccgccaaactccagcctccaccaagggcccatccggtccttcccccgtggccgccctgcctccgaggacgccacccgtccgagacgcacgacggccggcccgtggggcctcggcccgtgggtccaaacgggtaccttaccgttccgtacggtgacgtctcgtggacggcgggtctcgggacgacgggcgcgatagnnnnnnnnnnnnnnnn

SEQ ID NO: 163958 - DNA, 679 bp, Homo sapiens
  misc_feature: GYAE6OF02F2TDG.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagcgttgggttttccttgttgcttacttttaaaaggtgtccagtgtgaggtgcgaggtagtggaggtccgggggagtcttagttcgagccgtggggacgtcccgtgacgacctctcctgttgtacgtctcgtggaatcgtagtttcacgttaccttgtggatgctacgtcgggtacccgacctaaacgtccgaagggtacgggtcgtggtcggtggtcctcgtacgtatactaatccgtgtagtcggtcgtagttagtttaaagttaaagttagtcggtaccggtaccgttcgggtagggaccggggtaccgtagttaccgacgtccgtacgtcctaaccgaagaacggaaccgaaacggactaaaggtacgtaactacgttgtaactgtaaagaagtacgaactaagtacgagaagtacgtacgaagtacgtacgtcttacgtacttagtacttagtttcgttcggtttacgtacgttccggttcccgtttccgggtccggtcggttacgttccggacgggtcccgtacgggtacctcggg

SEQ ID NO: 163959 - DNA, 709 bp, Homo sapiens
  misc_feature: GYAE6OF02G653N.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggtcttagttcagccgtggggagtccctgagactctcctgtgtagtctctggaatcagtttcagtaccttctggatgcacgtcgggtacccgaccaaacctccgaggggtaacggggccgtgggttggtcgggttcctcgtacgtataccaattcctgagtggactagttagtttaaattaaatttagtcggaccggtaaccgttccgggtacgggacgggggtcccgtagtttaccgaacggtccaacttcccgtacccgaaaggtaacgaaaccgaaacccggggacaaaggtaacggttaacttaccgttaggttaacgtttacgtaagggtaaattacgaaactaattcgtaaggaaggtacgtaccggaacgtaacgttaccgggtacttcgtacttacttcttagttttgttacggttttcgattccgttcccgtttccgggtcccggtcgggttaccgtttcgggacggggtacccgtacggggtaccccttcggg

SEQ ID NO: 163960 - DNA, 567 bp, Homo sapiens
  misc_feature: GYAE6OF02H0ZF1.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggagcttagttcagctggggagtccctgagactctcctgtgtagtctctggaatcagtttcagtaccttctggatgcactgggtccgaccaaactccaggtaaggggctggtgtgggtctcacgtatcaatcctgtatggactagtagtttaattaaattagtagacggaccttcggtaggacggggccgtattcacgtcatctaccagagacgaacgacaagagtatactagtactgtagaaatagaactatacgtagagagtacgacgaatacggtctagtctatcttattgttgtttacgtattcgtccgttcggtccggtcgggtacttccggtacgggtccgacgggtacccgtacggg

SEQ ID NO: 163961 - DNA, 691 bp, Homo sapiens
  misc_feature: GYAE6OF02IM9TA.47.55.E11.1.454.CMB.1.raw
  modified_base (404)..(404): a, c, t, g, unknown or other
  misc_feature (404)..(404): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggtttttccttgttgctacttttaaaaggtgtccagtgtgaggtgcaggtagtggaggtccgggggaggtcttagttcagccgtggggacgtccctgacgactctcctgtgtagtctcgtggaatcgtagtttcacgttacctttctggtatgcgtacgttcgggtacccgacccaaactccggtaaggggtaacggggcgtgggtcgtgggtcctcgtacgtatcaacgtcctagtagtggctagttagttaataaagttntacggcggtacgtcgtaggacgggctagttacagactcgtctaccgagaacgacgaaggacaaagagttaatacgttagtaactacgtaagtaaatagaactatcgtaagagtacggtcgaaacggtaagtaccggtcgttacgtaattacgtacgttacgttttggtttacggttttcgtaactttccggtttccccggtttccggggttacccgggtcgggtttaacccgttttccggggaacccggggggtaaccccttaaccggggggtaacccctttacggg

SEQ ID NO: 163962 - DNA, 565 bp, Homo sapiens
  misc_feature: GYAE6OF02GQ92V.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcacgtcgggtccgaccaaactccaggtaaggggctggtgtggtctcacgtatcaatcctgatggcagtgttaataaattatgacggactcggtgacggggccattcagcatctcagacgacaacggacaagagtactacgtagtatcgtagaaatagaaacatacgtagagtaggtacgacgtatacggtcgtgtacttatactagttgttaggttttcgagttcggtaccgtttcggttccggtcgggtacgttcggtcggggccgtacgggtacccgtcggg

SEQ ID NO: 163963 - DNA, 558 bp, Homo sapiens
  misc_feature: GYAE6OF02JEFA0.47.55.E11.1.454.CMB.1.raw
  modified_base (170)..(170): a, c, t, g, unknown or other
  misc_feature (170)..(170): n is a, c, g, or t
  modified_base (348)..(348): a, c, t, g, unknown or other
  misc_feature (348)..(348): n is a, c, g, or t
  modified_base (383)..(383): a, c, t, g, unknown or other
  misc_feature (383)..(383): n is a, c, g, or t
  modified_base (388)..(388): a, c, t, g, unknown or other
  misc_feature (388)..(388): n is a, c, g, or t
  modified_base (404)..(404): a, c, t, g, unknown or other
  misc_feature (404)..(404): n is a, c, g, or t
  modified_base (477)..(477): a, c, t, g, unknown or other
  misc_feature (477)..(477): n is a, c, g, or t
  modified_base (489)..(489): a, c, t, g, unknown or other
  misc_feature (489)..(489): n is a, c, g, or t
  modified_base (525)..(525): a, c, t, g, unknown or other
  misc_feature (525)..(525): n is a, c, g, or t
  modified_base (544)..(544): a, c, t, g, unknown or other
  misc_feature (544)..(544): n is a, c, g, or t
  modified_base (553)..(553): a, c, t, g, unknown or other
  misc_feature (553)..(553): n is a, c, g, or t
  modified_base (556)..(558): a, c, t, g, unknown or other
  misc_feature (556)..(558): n is a, c, g, or t
tcagagctcacgtacacgaccggtgctcgatttagcactcgcacgttgggtttggggagccgcagccctgggattcccagctgtttctgcttgctgatcaggactgcacacagagagctcaccatggagtctgggctgagctgggtttccttgttgctcttttaaaaggngtccagtgtgaggtgcaggtagtggaggtccgggggaggcgttagttcagccgtggggagtccccgtgagactctcctgtgtagtctctggaatctagtttcagttaccttgtggattgcacgtggtcccgaccaaacgtccgagggtacgggccgagggaccctggtcagcgtctcncagcctccacgacggcccagtccgtccttccccgnggccnccgtgcctccgaggcnccaccgtcgacgacgcacgacgccgacctcggccctgcccgttgggaccaacggaccttacgttcccgtacgngaacgtctacgnggacggccgggtctcggccgaaggccgacaggtcgnacgggtcagtcacgacgtnacgctacgnacnnn

SEQ ID NO: 163964 - DNA, 603 bp, Homo sapiens
  misc_feature: GYAE6OF02G7R5C.47.55.E11.1.454.CMB.1.raw
  modified_base (453)..(453): a, c, t, g, unknown or other
  misc_feature (453)..(453): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagccgtgggggagtccctgagactctcctgtgtagtctctggaatctagtttcagtaccttctggatgctacgtgggtcccgaccaaacgtccgaagggtaacggggtcgtgggtggtggggtctcgacgtactacaactccgtagagtggctaggttgttaaattaaattagtggacggtacgttccggtgggacggggtccgagttcagtctactccgtcaagacgacgaacggnaaggatatacgtgtaactcgtaaggaaatacgaaactagtacgtagaagtacgtcgaacgagtacgtctcgtactatctagttgtttcgtttcgattccgtccggttcggtccggcggttacttcggcgggtaccgtagggtacccgtgg

SEQ ID NO: 163965 - DNA, 596 bp, Homo sapiens
  misc_feature: GYAE6OF02JATO4.47.55.E11.1.454.CMB.1.raw
  modified_base (294)..(294): a, c, t, g, unknown or other
  misc_feature (294)..(294): n is a, c, g, or t
  modified_base (351)..(351): a, c, t, g, unknown or other
  misc_feature (351)..(351): n is a, c, g, or t
  modified_base (362)..(362): a, c, t, g, unknown or other
  misc_feature (362)..(362): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttcctgttgctcttttaaaaggtgtccagtgtgaggtgcaggtagtggaggtccgggggaggcttagttcagccgtggggagtccctgagactctcctgtgtagtctctggaatcagtttcagttaccttctggatgcactgggtccnccaaactccgaggtaagggctggtgtgggtctcacgtatcaatcctagatggcagtnttaataaattntgcgtactcggtgacggggtcctattcagtcatccgtacgaagtacgaacgaacggacaagtacgtatacgtgttatcgtaagaaactagaacaagtcgtagagagtacgaagtacgtacggtctgttacctattacgtattttggtttacgacgttcggtcccgtttaccgggccggttacgggttaccttcgggtaccggggtacccgtacggggtaacccctgggtaccgg

SEQ ID NO: 163966 - DNA, 684 bp, Homo sapiens
  misc_feature: GYAE6OF02JEN7E.47.55.E11.1.454.CMB.1.raw
  modified_base (612)..(612): a, c, t, g, unknown or other
  misc_feature (612)..(612): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccggggagcttagttcagcctggggatcccgtgagactctcctgtgtagtctctggtaatcagtttcagtaccttctggatgctacgtcgggtccgccaaactccgaggtaagggctgggtgtggtctcgacgtatcaacttccgtagagtcggacgtagttagtttaattaaattgtcggtaccggtacttacccgggtagggacgggggtaccgtacgtttaccgagtactcgttacctaccgtaaggtaacggaaccgaaaccggtacgtaaacggtagttaacgtacgtagttactcgttaacggtaaagtacgtaaactacgttactagggaacgtaggtaccgtaacggtaacgtaccgggtaccttcggtacttacgttacgttagtttcggtttacgttttacggngttacgttcccgtttccggtccggtacgggttcgtttccggtcggggtaccgtaccgggtacccgttacggg

SEQ ID NO: 163967 - DNA, 701 bp, Homo sapiens
  misc_feature: GYAE6OF02H3PNH.47.55.E11.1.454.CMB.1.raw
tcagagctcacgtacacgaccggtgctcgatttagcactcgcacgttgggtttggggagcttcagctgtggtagagaagacaggattcaggacaatctccagcatggccggcttcctctcctctcacctcctcactcactgtgcagggtcttgggcccagtctgtgctgactcagccaccctcagcgtcgtcgggaccccggcacgacggtcaccatctcttgttctgggaagccagctaccaatacgtacggaaatgaataatgtatacgtaggtaccagactaacgtcccaacggaaccggacccccaaactcctacatactaataacaatgactcgacgccgcccctacgaccggggtcctcggacctactttctcgtcggtctaccgaagtcgtcggcctccctacgaccgaccctaacccgtcggaccctaacgttccgaacgggttcggggaccccgtcccggggacccgagggaactagggacggtcttacggtaattttacgtttacgtgggttacgggtttacgggttagggacttacggaccgtacggtcccgttacggtaccttcggttaccgtttaccgggttcgtttcgggacgtacgggtaaccgggtaacccgtacggtcccgttacccgtaccggttacggtacccgaccggaaccccggtaaaccgtcccccgaaccccgtacg

SEQ ID NO: 163968 - DNA, 553 bp, Homo sapiens
  misc_feature: GYAE6OF02GQ34K.47.55.E11.1.454.CMB.1.raw
  modified_base (231)..(231): a, c, t, g, unknown or other
  misc_feature (231)..(231): n is a, c, g, or t
  modified_base (280)..(280): a, c, t, g, unknown or other
  misc_feature (280)..(280): n is a, c, g, or t
  modified_base (306)..(306): a, c, t, g, unknown or other
  misc_feature (306)..(306): n is a, c, g, or t
  modified_base (366)..(366): a, c, t, g, unknown or other
  misc_feature (366)..(366): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctcggggacccccggcagacggtcaccatcctcttgttcncggaagctagcgtaccaatatcggaaatgataatcgtatactggtaccngacaagtcccagaacgccccaatccnatcataacatgatcagcgccctagacgggtcctcggcctattctctggcctcgaagttcncggcctacctcgcacccaccgtgaccatcgagtcggctccggccaggatgacgtcagtacttaagtcgtgacggtttaggtcgggatccgacgcgtaccgttgaacgttcgacgtttactccgttacgagtcggtaccggactacggtccacgtacccgtagccacggaccacggtacccaccctcg

SEQ ID NO: 163969 - DNA, 178 bp, Homo sapiens
  misc_feature: GYAE6OF02INT4H.47.55.E11.1.454.CMB.1.raw
  modified_base (176)..(178): a, c, t, g, unknown or other
  misc_feature (176)..(178): n is a, c, g, or t
tcagagctcacgtacacgaccggtgctcgatttagcactcgcacgttgggtttggggggaagaggaagactgacggccctgctccaggagcacctccgagagcacagcggccctgggctgcctggtcaaggactacttcctatgtatactctgagcgggctggcaaggcgcatagnnn

SEQ ID NO: 163970 - DNA, 573 bp, Homo sapiens
  misc_feature: GYAE6OF02FPXKR.47.55.E11.1.454.CMB.1.raw
  modified_base (411)..(411): a, c, t, g, unknown or other
  misc_feature (411)..(411): n is a, c, g, or t
tcagagctcacgtacacgaccggtgctcgatttagcactcgcacgttgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaaactccaggtaaggggctggtgtgggtctcacgtatcaatcctgatggcagtgttataaattatgcggactccgtggaggggccgattcagcatctcagagacaacggcaagatatactgtatctaggaaatagaacaatctagagagtcgaacgatacggctgtctatctattgtgttttcgatcgtccttcggtccgcggtcttcgnggggccagggaccctggtcagcgtctccgtcacgccctccgaccgtaacggcccctagtccggtcccttcccccgtggcccgtccctcgcccgtccgacggccgccacccgtccggacgacgccaacgcggccggtccgcggcctcggcgtcgacgtaacgg

SEQ ID NO: 163971 - DNA, 753 bp, Homo sapiens
  misc_feature: GYAE6OF02IWPXT.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctggctgagctgggttttcctgttgctcttttaaagtgtccagtgtgagtgcgaggtagtggaggtccgggggagcgttagttcagccgtggggagtcccgtagagacgtctcctgtgtagtctcgtggaatcgtagtttcagttaccttctaggatgtcctacgtcgggtcccgtaccctaaaccgtacccgaagggtaacgggtccgttgggtggtacggttccgtccgtaacgttactcgtaaacgttccgtgtagtggactaggttagttaataaattagtggacggtacgttccggtaggacggggtactagttacgagaccgtagtcctaccgaaggtaacgaaccgtaaacggtacgaagttaacgtaacgttaacgtagttaattaaccgtaggtaaaacgtacgtaaacgtaacgttacgttaacggaacgtaacggttaaccgaaacgtttaacgttaccggttacggttacgttaacgttacgttaacttagttttacggttacggtttttacgtaacgtttccggttacccgtttaccgggtacccggtaccgggttaaccggtttacccgggtacggggtaacccggtaaccgggttaaccggttaccggg

SEQ ID NO: 163972 - DNA, 679 bp, Homo sapiens
  misc_feature: GYAE6OF02HR2CI.47.55.E11.1.454.CMB.1.raw
  modified_base (210)..(210): a, c, t, g, unknown or other
  misc_feature (210)..(210): n is a, c, g, or t
  modified_base (236)..(236): a, c, t, g, unknown or other
  misc_feature (236)..(236): n is a, c, g, or t
  modified_base (343)..(343): a, c, t, g, unknown or other
  misc_feature (343)..(343): n is a, c, g, or t
tcagagctcacgtacacgaccggtgctcgatttagcactcgcacgttgggtttggggcagcttcagctgtggtagagaagacaggattcaggacaatctccagcatggcccggcttccctctcctcctcaccctcctcactcactgtgcagggtcttgggcccagtctgtgctgactcagcccaccctcagcgtctcggggacccccggnagacggtcacatctcttgtctggaancagctcaatatcggaaatgaataatgtaactactgtaaccagacaacgtcccaacgaaccggacccccaaactcctcaatctaataacaaatgactacagccggccncgacggggtcctggcattctctcggctaccgaagtcgacggctccctgaaccgtcccacccgtacggccctaatccgtaggtacgggtccgtacccggggtacccgagggtactacggaacggtctacggtaagttacttaaccgtggttacggttagggttagggacgtcgaccgacgtcccgttaggtaccgtacgtttaccgtttaccgggttcgttaccgggtacggtccggttaaccggggtaacccgtaacggggttcccaaccccggtttaccgaaccgggttaccgaacccggtaaccccggtaacgggtacccccctaaaaccccgg

SEQ ID NO: 163973 - DNA, 785 bp, Homo sapiens
  misc_feature: GYAE6OF02JHG23.47.55.E11.1.454.CMB.1.raw
  modified_base (207)..(207): a, c, t, g, unknown or other
  misc_feature (207)..(207): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtcctgtgctgactcagcccaccctcagcgtctcgggaccccggnagacggtcacatctcttgttctggaagcagctcaatatacggaaatgataactgtatactggtaccagactaacgtcccaacgaacccggacccccaaactcctacatctaataacaactgactacacgccggccctacgaccggggtccctcggccgtagtttccgtacgtcgggtccttacccgaaggttcccgttacggggcccgtacccttaccgaccgaccccgtaccccgtccggggaccctaacgttccgaacgggttaccggggtccctcccgggggtacccgggaacgggtaacgtacgggtacgggtcccgttaggttaccgttttaaacgtttaccgttgggtttaacgggttaacggggtttacggggtaaccttcccgggtaccgtaacggtcccggtttacggtaaccgttcggttaaccttttaccgggttacccgtttacggggaccggtaccggttaaccgggggtaaacccgtaacggggtaccccgttaacccggttaccggttaacggtacccggtaacccggaacccggtaacccggacccctaaaccccgtaccgg

SEQ ID NO: 163974 - DNA, 555 bp, Homo sapiens
  misc_feature: GYAE6OF02F6GYO.47.55.E11.1.454.CMB.1.raw
  modified_base (294)..(294): a, c, t, g, unknown or other
  misc_feature (294)..(294): n is a, c, g, or t
  modified_base (535)..(536): a, c, t, g, unknown or other
  misc_feature (535)..(536): n is a, c, g, or t
  modified_base (539)..(540): a, c, t, g, unknown or other
  misc_feature (539)..(540): n is a, c, g, or t
  modified_base (544)..(546): a, c, t, g, unknown or other
  misc_feature (544)..(546): n is a, c, g, or t
  modified_base (548)..(555): a, c, t, g, unknown or other
  misc_feature (548)..(555): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagccgtggggagtccctgagactctcctgtgtagtctctggaatcagtttcagtaccttctggatgcacgtgggtccnccaaactccgaggtaacgggccagggaaccctggtcaggccgtctcctcacgccctccaccgaacgggcccagtccggtccttccccgtggccgccctgccgtccaggacgccacccgtccgagacgcacgagccggacccgtgggctcggcccgtgggtaccaaacgggccttaccttccgtacggtcgacgtccgttcgagggacggcggggtctcgggtaccgaacggcgacagtagnngtnngacnnngnnnnnnnn

SEQ ID NO: 163975 - DNA, 725 bp, Homo sapiens
  misc_feature: GYAE6OF02FYM7M.47.55.E11.1.454.CMB.1.raw
  modified_base (199)..(199): a, c, t, g, unknown or other
  misc_feature (199)..(199): n is a, c, g, or t
tcagagctcacgtacacgaccggtgctcgatttagcactcgcacgttgggtttggggagctgtggtagagaagacaggattcaggacaatctccagcatggccggcttccctctcctcctcaccctcctcactcactgtgcagggtcttgggcccagtctgtgctgactcagccaccctcagcgtctgggacccccggnagacggtcaccatctcttgttctggaagcagctccaatatcggaaatgaataatgtatactggtaccagcaacgtcccacgaaccggccccccaaactcctcatctaataacaatgatcacgccggtccctacgacggggtcccctgggaccgtatttccttacgtcgggtccttacccgtaaggttccgttagggcccgacccttaccgaccgtccccaacccgtcgggacccctaattccgaagggttccgggccccgtccccggggaccccggtagggacgtacgggaagggtccttaggtaacttttacgttaaccgttgggttaggttaacggggtttggggaccttccgggacgtaccggtccgtacggtacttaccgtaccgttttaccgtccgtttacggggacgttcgtaccggggaaccctaacggggtccctaacccggtccgttaaccggtccgaaccggtacccccggaaacggtacccccgtaaaccccctccgttaccgtacccgtacccg

SEQ ID NO: 163976 - DNA, 734 bp, Homo sapiens
  misc_feature: GYAE6OF02H2GTU.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgcttacttttaaaaggtgtccagtgtgaggtgcaggtagtggaggtccgggggagcttagttcagccgtggggacgtccctgagacttctcctgtgttagtctcgtggaattcgtagtttcacgttacctttcgtggtatgccgtacgttcgggtaccccgaccgtaaaacccgtccggtaagggggtaacgggggtccttgggggttggttcggggttccttaccgtaaccggttaacttacctaaacttccgtaggtaagtcggtacgtaaggtttagttttaaattaaaaagtttgacgggtaccggtacgttcccgggtagggacggggtacccgtattacgacgtctacttacctaccgaaggtaacgaaccgtaaacggcgaaaagtacgttaatacgttattacgtacgtaaacggtaaatacgtaaacaacttcgaagtaacggtacggtacgaacgtacgtacgtcttagttcctattcgttagttttgtttacggatttccggtccggttccgggttaccgccggtttacgttcgggaccgggtacccggtaacggtcccgtggtaccg

SEQ ID NO: 163977 - DNA, 619 bp, Homo sapiens
  misc_feature: GYAE6OF02GW4G1.47.55.E11.1.454.CMB.1.raw
  modified_base (505)..(505): a, c, t, g, unknown or other
  misc_feature (505)..(505): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcacgtgggtccgccaaactccgaaggtaaggggctgggtgtgggtctcacgtatcaatcctgatggctagtagtttataaattatgcggacgtcgtggagggccgattcacgcatctaccaggtaagaccgaaacggcaaaggtagtaactaccgtagttaacgttacgtagggaaaactgaaacctaagttcgtagaaggtacgtacgaacgtagtaccggtnttacgtctaacttcttagtttcgtttcggtttacgattcgggttacccgtttccgggtaccggtaccgggttaccgtttcggtaccgggggtcctaaccggggacccgttcggg

SEQ ID NO: 163978 - DNA, 496 bp, Homo sapiens
  misc_feature: GYAE6OF02HMLBO.47.55.E11.1.454.CMB.1.raw
  modified_base (419)..(419): a, c, t, g, unknown or other
  misc_feature (419)..(419): n is a, c, g, or t
  modified_base (453)..(453): a, c, t, g, unknown or other
  misc_feature (453)..(453): n is a, c, g, or t
  modified_base (457)..(457): a, c, t, g, unknown or other
  misc_feature (457)..(457): n is a, c, g, or t
  modified_base (461)..(461): a, c, t, g, unknown or other
  misc_feature (461)..(461): n is a, c, g, or t
  modified_base (479)..(479): a, c, t, g, unknown or other
  misc_feature (479)..(479): n is a, c, g, or t
  modified_base (484)..(496): a, c, t, g, unknown or other
  misc_feature (484)..(496): n is a, c, g, or t
tcagagctcacgtacacgaccggtgctcgatttagcactcgcacgtagggtcttgggcccagtctgtgctgactcagccacccctcagcgtcctggggacccccgggcagacggtcaccatctcttgttctggaagcagctccaatatcggaaatgataatgtatactggtaccagcaagtcccacgaaccggcccccaaactcctcatcataacaatgatcagcggccctcaggggtccctggccgattctctggctccaagtctggcgcctcagccaccctggccatcagtgggctccggcccgaggatggaggctgattatactgtgtaggttgggatcgcagcctgactgtcttacgtcttcggagtcgtgggaccaaggtccaccgtcctaggtcacgcccaaggcccaacccnctcgtcactctccgttccccaccctcctctacgngacnctcngacgcggctggcgaggcngatgnnnnnnnnnnnnn

SEQ ID NO: 163979 - DNA, 818 bp, Homo sapiens
  misc_feature: GYAE6OF02GXVNB.47.55.E11.1.454.CMB.1.raw
  modified_base (211)..(211): a, c, t, g, unknown or other
  misc_feature (211)..(211): n is a, c, g, or t
  modified_base (346)..(346): a, c, t, g, unknown or other
  misc_feature (346)..(346): n is a, c, g, or t
tcagagctcacgtacacgaccggtgctcgatttagcactcgcacgttgggtttggggagcttcagctgtggtagagaagacaggattcaggacaatctccagcatggccggcttcccctctcctcctcaccctcctcactcactgtgcagggtcttgggcccagtctgtgctgactcagcccacctcagtcgtcgtccggggacccccggnacgacggtcacctagtcctcgttgttcgtggaacgctacgcctaccaatacgtaccggaaatgaattaatgttaactacgtggaccagacaacgtcccaacgtaacccgacccccaaactccctacatacctaanaaactactagactcgacggcccggtccctacggtaccggggtcccctcggtacctacgttcctcgtccggtccctaacccggagttccgtacgggccctacccgtaccgaccgtaccccctacccggtcgacccccgtagttaccggtacgggttccgggtaccccgtccccgggacccgggtaggtacgtacggaccgggttacgttacgtttaacgtttaacgtttacggttacgggttacgggttaacgggtttcgggaacgtttcccggaccgtaccggttccccggttaagttacccggttacgtttcccggtttaaccgttaccgggtttaccgggcggttacccgggttaacccggggtaaccgtaacccgggtttacccgtaaccccgggtttaccgttacccgggtaccgtaacccccgggttaccccgaaacccggggtaccccctaaccccccgttaccgg

SEQ ID NO: 163980 - DNA, 645 bp, Homo sapiens
  misc_feature: GYAE6OF02G2YTN.47.55.E11.1.454.CMB.1.raw
  modified_base (206)..(206): a, c, t, g, unknown or other
  misc_feature (206)..(206): n is a, c, g, or t
  modified_base (628)..(632): a, c, t, g, unknown or other
  misc_feature (628)..(632): n is a, c, g, or t
  modified_base (634)..(635): a, c, t, g, unknown or other
  misc_feature (634)..(635): n is a, c, g, or t
  modified_base (637)..(637): a, c, t, g, unknown or other
  misc_feature (637)..(637): n is a, c, g, or t
  modified_base (639)..(644): a, c, t, g, unknown or other
  misc_feature (639)..(644): n is a, c, g, or t
tcagagctcacgtacacgaccggtgctcgatttagcactcgcacgtagggtcttgggcccagtctgtactgactcagccaccctcagcgtctcgggacccccgggcagacggtcaccatctcttgttctggaagcagctccaatatcggaaatgaataatgtatactggaccagcaagtcccaacgaaccggcccccaaactcctnatctaataaacaagtgatcaggccggcccctacggacgggggtcccctagggcccatttcctctgggcctccaagtctggccgcctacacgcccacccgtggccatcgaggtcggggcctcccgggcccgaggactggacggctagtaatttacgttactggttaggttagggttcgggatccgggcacggtcctacgtacgtcgttaccgtttacgttcgttcgggagtccgttacgggggaaccctacggggtccaacccggtttccgtaacgggttaccgacgtaccccgaaaccggacccccaaaccccgtacgtcgtaccaccgttccgtttccgttcccccgtcccttacccgttcgtacgttagccgtctccgtaggccggcgggtccgtcggacgaacggccgaatcagcagcnnnnncnncncnnnnnnc

SEQ ID NO: 163981 - DNA, 614 bp, Homo sapiens
  misc_feature: GYAE6OF02G0TAI.47.55.E11.1.454.CMB.1.raw
tcagagctcacgtacacgaccggtgctcgatttagcactcgcacgttgggtttggggagccgcagccctgggattcccagctgtttctgcttgctgatcaggactgcacacagagagctcaccatggagtctgggctgagctgggttttccttgttgctcttttaaaaggtgtccagtgtgaggtgcaggtagtggaggtccgggggaggcttagttcagcctggggagtccctgagactctcctgtgcagcctctggactcaccttagcaactctgtcagtggctgggtccgcaggcgtccggggagggctgggaggtgggtctcgacgtatcaatcctgagtggctagtagttaataaattagtgacggactccggtggacggggcctagttcgagtcctaatcctaccgaaggtacgaacgaacgggacaaaggattatactagtatcgtaagaaattagaaactatacgtagaagtcgtacgaagtacgtacggtcttagtaccttagtactagttttcggttacggttttacgagtttcggtccccgtttaccgggttcccgggtaccggggttccgtttaccgggttcgggggacccgtaacccgggg

SEQ ID NO: 163982 - DNA, 849 bp, Homo sapiens
  misc_feature: GYAE6OF02JFYT8.47.55.E11.1.454.CMB.1.raw
tcagagctcacgtacacgaccggtgctcgatttagcactcgcacgttgggtttgggggccggcagccctgggattcccagctgtttctgcttgctgatcaggactgcacacagagagctcaccatggagtctgggctgagctgggttttccttgttgctacttttaaaggtgtccaggtgtgaggtgcaggtagtggagtccgggggagcttagttcagcctggggagtcccgtgagctctcctggtgtagtctcgtggaatcagtttcagttaccttcgtggatgacgtacgtcggggtcccgacctaaaaccgtccgaagggttaacgggggcgttgggtggtttggggtccttaccgaacggttactaccgtaaacgttcccgtagtaacggtcggggtactaaggttgtttaaattaaaatttacgtaggaccgggtaaccgttccgtagggggacggggtacccggttatttaccgaagccgtaacttccgtacccgtaaagggaccgaaccgaaaccgggtaccgaaagggtaacgttaacgttaacgttcgttaaacgttcggttaaacgggtaaaactaaggtaaacctaaacgttacgtaggtaacgaggttaccgtaaaccggtacgttaccgggtaccgttaggttaccgttaacgttcgtaacggttttttggtttacggttttttccggtaacggtttccgggttacccccggttttacccgggggtttacccccggggtaaccgggggttttaacccggttttacccccgggggttacgggggggtaaccccccgtttaacccggggggttaacccccggttttaaccccggggg

SEQ ID NO: 163983 - DNA, 593 bp, Homo sapiens
  misc_feature: GYAE6OF02H2E6A.47.55.E11.1.454.CMB.1.raw
  modified_base (206)..(206): a, c, t, g, unknown or other
  misc_feature (206)..(206): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctcgggacccccggnagacggtcaccatctcttgtctggaagcagctccaatatcggaaatgataatgtatactggtaccagcaagtcccacgaacgcccccaaactcctacatctaataacaatgactcagccggccctcgacggggtccctggccgattctctggctcaagtctgcgcctcacgcccacctggcccatcgagtcgggccgtcccggcccggaggacgtggacggtctagattacttacgtggtggtagggttgggacgtcgacgagtccgtgtaccgtcgtcgtttacggttcgttaccgggagtaccggtgggtaacccgtaacgggttcccgacccgttccggtacggtaccgaaccgaccccgaaacggtcccccaaccccgtaccg

SEQ ID NO: 163984 - DNA, 754 bp, Homo sapiens
  misc_feature: GYAE6OF02ITPM3.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtgggaggtccggggggaggtcgttagttcgacgtccggtagggggtaccgtcccgtgacgtacctcctccgtggtgtacgtctcgtaggtaactctagtttactacgttaccttcgtaggtctcgactacggtcgggtacccgaacctaaaccgtaccggtaaggggtaacggggtcgttggggtcgggtcggttccgtacgtacgttactactaactcgtagtacgtcggacgtaagttagtttaaagttaaattacgtcggtaccggtaccgttaccgggtgggacggggtcctacgttacgacgacgtaccgttccgtacgaaggaacgaaaccggaacggtacgaaagttaacgtacgtacgttagttagttacgtaaaggtaacaacgtaactagtcgaaggtacgtacggtaacgtagtaaccggtcggttctacggttacttacgttattacgttttgtttacggttacggtacgtccggtttacccggttccgggtaccgggttacggtttaccgttccggggacgggaacccggttaccggggtaccctcggg

SEQ ID NO: 163985 - DNA, 699 bp, Homo sapiens
  misc_feature: GYAE6OF02GSKCP.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggagcttagttcagccgtggggatccctgagacctctcctgtgtagtctctggaatcagtttcagttaccttcgtggatgcacgtcgggtcccgacctaaaactccgagggtaagggctgggtggtggtctcacgtatcaattcctagatggctagttagtttaattaaattatggcggtaccttccggtagggacggggtccctagtttccgaggtctacgttaccttacccgaaggtaaccggaaaccgaaacccgggtacaaaggtacggttaacttacgttagttaacttacgtaaggtaaactacgaaactaagttacgtaggaacgtaggtaccgaacgtaacgtaccgtcgttagtacttacgttactagttttggtttacgtttttacggagtttccggttcccggttttacccgggttacccgggttaccggggttaccgtttcccggggtaccgggggtacccggtaccggggtacccgttacggg

SEQ ID NO: 163986 - DNA, 652 bp, Homo sapiens
  misc_feature: GYAE6OF02IQ21D.47.55.E11.1.454.CMB.1.raw
  modified_base (208)..(208): a, c, t, g, unknown or other
  misc_feature (208)..(208): n is a, c, g, or t
  modified_base (231)..(231): a, c, t, g, unknown or other
  misc_feature (231)..(231): n is a, c, g, or t
  modified_base (247)..(247): a, c, t, g, unknown or other
  misc_feature (247)..(247): n is a, c, g, or t
  modified_base (340)..(340): a, c, t, g, unknown or other
  misc_feature (340)..(340): n is a, c, g, or t
tcagagctcacgtacacgaccggtgctcgatttagcactcgcacgttgggtttggggagcttcagctgtggtagagaagacaggattcaggacaaatctccagcatggccggcttccctctcctcctcaccctcctcactcactgtgcagggtcttgggcccagtctgtgctgactcagcccaccctcagcgtctcgggacccccggnagacggtcaccatctcttgttcnggaagcagctacaatnacgaatgataatgtatactggtacagcaacgtcccaacgaaccggccccaaactcctcatctaataacaatgatcagcgcctcgacgggtccnggcgattcgctgctcagtcgtgccgcctcacgccaccgtcggcccatcgaggtcgggcccttcccggggaccccgtagggacgtacggacgggtcgttagtaacgtttagtttaaccgttcggttagggtttaaggggttcggggtacgttccggtacgacggttcccgtacgtaacgttcgtaccgtttaccggttcgtttaccggggtacgtaccggtaccggggtaacccgtaacgggttcccgtaacccggttaccgtacggtacgtacccggaaccccgaaccgggtacccccaaaccccgttaccg

SEQ ID NO: 163987 - DNA, 739 bp, Homo sapiens
  misc_feature: GYAE6OF02FVE9O.47.55.E11.1.454.CMB.1.raw
  modified_base (184)..(184): a, c, t, g, unknown or other
  misc_feature (184)..(184): n is a, c, g, or t
  modified_base (205)..(205): a, c, t, g, unknown or other
  misc_feature (205)..(205): n is a, c, g, or t
  modified_base (230)..(230): a, c, t, g, unknown or other
  misc_feature (230)..(230): n is a, c, g, or t
  modified_base (311)..(311): a, c, t, g, unknown or other
  misc_feature (311)..(311): n is a, c, g, or t
tcagagctcacgtacacgaccggtgctcgattttagcactcgcacgtttggggttttgggggacgaaagaagaccaggattcaaggaccaatctccagcatggccggcttccctcgtcctcctcaccctcctcactctactgtgcagggtctgggcccagtctgtcgctgactcagccaccctnagcgtcgtcgggaccccgggnagacggtcacatctcttgtctggancagctcaatatacggaatgataatgtatactaggtacagacaacgtcccgaacggaacccggacccccaaacttcccgtanactactaataaacagtgactcgacggccggcctggaccgggtccctgggaccttacttaccgtcgtacgtacctaaccgtaaggtctcgggccctacctacgaccggccctacccggtggaccagttacggaccggcggtacccgtcccgggaaccgtaggtacctggaaaccggtcttaacggttaactttacgttacggtcggttacgggttaacggggttgtacgtccgacgaccggttccgtacgcgttaacggttccgtttaccggttcgtacgggtaccggtcggtttaaccccggggtaacttaccgggttaccctacccggtttccggaaacgggttccaacccgggtaaaccctaaccggtaacccctacccggtagttcgtacccgttaccgtccgttacccgtacccccttaccccg

SEQ ID NO: 163988 - DNA, 690 bp, Homo sapiens
  misc_feature: GYAE6OF02H6B41.47.55.E11.1.454.CMB.1.raw
  modified_base (217)..(217): a, c, t, g, unknown or other
  misc_feature (217)..(217): n is a, c, g, or t
tcagagctcacgtacacgaccggtgctcgatttagcactcgcacgttgggtttgggggggggaagctcagcttcagctgtggtagagaagacaggattcaggacaatctccagcatggccggcttccctctcctcctcaccctcctcactcactgtgcagggtcttgggcccagtctgtgctgactcagccaccctcagcgtctcgggacccccggnagacggtcaccatctcttgttctggaagcagctaccaatatcggaaatgataatgtatactggtaccagaccaagtccccacgaaccggcccccaaactccctacactcctaataacaatgactcacgccggcctcgacggggtccctggcctatttctcgtcggcctaccaagtcgtcggccgccctcacgccccaccgtcggccagtcgaggtcgggaccgtcccgggacccggtaggacgtcggacgggtccgttaggtaacttttaacgttacgttgggtttacgggttaacgggggtttggggtaaccgttccgggccgtaccggtcccgttacggtaccgttcggtacccgttttaccggttcccggtttcggggaccggttccggtaccggggtaaccccgtaacggggttaccctaccccgggttcccgttaacgggtaccctacccgggaccccgtaacccggg

SEQ ID NO: 163989 - DNA, 572 bp, Homo sapiens
  misc_feature: GYAE6OF02GSQNK.47.55.E11.1.454.CMB.1.raw
  modified_base (475)..(475): a, c, t, g, unknown or other
  misc_feature (475)..(475): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttggtccagccgtggggggtccctcagactctcctgtgcagcctctggattcaccttttagttcctcttggatgaattgggtccgccagactccgaggggaaggggctgggaggtgggttggcaacataaaatccaagatggaagtacaagaaaacctatgtggactctctggaagggccattcaccatcctcagacgacaacgaccaagaactctctgtttcagcaatggacagcctggagtagacgaagaccgacggtctagtnttaagttactagtgtgtcgttactggtaaccgtccgttccgggcccgtacgttcggtctttcggtcggggtccgtacgggtacccgttggtaccccg

SEQ ID NO: 163990 - DNA, 677 bp, Homo sapiens
  misc_feature: GYAE6OF02G1PX1.47.55.E11.1.454.CMB.1.raw
  modified_base (213)..(213): a, c, t, g, unknown or other
  misc_feature (213)..(213): n is a, c, g, or t
  modified_base (238)..(238): a, c, t, g, unknown or other
  misc_feature (238)..(238): n is a, c, g, or t
  modified_base (243)..(243): a, c, t, g, unknown or other
  misc_feature (243)..(243): n is a, c, g, or t
  modified_base (390)..(390): a, c, t, g, unknown or other
  misc_feature (390)..(390): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcgagggttcttgggcccagtctagtgctgactcagcccacctcgagcgtcgtcggggacccccgggnacgacggtcaccatcttcttgttcnggacncagctacaatagtacggaatgaataatgtactcgtggtaccagccaacgtcccaccgtaaccggacccccaaacgtcctacacttactaataacaatcgactcgacgtccgccctacggacgggtccctcggtaccctatttcccgngttccggacctccgtaacggttccgtacggtccgtccgtaccgaccgcccctaacccggtcgtacccagttcccgacgggtcgggcccgtacccgggacccggtagggacgtacggaccggtcgtagtactttacgttacgttggtagggttacgggttggaacgtcggaccgtacgccgtacgtacgtcgttaaccgtttccgtacgttcggacgtcggtacgggaaccgttaccggtccgtaccgttcgtacggccgtaccggacccacggtacccacccgtacc

SEQ ID NO: 163991 - DNA, 798 bp, Homo sapiens
  misc_feature: GYAE6OF02JT6DX.47.55.E11.1.454.CMB.1.raw
  modified_base (64)..(64): a, c, t, g, unknown or other
  misc_feature (64)..(64): n is a, c, g, or t
  modified_base (248)..(248): a, c, t, g, unknown or other
  misc_feature (248)..(248): n is a, c, g, or t
tcagagctcacgtacacgaccggtgctcgatttagcactcgcacgttgggtttggggggggaanctcagcttcagctgtggtagagaagacaggattcaggacaatctccagcatggccggcttccctctcctcctcaccctcctcactcactgtcgacgaggtctcgggaccctagtcctggtcgctacgtacctcgacgcccctaccctcgacggtccgttcggtacccgggggaccccccggganaacgggtaccggtccaaccctcgttccttcgtttgttaccgtagggaacgtcacgtcctaccaagtacgtaacggtaatacggtaataagttacgtaacgtaccgtacggtacctacgactaaaccgtaccccgaaccggaaccccggaacccccctaacgtccctactacttactaactaaacctaacgtacgacgtacgacggtcccggtacctacccggtacgggttcccgtcgggtacccttacgttccgtccggtcgtaccgtacctaacggttccggtaccggtccgtaacccgttccgacgtaccccgtaccgtcggacccgtactcggacgggtccgggtcccggtaccccggtccggtaacgggtcgtcgtacggtacgtagttacgtttacttacggttcggtaggtttacggggttagactaccggtcgtaccggtacgtacgtacgtgtacctttacggtacggtcggacgttacggtccggtaacgttaccggtaccgaccggttaccgtcggtaccacccggtaacccgtacccgg

SEQ ID NO: 163992 - DNA, 561 bp, Homo sapiens
  misc_feature: GYAE6OF02HXTXJ.47.55.E11.1.454.CMB.1.raw
  modified_base (354)..(354): a, c, t, g, unknown or other
  misc_feature (354)..(354): n is a, c, g, or t
  modified_base (498)..(498): a, c, t, g, unknown or other
  misc_feature (498)..(498): n is a, c, g, or t
  modified_base (528)..(528): a, c, t, g, unknown or other
  misc_feature (528)..(528): n is a, c, g, or t
  modified_base (539)..(539): a, c, t, g, unknown or other
  misc_feature (539)..(539): n is a, c, g, or t
  modified_base (542)..(542): a, c, t, g, unknown or other
  misc_feature (542)..(542): n is a, c, g, or t
  modified_base (550)..(551): a, c, t, g, unknown or other
  misc_feature (550)..(551): n is a, c, g, or t
  modified_base (554)..(554): a, c, t, g, unknown or other
  misc_feature (554)..(554): n is a, c, g, or t
  modified_base (556)..(557): a, c, t, g, unknown or other
  misc_feature (556)..(557): n is a, c, g, or t
  modified_base (560)..(561): a, c, t, g, unknown or other
  misc_feature (560)..(561): n is a, c, g, or t
tcagagctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggccccaaactcctcatctataacaatgatcagccggccctcgacggggtccctggccgattctctggctccaagtctggcgcctcagccaccctggccatcgagtgggcctccgggcccgaggatggacggctgtatttattacgttgtcgtaggttgggatcgcngcctgactgtcttacgtcgttcggagtcgtcgggaccgtaggtcctaccggtctacggtcaacggaccccgaacggcccaaaccctctcgtaccctacctccgttccgttccccacccttcctacgtaccgtgacgtccttcgnggacgtcgggtcctgggaccgaacgggccncgtaagtacgnacngctgctgnngcncnngcnn

SEQ ID NO: 163993 - DNA, 351 bp, Homo sapiens
  misc_feature: GYAE6OF02H8LUG.47.55.E11.1.454.CMB.1.raw
  modified_base (342)..(351): a, c, t, g, unknown or other
  misc_feature (342)..(351): n is a, c, g, or t
tcagagctcacgtacacgaccggtgctcgatttagcactcgcacgttgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccagcctccaccaaggcccatcggtccttcccctggccgccctgctccaggagcacctcgagagcacacgcggcccgtgggctcgcctggtcaaggctacttccagtgagctctgagcggctggcaagggcacatannnnnnnnnn

SEQ ID NO: 163994 - DNA, 560 bp, Homo sapiens
  misc_feature: GYAE6OF02GP6O9.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcacgtgggtccgccaaactccaggtaagggctggtgtgggtctcacgtatcaatcctagatggcagtgttaataaattagtgacggtactccggtggaggggccgattccagcatctccagagacaacggcaagagtactatgtatcgtaggaatagaactaatcgtagagagtcgacgtagtacggctgtactatctattgttgtttacgagttcgtccgtttacggtcccggtacggtaccgttcggtcggggaccgtaccggggtacccttacggg

SEQ ID NO: 163995 - DNA, 690 bp, Homo sapiens
  misc_feature: GYAE6OF02H9JLU.47.55.E11.1.454.CMB.1.raw
  modified_base (239)..(239): a, c, t, g, unknown or other
  misc_feature (239)..(239): n is a, c, g, or t
  modified_base (245)..(245): a, c, t, g, unknown or other
  misc_feature (245)..(245): n is a, c, g, or t
  modified_base (258)..(258): a, c, t, g, unknown or other
  misc_feature (258)..(258): n is a, c, g, or t
  modified_base (546)..(546): a, c, t, g, unknown or other
  misc_feature (546)..(546): n is a, c, g, or t
tcagagctcacgtacacgaccggtgctcgatttagcactcgcacgttgggtttggggccgcagccctggattcccagctgtttctgcttgctgatcaggactgcacacagagagctcaccatggagtctgggctgagctggtttccttgtgctcttttaaaggtgtccagtgtcaggtgcgcctggtggagtcgggggagcgtggtccagcctgggacgtccctgagactctcctgtgnagcctntggcttcaccttnaattaattatcgctaatgcagtcgggtcctccgaggctccaggcgagggacttgagtggtgggacgtccatactcgtccaggttggacctatcttacagtaacgttacgcacgatcccccgtaggaccgggggtaccgtaatttccgaaccaaacggttccttaccccgaaaggcggtaaacccgtaaacgtttaccccgtaaacaaaccggtaaaccgggttcccttaagttaacccgttcggttacccaccgtttacgaaaccccttcggaacccttcggggaaanaaccgttacgacccgggaactaacccgggttattcccaccggttaaccctttacggtacccggtaggtacccgtagggtaaaaccgttgggttaaccggttaaccggacggtttaacctacggtttacgtttacgggtaaccgg

SEQ ID NO: 163996 - DNA, 606 bp, Homo sapiens
  misc_feature: GYAE6OF02FQ39S.47.55.E11.1.454.CMB.1.raw
  modified_base (446)..(446): a, c, t, g, unknown or other
  misc_feature (446)..(446): n is a, c, g, or t
  modified_base (466)..(466): a, c, t, g, unknown or other
  misc_feature (466)..(466): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttcctgttgctcttttaaaaggtgtccagtgtgaggtgcaggtagtggagtccgggggagcttagttcagcctggggagtccctgagactctcctgtgcagcctctggattcacctttagttcctcttggactgaattgggtccgcagactcgaggggaaggggctgggagtgggttgacaacagtaaatcagactggaagtcaagaaaacctagtgtaggactcgtcgtagaacgggaccgattcaccatcctaccgaagacgaacgaacggcccaaaggtaacctctacttagtttcnggtaacaaaggtcggaaccngtaccctggaacgtaggtaacgaaggacctcggacttggtataacgtttacgtgttagttcgtactcgtagtaccgccgtccgggtacccggtacgtttcgggactttccggcggggtcccctaggggtaacccctcggg

SEQ ID NO: 163997 - DNA, 631 bp, Homo sapiens
  misc_feature: GYAE6OF02IK7EH.47.55.E11.1.454.CMB.1.raw
  modified_base (420)..(420): a, c, t, g, unknown or other
  misc_feature (420)..(420): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggtttttccttgttgctcttttaaaaggtgtccagtgtgaggtgcaggtagtggaggtccgggggaggcttagttcagccgtggggagtccctgagactctcctgtgtagtctctggaatcagtttcagtaccttctggatgcacgtcgggtccgccaaactccgaggtaagggctggtgtgggtctcacgtatcaatcctagatggctagtgttaataattatgcgacttccggtgacggggcctattcgagtcactcctacagaacgacgaacganaagattatacgtgttaatcgtaggaaactagaaacctaagtcgaggagtaacggtaccgtaacggtacgtaaccgggtcttacggttacttaattaccgttagttttggtttacggttttcgtaacgttcggttccccgtttacggggttccccggtacgggttaccgtttccgggtacgggggacccgttaccggggtaacccgttcggg

SEQ ID NO: 163998 - DNA, 714 bp, Homo sapiens
  misc_feature: GYAE6OF02J0TLQ.47.55.E11.1.454.CMB.1.raw
  modified_base (274)..(274): a, c, t, g, unknown or other
  misc_feature (274)..(274): n is a, c, g, or t
  modified_base (399)..(399): a, c, t, g, unknown or other
  misc_feature (399)..(399): n is a, c, g, or t
tcagagctcacgtacacgaccggtgctcgatttagcactcgcacgttgggtttgggggtccggcgagcccgtgggattcccagctgtttctgcttgctgatcaggactgcacacagagagctcaccatggagtctgggctgagctgggttttccttgttgctacttttaaaggtgttccagtgtgacggtgcgaggtgtggagtccggggaggcttaggttcagccgtggggagttccctggtacgacgtctccgtggttagtacgtcttccgnggtaatcgtagtttgacgttaccttcgtcggtagtgacgtacgtcggtccgaccgtaaccgtaccgacggtaacgggtcgtggtcggttcgggtcgtcgtacgttatctaacttcgtgacgtggnttagggtcttaaagttaagttgtaagttacggtaaccttccgggtaggtacccggggtcgtacggttccgaggttcacgttcctacgacgtacgaacgtacggacaaagggtactaagtcgtagttactcgtaagaatcgaaatacgtacgaagtacgacgtacgaagttacgaacggtctacggtaccttagtaccgttaagttcggtttagtttaccggtaggttttaccggtaccgtttccgggtacccggttcgggtttacccgttcggggtaccgggtacccggtaacggggttacccccgttaacgggg

SEQ ID NO: 163999 - DNA, 759 bp, Homo sapiens
  misc_feature: GYAE6OF02HSJMH.47.55.E11.1.454.CMB.1.raw
  modified_base (119)..(119): a, c, t, g, unknown or other
  misc_feature (119)..(119): n is a, c, g, or t
  modified_base (204)..(204): a, c, t, g, unknown or other
  misc_feature (204)..(204): n is a, c, g, or t
  modified_base (234)..(234): a, c, t, g, unknown or other
  misc_feature (234)..(234): n is a, c, g, or t
tcagagctcacgtacacgaccggtgctcgatttagcactcgcacgttgggtttggggagcttcagctgtggtagagaagacaggattcaggacaatctccagcatggccggcttccctntcctcctcacctctcactcactgtgcagggtcttgggcccagtctgtgcctgactcagccacctcagcgtctcgggacccccggnacgacggtcaccatctcttagttctggaancagctaccaatgacggaaatcgatatgtaatactggtacagcaacgtcccacgaaccggaccccaactcctcgacttctaacgaactatcgactacgaacgcccggtaccctacgacggggttccccgtaggacccgttagttccgtccgtacgggtccctaccggtaacgttcggtacgggcccgtaccctacggacctacccgtaccccgtgggtacccctaagttacccggtggtaccgggggtcccgttaccccggggaccccggtaagggtaccgttcgggaaccgggttctttacggtaaaccttttagttaaccgggtttggttagggttaccgggtttagggaaccttccggacggtaaccggtttccaacggttaccgtgttacccgttaccgttacgggttacgtaccggttaccggtaacggggtaacccctaggggttaccctacccgggttaacccggtttggacccgaaccgggttccccgaaacgggtcccccctaaaccccgttaccgg

SEQ ID NO: 164000 - DNA, 559 bp, Homo sapiens
  misc_feature: GYAE6OF02GPB0N.47.55.E11.1.454.CMB.1.raw
  modified_base (269)..(269): a, c, t, g, unknown or other
  misc_feature (269)..(269): n is a, c, g, or t
  modified_base (515)..(515): a, c, t, g, unknown or other
  misc_feature (515)..(515): n is a, c, g, or t
  modified_base (539)..(539): a, c, t, g, unknown or other
  misc_feature (539)..(539): n is a, c, g, or t
  modified_base (543)..(544): a, c, t, g, unknown or other
  misc_feature (543)..(544): n is a, c, g, or t
  modified_base (547)..(550): a, c, t, g, unknown or other
  misc_feature (547)..(550): n is a, c, g, or t
  modified_base (552)..(552): a, c, t, g, unknown or other
  misc_feature (552)..(552): n is a, c, g, or t
  modified_base (554)..(559): a, c, t, g, unknown or other
  misc_feature (554)..(559): n is a, c, g, or t
tcagagctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaaccggcccccaaatcctcatctataacaatgatcagccggccctcgaggggtccctggccgattctctggctccaagtctggcncctcacgccaccctggccatcagtcgggcctcccggcccgaggactggacggctgatttacttactggttggtaggttgggactcgcagcctgacttgtcgtttacgtcgttcggacgtcgtaggggacctaaggtccaccggtccgtacggtcaccgcccgaacggaccccaacccgctcgtccactccgttacgttccccacccttccttacctacgtcgacgtcgtccgtaggacgtccgggntaccgggacgacggcgcaagtgancgtnnacnnnncncnnnnnn

SEQ ID NO: 164001 - DNA, 692 bp, Homo sapiens
  misc_feature: GYAE6OF02JEZUT.47.55.E11.1.454.CMB.1.raw
  modified_base (252)..(252): a, c, t, g, unknown or other
  misc_feature (252)..(252): n is a, c, g, or t
  modified_base (258)..(258): a, c, t, g, unknown or other
  misc_feature (258)..(258): n is a, c, g, or t
  modified_base (279)..(279): a, c, t, g, unknown or other
  misc_feature (279)..(279): n is a, c, g, or t
tcagagctcacgtacacgaccggtgctcgatttagcactcgcacgttgggtttggggagccgcagccttgggattcccagctgtttctgcttgctgatcaggactgcacacagagagctcaccatggagtctgggctgagctgggttttcctgttgctcttttaaaggtgtccagtgtgtaggtgcaggtagtggagtccggggaggcttagttcagctgggagtccctgagactcgtcctgtgtagtctgnggaatnagttcagtacttcgtggatgnacgtcggtccgcctaaaccgtccgtagggtaaggggccttagggtggtacggggttctaccggtacgttagtacctaaacgttcccgtaggtaacgtcggtaccgtaaggtttagttaacttaaaacgtttagtacggtcgggtaaccgttccgggtagggtacgggggtacccgacgtttacgacgggtcttacgtccttaccgagtaacggaaccgtaaacggacgtaaaggacgttaactacggttagttaacgtcgtaagggtaaattacgaaaccgtaattccgtagacgtagtaccgagtacgaccgtgtagtactagtacttagttcggttagtttagcgttacgtccgtttaacccgggtccggacggttacctttcgggacggtacccggtacgggtaacccgg

SEQ ID NO: 164002 - DNA, 854 bp, Homo sapiens
  misc_feature: GYAE6OF02GOBLT.47.55.E11.1.454.CMB.1.raw
  modified_base (726)..(726): a, c, t, g, unknown or other
  misc_feature (726)..(726): n is a, c, g, or t
tcagagctcacgtacacgaccggtgctcgatttagcactcgcacgttgggtttgggagccgcagccctgggattcccagctgtttctgcttgctgatcaggactgcacacagagagctcaccatggagtcgtgggctgagtcgttcgggttttccttgttgtccttacgttttaaaaggtgtccagtgtggaggtgcgtaggtagtggaggtccggggaggtcttagttcgaggccgtggggtactcccgtgacgtaccttcgtccgttggtacgttacgttcgttacgtacggtaactccgttaaggttttaccaacgtttaccctttcgtaggtatcggtaccgtacggttccggggttaccccgacccgtaaaaccgttccggtaaggggttaaccggggtccgttagggttacggttcgggttacctacgtaacgttactacctaacgttccgtagtacgtacggacgtagtttagtttaaattaaacgtttacgtacggtaccggtaccgttaccggtagggtaacgggtaccgtacgtttaccgaaggtcccttaacgttacccgaaccgtaagaaacccggtaaacgaaaccgggtaactaaaacgggtaacgttacgttaacgtttcggtaaacttaccgggttaaagaaaccgttagaaaacccttaagtaccggttaagggaacgtacgtacggtaaccgtaaggttaccccggtnttaacgtacttaacttacgttaaggtttttcggttacggtttaccgtgttacccgggttaccccggtttcgggaacccgtcggggtttacctttaccgggcggggtaaccccgttaacggttccccgg

SEQ ID NO: 164003 - DNA, 681 bp, Homo sapiens
  misc_feature: GYAE6OF02FO5PT.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcacgtcgggtcccacctaaacgtccgaagggttaacggggtcgttggtggtgggtctacacgtatcaatcctgagtggctagttagttaattaaatttagtgacggtactaccggtagggtacgggggtacctagttacgagtcctactccgtaccgaagacggaaccgaacgggacaaacggtataacgtacgttagttaactacgttaaggtaaatacggaaactaagttcgaggtaacgaggtaccgaaacggtacgttaaccgggtcgttacggttacttacttacgttagtttggttacggttttacgaactttccgggtcccggtttaccgggtccgggtacgggttaccgttccgggtacgggggaccccgttaacggggtaccccttcgggg

SEQ ID NO: 164004 - DNA, 781 bp, Homo sapiens
  misc_feature: GYAE6OF02H31OC.47.55.E11.1.454.CMB.1.raw
  modified_base (168)..(168): a, c, t, g, unknown or other
  misc_feature (168)..(168): n is a, c, g, or t
  modified_base (185)..(185): a, c, t, g, unknown or other
  misc_feature (185)..(185): n is a, c, g, or t
  modified_base (210)..(210): a, c, t, g, unknown or other
  misc_feature (210)..(210): n is a, c, g, or t
  modified_base (237)..(237): a, c, t, g, unknown or other
  misc_feature (237)..(237): n is a, c, g, or t
tcagagctcacgtacacgaccggtgctcgatttagcactcgcacgttgggtttggggagcttcagctgtggtagagaagacaggattcaggacaatctccagcatggccggcttccctctcctctccaccctcctcactcactgtgcaggtcttgggcccagtctgtnctgactcagccaccctnagccgtctccgggggacccccgganacggacggtcaccacttctcttgttcngggaagcagctcaaatgacggaatgaataatgtatactcgtacagactaacgtcccaacgaaccggacccccctaaactccctactactaccttaacgtaaactaactacgtactaccgaacggtccccggtacccctacgggtaccggggtaccccgtcgggtaaccccgtacgtttccgtaccgttacggtcccttaacccgaaaggttcccgtacgggtcccgtacccttaccgaccgtcccccgtaacccgtttggacccctaagttaccggtaaccggttcggggacccgttacccgggacccggaggtaacggtcgggacgttcgttaacgtacgttttaacgttaacggttgttacgggtttaaggggttacgggaccgttaccggtacgtaccggtaacccgttcgttaaccggtccgtttacgtttacccggtcgtttccgggaacggtcggttaaccgggtaacccgaggttaacccgtacccgtacgttacggtaccgaccggaaccctaacgggacccctaccccgtaccgg

SEQ ID NO: 164005 - DNA, 646 bp, Homo sapiens
  misc_feature: GYAE6OF02GO5FU.47.55.E11.1.454.CMB.1.raw
  modified_base (206)..(206): a, c, t, g, unknown or other
  misc_feature (206)..(206): n is a, c, g, or t
  modified_base (233)..(233): a, c, t, g, unknown or other
  misc_feature (233)..(233): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctcgggacccccggnagacggtcaccatctcttgtctggaancagctccaatatcggaaatgataatgtatacgtgtaccagcaacgtcccaacgaaccggaccccaaactcctacatctaataacaatgatcacgccgcctcgacgggtccctggccgtattcctcgtggtcctaccgtaacgttctacgggccctcccgtacgaccgccccgtacccgtcggaccctacgtcgacgggtcgggcccgtcccggggcccgaagggtagtcggtaacgggtccttaggttaactttaacgttacgttggttagggttagggttacgggtactacggcgtaacgtcccgtagtacctcggtaccgttacgttcgttacggacggtcggtacgggaccgtacgggtacctacccgttccgtaggtccgaccgacccgaaccggccctaacccgtacg

SEQ ID NO: 164006 - DNA, 770 bp, Homo sapiens
  misc_feature: GYAE6OF02ICGQM.47.55.E11.1.454.CMB.1.raw
  modified_base (650)..(650): a, c, t, g, unknown or other
  misc_feature (650)..(650): n is a, c, g, or t
tcagagctcacgtacacgaccggtgctcgatttagcactcgcacgttgggtttgggggccgcagccctgggattcccaactgtttctgcttgctgatcaggactgcacacagagagctcaccatggagtctgggctgagcttgggttttccttgttgcttcgttttaaaggtgtccagtgtgaggtgcaggtagtggaggtccggggagtcttagtcagccgtggggatcccgtgagactctcctgtgtagtctcgtggtaatctagtttcacgttaccttcgtggtactgactacggtcgggtacccgtaccctaaaaccgttccgaaggggttaacggggtccgttggggttacggtcggggttcctacggtaaccggttataccgtaaattcccgtaggtagtcggtatacggtttagttaaattaaacgttagtacggtaccggtaacgtccgggtaggggtaaccggggtaccgttaacgtttacgaacgtacctacgttacccgtacccgaaaaggtaccggaaaccggaaacggtacgaaaacgggtaacgttaacttaacggtagttaacgttacgttaaggaaaattaccgaaattaacgtcgtaaggtaacggtaccgtacggaacgtagtaccgggttnttaacgtacgtattcgtttagttcggtttacagttccggtacccggttcgggtccccggacggtttcgttaccgggtacgggtacccgttaaccggggtacccttggggacttacccggg

SEQ ID NO: 164007 - DNA, 907 bp, Homo sapiens
  misc_feature: GYAE6OF02IWGKO.47.55.E11.1.454.CMB.1.raw
tcagagctcacgtacacgaccggtgctcgatttagcactcgcacgttgggtttggggagcttcagctgtggtagagaagacaggattcaggacaatctccagcatggccgcttccctctcctcctccaccctcctcactcactgtgcgaggtcttcgggcccagtctgtgctgactcacgcccaccctacacgtcgtccgtacggggaccccccgggcacggaccggtccaccattccttcgtttgttacgtaggaagcacgcctaccaatagtaccggaaatgaataaatgtaatacgttacgggaaccaagactaaacgtccccgaaaccggaacccggaacccccctaaaacgttcctaccaacgttactaaactaaactaaagtacgactacgacggtacccgggtacccctcggtaaccgggggttcccccgtacggtacccgttaacgtttcccgttccggttacgggccccttaaaccggtaaacggtccccgttcggggtacccctccccgttaaccggaaccccgacccccgtaaccccgggtttcggtaaccccgaacgtttaaccgggtccggggtaccgggttccccggtaccccggggaccccgggtaaacggggtaagtccgggtaaaccgggttcgtttaacggttaaacgttttaaccggtttacgtacggggttttacgggtttaaggggttaccggggtaacgttaccgaccgtaaccggtttcccgtaggtacccggttcggtttaaccgtttaccgggtttcccgttccgggaacggttacccggttacggggtaaaaccgttaccgggttaacccgaccccggttttaggtaccgggttacccgaaccggtaccccggtaaacggtaccccccaaaccgttaccgg

SEQ ID NO: 164008 - DNA, 992 bp, Homo sapiens
  misc_feature: GYAE6OF02HQB4H.47.55.E11.1.454.CMB.1.raw
  modified_base (186)..(186): a, c, t, g, unknown or other
  misc_feature (186)..(186): n is a, c, g, or t
  modified_base (207)..(207): a, c, t, g, unknown or other
  misc_feature (207)..(207): n is a, c, g, or t
  modified_base (232)..(232): a, c, t, g, unknown or other
  misc_feature (232)..(232): n is a, c, g, or t
  modified_base (237)..(237): a, c, t, g, unknown or other
  misc_feature (237)..(237): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcaggtcttgggcccagtctgtgctgactcagcccaccctnagcgtctcggggacccccggnagaccggtcaccatcctcttgttcnggaancagctacaatatacggaaatgataatgtaatacgtggtaaccagacctaacgtaccccaaccggaaacccggacccccctaaaacttcccttaccgaacttaccttaaactaaaacctaaagtacgaacttaccgaaacggtccccgggtacccccttacggggaacccgggggttccccctaacggggtccccgttaacgttttcccggtaccgtttccggggtacccttaaaccccgtaaacgggtttcccggttaaccggggccccgttaacccccgttaccggaacccggtacccccccgttaaacccccgggttccgggggtaacccccctaaacggtttacccgggtaacgggttcccgggggggtaacccccgttacccccggggggaaccccgggtaaacgggggtaaaccgtttccgggggaaaccggggtccttttaacggggtaaacttttttaacgtttaaccggtttaggggttacgggtttaacgggggtttacggggtaaccgttcccgggtaaacgtacccggtaccgtttaacggtaacccgttttcggtaaacccgttttaccgggtttaccgggtttaccgggtaaccggttcccgggttaaaccggggaacccccggtttaaacggggttaccccccggttaaccccgggtttacccggttaaccggggttacccggaaacccggttaacccccccgggaaacggggtaccccccctaaacccccggttaaccgg

SEQ ID NO: 164009 - DNA, 679 bp, Homo sapiens
  misc_feature: GYAE6OF02I936R.47.55.E11.1.454.CMB.1.raw
  modified_base (197)..(197): a, c, t, g, unknown or other
  misc_feature (197)..(197): n is a, c, g, or t
  modified_base (229)..(229): a, c, t, g, unknown or other
  misc_feature (229)..(229): n is a, c, g, or t
tcagagctcacgtacacgaccggtgctcgatttagcactcgcacgttgggtttggggagagaagacaggattcaggacaatctccagcatggccggcttccctctcctcctcaccctcctcactcactgtgcagggtcttcgggcccaggtctgtgctgactcagcccaccctcagcgtcgtcggggaccccccggnaggaccggtccaccatctcttgttctggaacnagctccaatatcggaaatgataagtgtatactggtacagcagtcccacgaaccggcccccaaactcctacactctaactaacaatgactcacggccggccctcggacgggtcccgtaggccgtacttccgtccgttcggccttacccgtaagttccgtacggtaccgtcctcgacggtcccaccccgtgcccacgtccgtacgggtcggccgtcccggacccgtaggtctcggacggtctagtacttacgttacgtggtacggttacgggttcggtacgtcgaccgtacgtccgtgaccggtctaccgtaccgttcggttccggtaggtccgttacgggacccgtaacggttccgaccggttaccgtacggtaccgtaccggacccaaaccgggtacccctaacccgtcgtaccgtaccgtaccttccggttccttacccccgtaccccg

SEQ ID NO: 164010 - DNA, 578 bp, Homo sapiens
  misc_feature: GYAE6OF02F3RL0.47.55.E11.1.454.CMB.1.raw
  modified_base (311)..(311): a, c, t, g, unknown or other
  misc_feature (311)..(311): n is a, c, g, or t
  modified_base (572)..(572): a, c, t, g, unknown or other
  misc_feature (572)..(572): n is a, c, g, or t
  modified_base (576)..(577): a, c, t, g, unknown or other
  misc_feature (576)..(577): n is a, c, g, or t
tcagagctcacgtacacgaccggtgctcgatttagcactcgcacgttgggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcgacggggtccctggccgattctctggcctccaagtctggcgcctcacgccaccctggccatcaggtcggctccggccgaggntgaggctgattattactgtgtaggttggatcgcagcctgactgtcttacgtcttcggagcgtcgggaccaagggtccaccggttcctaggtccaggaccccaagggccccaaaccccgattcggtacctaccttccttccgttaccccacccttccctacgtacgtacgacgtcctacgtcgggaacgtccggggtacctcggggacccaacggggtccaccgtaacgttaggcaggtacacgctacgcgcgagtcgacgnctcnnc

SEQ ID NO: 164011 - DNA, 505 bp, Homo sapiens
  misc_feature: GYAE6OF02GIAFT.47.55.E11.1.454.CMB.1.raw
  modified_base (294)..(294): a, c, t, g, unknown or other
  misc_feature (294)..(294): n is a, c, g, or t
  modified_base (342)..(342): a, c, t, g, unknown or other
  misc_feature (342)..(342): n is a, c, g, or t
  modified_base (477)..(477): a, c, t, g, unknown or other
  misc_feature (477)..(477): n is a, c, g, or t
  modified_base (480)..(481): a, c, t, g, unknown or other
  misc_feature (480)..(481): n is a, c, g, or t
  modified_base (483)..(483): a, c, t, g, unknown or other
  misc_feature (483)..(483): n is a, c, g, or t
  modified_base (485)..(490): a, c, t, g, unknown or other
  misc_feature (485)..(490): n is a, c, g, or t
  modified_base (492)..(495): a, c, t, g, unknown or other
  misc_feature (492)..(495): n is a, c, g, or t
  modified_base (497)..(505): a, c, t, g, unknown or other
  misc_feature (497)..(505): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagccgtggggagtccctgagactctcctgtgtagtctctggaatcagtttcagtaccttctggatgcactcgggtccnccaaactccagcctaccaccaagggcccatcggtccttcccctggccnccctgcctccgaggacgccacctccgagagcacgacgcggccctgggctcgcctggtacaaggtccttacgttcctacggtgacgctactggacgtcggggactgggacaacgggtcgactaagttaggatgcancgnngncnnnnnngnnnncnnnnnnnnn

SEQ ID NO: 164012 - DNA, 573 bp, Homo sapiens
  misc_feature: GYAE6OF02GULZT.47.55.E11.1.454.CMB.1.raw
  modified_base (453)..(453): a, c, t, g, unknown or other
  misc_feature (453)..(453): n is a, c, g, or t
  modified_base (482)..(482): a, c, t, g, unknown or other
  misc_feature (482)..(482): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggaggtccgggggaggcttagttcagccgtgggggagtccctgagactctcctgtgtagtctctggaatcagtttcagttaccttctggatgcacgtcgggtccaccaaactccgaggtaaggggctggtgtgggtctcgacgtatcaatcctgatggactagtagtttataaattatgtacggactcggtgacggggccgtattcgagcactctaccaggagaccgaacggacaagagtaatactgtatctaggaaatnaaacatcagagagtcgaacgtagtaccgnttgtactatctagtttgttgtttcgattcggtcccgtttcgggttccggcgggttacttccggcggggtacccgtacggggtaccctcggg

SEQ ID NO: 164013 - DNA, 722 bp, Homo sapiens
  misc_feature: GYAE6OF02IY27K.47.55.E11.1.454.CMB.1.raw
  modified_base (138)..(138): a, c, t, g, unknown or other
  misc_feature (138)..(138): n is a, c, g, or t
  modified_base (363)..(363): a, c, t, g, unknown or other
  misc_feature (363)..(363): n is a, c, g, or t
  modified_base (605)..(605): a, c, t, g, unknown or other
  misc_feature (605)..(605): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgngtcgttgggttttccttgttgcttacttttaaaaggtgtccagtgtggaggtgcgaggtagtgggacggtccgggggaggtcgttagttcgaggccgtgggggtactcccgtgacgtacctctcgtgtgtagtctgtaggaactgagtttcacgttaccttgtggactgccgtacgtcggtacccgaccgtaaactccggagggtaagggtctggtggtcggtcncgtaacgttacgtactaacttcgtagagtggacgtagtagtttaataagttgtacggcgaacgttcggtagggacggggtacccgtagttcgacgtactacgtacccgtaagaaacgggtaaccgaaaccggtaacgggaactaaaacgggtaacttaacgttacgtttacggaacgtttacggtaaaggaaaaccgtaacggtaactaaacgtcggtaaggaaacgtcgaaacccgggtanaaccggttaggtcgtaaagttcctaaattcgtagtttggtttacgttgaaccgttcgttaccccggttgggtaccgcgggttacgttccgggacggggaccctacgggacccttggg

SEQ ID NO: 164014 - DNA, 637 bp, Homo sapiens
  misc_feature: GYAE6OF02FLIX6.47.55.E11.1.454.CMB.1.raw
  modified_base (186)..(186): a, c, t, g, unknown or other
  misc_feature (186)..(186): n is a, c, g, or t
  modified_base (206)..(206): a, c, t, g, unknown or other
  misc_feature (206)..(206): n is a, c, g, or t
  modified_base (244)..(244): a, c, t, g, unknown or other
  misc_feature (244)..(244): n is a, c, g, or t
  modified_base (300)..(300): a, c, t, g, unknown or other
  misc_feature (300)..(300): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctnagcgtctgggacccccgggnagacggtcaccatctcttgtctggaagcagctcaatancggaaatgatatgtatactggtacagcaagtcccacgaaccggcccccaaactccncactctaataacaatgatcacgccggcccgtcgacgggtccctggccgtatttctccgtaggcctaccgaagttcgtacggtccgcccttcgacggcccctaaccccgtcggaccctacgtccgtacggtcggggacccgttcccggggaccccggaagggtacgcgggtaacggtcgtaggttactttaacgttacgttggtttagggttacgggtttgggacgttccgacgtacggtccgttcgtacgtcgtcgttacgtcgttacgggagtcgtacgggactacggtaccgtaccgtcgtacggtcaccgtccaaccggtacccaacccgtacg

SEQ ID NO: 164015 - DNA, 488 bp, Homo sapiens
  misc_feature: GYAE6OF02G3W7Z.47.55.E11.1.454.CMB.1.raw
  modified_base (450)..(452): a, c, t, g, unknown or other
  misc_feature (450)..(452): n is a, c, g, or t
  modified_base (456)..(456): a, c, t, g, unknown or other
  misc_feature (456)..(456): n is a, c, g, or t
  modified_base (461)..(461): a, c, t, g, unknown or other
  misc_feature (461)..(461): n is a, c, g, or t
  modified_base (467)..(469): a, c, t, g, unknown or other
  misc_feature (467)..(469): n is a, c, g, or t
  modified_base (471)..(472): a, c, t, g, unknown or other
  misc_feature (471)..(472): n is a, c, g, or t
  modified_base (474)..(474): a, c, t, g, unknown or other
  misc_feature (474)..(474): n is a, c, g, or t
  modified_base (476)..(476): a, c, t, g, unknown or other
  misc_feature (476)..(476): n is a, c, g, or t
  modified_base (478)..(478): a, c, t, g, unknown or other
  misc_feature (478)..(478): n is a, c, g, or t
  modified_base (481)..(482): a, c, t, g, unknown or other
  misc_feature (481)..(482): n is a, c, g, or t
  modified_base (484)..(488): a, c, t, g, unknown or other
  misc_feature (484)..(488): n is a, c, g, or t
tcagagctcacgtacacgaccggtgctcgatttagcactcgcacgttgggtttgggggccgcagaccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactggggtccgccaaactccagcctccaccaagggcccatcggtcttccccctggccgcccctgcctccacggagccacctccggagagcacagccggccctgggctgcctggtcaaggctacttcctacgtgagcctctgagcgggctggcaggcgacagtagcannnacgnagtcngcagtnnngnncncncntgnngnnnnn

SEQ ID NO: 164016 - DNA, 611 bp, Homo sapiens
  misc_feature: GYAE6OF02HY551.47.55.E11.1.454.CMB.1.raw
  modified_base (371)..(371): a, c, t, g, unknown or other
  misc_feature (371)..(371): n is a, c, g, or t
  modified_base (458)..(458): a, c, t, g, unknown or other
  misc_feature (458)..(458): n is a, c, g, or t
  modified_base (500)..(500): a, c, t, g, unknown or other
  misc_feature (500)..(500): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggaggtccgggggaggcttagttcagcctggggacgtccctgagactctcctgtgtagtctctggaatctagtttcacgtaccttctggatgcacgtcgggtccaccaaactccgagggtaacgggctggtgtggtctcgacgtatcaactcctgagtggctagtatttaataaattntcggcgactccggtaggacggggctatcgagctatcctccgagaacgacgaaacggcaagtagtatacgtagtatacgtaagtaaanagtaaactaaatcgtagaagtacgtacgaacgagtaccggtntgttacctatcgttattgtttacgtttagtacgttcggtaccgttttccgggacccggtcgggttaccgttgggtaccgggggacccttaccgggggtaacccttaccggg

SEQ ID NO: 164017 - DNA, 727 bp, Homo sapiens
  misc_feature: GYAE6OF02IZO3V.47.55.E11.1.454.CMB.1.raw
  modified_base (161)..(161): a, c, t, g, unknown or other
  misc_feature (161)..(161): n is a, c, g, or t
  modified_base (231)..(231): a, c, t, g, unknown or other
  misc_feature (231)..(231): n is a, c, g, or t
  modified_base (335)..(335): a, c, t, g, unknown or other
  misc_feature (335)..(335): n is a, c, g, or t
  modified_base (479)..(479): a, c, t, g, unknown or other
  misc_feature (479)..(479): n is a, c, g, or t
tcagagctcacgtacacgaccggtgctcgatttagcactcgcacgttgggtttgggggccgcagccctgggattcccagctgtttctgcttgctgatcaggactgcacacagagagctcaccagtggagtctgggctagctgggttttccttggtttgctntttttaaaacggttgtccagtgtagagggtgcaggtaggtggagtccgggggagttcggtactataccgnggacgggtccgtacggtcgacacgtcctcgtcgttaaggtcgtacttcgtaaggtacctagttacgttacgttaacgttaccttacggtactcggtacgtaccnggttaccggccgtaaaccgtaccgaacgtaggggtacgtaggtgttacgggtcgttcgacgtactagtaactctacgtactggctacgtagttactaaagtttaactagtcggagtcccggtatcggggtacggacgtaccgtnacctaaggtcccacgtacgacgaacggacgaacgaacggtaataacgttagtaagttactaggttaaactagtaacggaatactacgagtagtcgaacgtacgtaagtaccgaattttcgggacttggtacttaattgtttaccggtttagtacggtttccggtaccgttcggtccccggtacgggttttccgtaccggggaccggttaccggtaaccgggggtacccctggggtaacccctacgggg

SEQ ID NO: 164018 - DNA, 575 bp, Homo sapiens
  misc_feature: GYAE6OF02JGXCO.47.55.E11.1.454.CMB.1.raw
  modified_base (182)..(182): a, c, t, g, unknown or other
  misc_feature (182)..(182): n is a, c, g, or t
  modified_base (206)..(206): a, c, t, g, unknown or other
  misc_feature (206)..(206): n is a, c, g, or t
  modified_base (217)..(217): a, c, t, g, unknown or other
  misc_feature (217)..(217): n is a, c, g, or t
  modified_base (221)..(221): a, c, t, g, unknown or other
  misc_feature (221)..(221): n is a, c, g, or t
  modified_base (231)..(231): a, c, t, g, unknown or other
  misc_feature (231)..(231): n is a, c, g, or t
  modified_base (259)..(259): a, c, t, g, unknown or other
  misc_feature (259)..(259): n is a, c, g, or t
  modified_base (286)..(286): a, c, t, g, unknown or other
  misc_feature (286)..(286): n is a, c, g, or t
  modified_base (313)..(313): a, c, t, g, unknown or other
  misc_feature (313)..(313): n is a, c, g, or t
  modified_base (329)..(329): a, c, t, g, unknown or other
  misc_feature (329)..(329): n is a, c, g, or t
  modified_base (348)..(348): a, c, t, g, unknown or other
  misc_feature (348)..(348): n is a, c, g, or t
tcagagctcacgtacacgaccggtgctcgatttagcactcgcacgttgggtttggggagctgtggtagagaagacaggattcaggacaatctccagcatggccggcttccctctcctcctcaccctctcactcactgtgcaggtcttggccagtctgtgctgactcagccacctgagcgtcncgggacccccggagacggtcaccntctcttgttcnggancagctcaatncggaaattgataatgtatactggtaccngcaacgtccacgaccgccccaatcctnatctataacaatgactcacgcgtcccngacgggtcctggcctntctcgtcggctccaagtcnggccacctcgacgccaaccgtggaccctatcacgttcggcttcccgggacccgagggacttacgggacggcctaggtaacctttattaaccgtggttaaccgttgggttcgaagttcgcttaacgcggttaccagtcgcttaacgtcgttgagtcctaggtacgagtccgtaactcgttaagccacggacccctaagggcccctaaaccctcgttctacccgtaccc

SEQ ID NO: 164019 - DNA, 723 bp, Homo sapiens
  misc_feature: GYAE6OF02IYCFT.47.55.E11.1.454.CMB.1.raw
  modified_base (603)..(603): a, c, t, g, unknown or other
  misc_feature (603)..(603): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggttttccttgttgcttacttttaaaaggtgtccagtgtgaggtgcgaggtagtggaggtccgggggagcttagttcagccgtgggacgtccctgacgactctcctgtgtagtctctaggatctagtttcacgttaccttcgtggatcgcctacgtcgggtacccgaccaaaccgtccgtaggggtaacgggtcgtgggttggtacgggtctcgaacgtatctaactccgtagacgtcggtctaagttagtttaaagttaaattgtacggtacggtaccgttacgggtacggacggggtacctaagttcgagtacctacttcccgtacgaagaacgaaacccggaacggaactaaacgtaagttaacgtacttgttaacgtacgtaaggaaactacgtaaactaagtcgtaaggaacgttacggtacgaagaacgttcgggtattcgttactaacgtttnttacgtttttcggtttcggttttacgacggtttaccgtcccgggttttccccggggaccggtccggtttaacgggttcccgggtaccggggaaccccggttacggggtacccgttcgggg

SEQ ID NO: 164020 - DNA, 754 bp, Homo sapiens
  misc_feature: GYAE6OF02INXSK.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagcgttgggttttccttgttgctacttttaaaggtgtccagtgtgaggtgcgaggtagtggaggtccgggggagtcttagttcgagccgtgggacgtcctgagtctctcctgtgtagtctctggaatctagttcagttacttctggatgctacgtggtcccgaccaactccgaggtagggcgtggttcggtggtctaccgtaggtactacgtaactccgtagaagtcggtatagttagtttaaattaaaagttgtcgggtacggtaccgtccggggttacggacgggggtaccgtaagtttacgacggtctaacgtccgtacgaacgtaacggaaccgtaaacggacgaaaggtaacgttacgttaaccgtggttaacgttacgtaaggtaaaacttacggtaaaacgtacttacgtaacgggtaaacggttaccggtacggtaaacggtaacgttacggtacgttagttaccgttaacgttaccgttacgtttttaacgggtttcggttttaaccgtaggttccgttttcccggggttaacccgggttcccgggttacgggttaccgtttccgggtaacccgggggtcccgtaaacccggggttccgttaccgggg

SEQ ID NO: 164021 - DNA, 751 bp, Homo sapiens
  misc_feature: GYAE6OF02H0CA3.47.55.E11.1.454.CMB.1.raw
  modified_base (375)..(375): a, c, t, g, unknown or other
  misc_feature (375)..(375): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtcagtgtgaggtgcaggtagtggaggtccgggggaggcgttagttcagccgtggggacgtcccgtgagacgtctcctgtgtagtctcgtaggaatctagtttcagtaccttcgtaggatgcacgtgggcccgaccaactccgaggtaaggggctagggtgtcgggtctacgtacgtatacaacgtcctaggatggactaggttnttaaagtaaaatttagtacggtaccggtaacgttccgggtacggggaacgggggtacccgtagttaccgaacggtacctaagtttcccaaccgaagggaaccgtaaaaccgaaacgggaaccgtaaaaggtacgttaacttaacgtagttaacgttaccgtaagggtaaaataacggtaaaactaacgttacgtaagtaaggtaaacgttaccgaaacggttaacggttaccggtcgtttacggtaactttaacgttacgtagtttttgggttttacgttttaccgaagtttcccggtaacccggttttcccgggtccggtaaccgggttcgttccgggttacggggggtaaccctaccggggtaacccgttcggg

SEQ ID NO: 164022 - DNA, 673 bp, Homo sapiens
  misc_feature: GYAE6OF02FQSOJ.47.55.E11.1.454.CMB.1.raw
  modified_base (270)..(270): a, c, t, g, unknown or other
  misc_feature (270)..(270): n is a, c, g, or t
  modified_base (342)..(342): a, c, t, g, unknown or other
  misc_feature (342)..(342): n is a, c, g, or t
  modified_base (592)..(592): a, c, t, g, unknown or other
  misc_feature (592)..(592): n is a, c, g, or t
tcagagctcacgtacacgaccggtgctcgatttagcactcgcacgttgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcacgtcgggtccgacctaaactccgagggtaagggctggtgtgggtctcacgtatcaatcctgatggctagtgttataaattntggcgactcggtgaggggccattcagcatctcagagacaaggcaagagtatactgtatcgtaggaaatgaanatcgagagagtcgacgatacggcttgtctatctatttgttcgttttacgattccgtccgtttccgggtccggtacgggtacctttcgggcgggggtaccctaacgggggtaaccccttggggtaccctagggtcccgtttccgttcccgtacgtaccgtcccctacccgaacccggaaccgggtccccctagttccccggttccctttcccccgttgggcccctcccgttcgcccttccgacgggtaccncctacccgtaccggaggaccgtccgaacgccggtccgggtcccgtcggggcccttccggcccgttacggaccgtaaccggg

SEQ ID NO: 164023 - DNA, 783 bp, Homo sapiens
  misc_feature: GYAE6OF02JOFLV.47.55.E11.1.454.CMB.1.raw
  modified_base (294)..(294): a, c, t, g, unknown or other
  misc_feature (294)..(294): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggtcttagttcagcctgggggatccctgagactctcctgtagtagtctctggaatcagtttcagtaccttctggatgcactgggtccncaaactccgaggtaaggggctgggtgtgggtctcacggtatcaacgtcctgtatggcaggttgttaataattagttcggaccggtacttccgggtggaacgggggtccgtaagttccgtaggaccgtacgttaccgtacccgtaagggtaacggaaccgtaaccgggtaaccgaaacgggtaaacgtttaaacgttaaccggtttagggttaaaccgttaccggtttaaggggttaaaacttaacggtaaacgtaaaacgtttcccgttaaggtaacgggttaaacggttaaccgggtaaccggttaaacggttaaacccggggtacttacggtttaaccgttacgttaacccgtttaggttttaccggtttacgggttttttaacgtacggtttaccggttacccgggttttccgggttaccccggtacggggtttaccgttccggttaccggggggtacccctaacggggggtaccccttaacgggg

SEQ ID NO: 164024 - DNA, 697 bp, Homo sapiens
  misc_feature: GYAE6OF02IYPHF.47.55.E11.1.454.CMB.1.raw
  modified_base (239)..(239): a, c, t, g, unknown or other
  misc_feature (239)..(239): n is a, c, g, or t
tcagagctcacgtacacgaccggtgctcgatttagcactcgcacgttgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgaccaaactccagggtaagggctggtggtggtctcacgttancaatcctgatgggctaagttgttaataaaattagtcggcggtaacctccggtagggaacggggccgtaagttcaggcagtcctaccgaagagaacgaacggcaagagtatactagtatctaggaaaatgaaactatcgtagaaggtacgtacggaacgagtaccggctagttctaattcgtagtttcggttcgttttccggattcggttccgtttccgggtcccggtacgggttaccgttcggtcgggggaccgtacgggtaacccgttcgggtcgtaacgccgttccttccgtcgaccgtccctaccgaaccgaccgggaccctacggttccggttcccttccccgtcggtcccgtcccgtccgcccgtaccgacggacgccgtacccgtccgacggaccgaccgaacgcggtccggtccgtcgggtccgtcggcccggttacgtaccggtaaccgg

SEQ ID NO: 164025 - DNA, 783 bp, Homo sapiens
  misc_feature: GYAE6OF02GQG6Q.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggagcttagttcagccgtggggactccctgagactctcctgtgtagtctctggattcatcttcagtgactacgacatcgcacgtcgggtcccgaccgtaaggttcgacgaaggtaacgtaaaccccgttgttagggtaaacgttcgggggttccctttaccgggttttaattcggtaccgtttaacggttcggggtttcggggttaccgaccccgtaaaccggtaacgtaaccgtttacggttacggtaccgtacgggttacccgttacccggggtagggggtaaccgggggacccgttaacgtttacccgtaaacccgtaacgttacccgttacccggtaaaggtaaaggtaaaaacgttcggggaacctaaaaccggtaaccctttacccggtttaagttaacgttacctttaaaccgtaaaacgttacgaaaccgtacgtacccgtaggaacgggtaccgggacccggggtacgaccggggtcggttaagttaacgttacgtaggtagtaaggagtacgtacgtacggtaagtacggtaacggtagggttacttagttcgttacgtttagattacgg

SEQ ID NO: 164026 - DNA, 752 bp, Homo sapiens
  misc_feature: GYAE6OF02JU8F7.47.55.E11.1.454.CMB.1.raw
  modified_base (435)..(435): a, c, t, g, unknown or other
  misc_feature (435)..(435): n is a, c, g, or t
  modified_base (666)..(666): a, c, t, g, unknown or other
  misc_feature (666)..(666): n is a, c, g, or t
  modified_base (723)..(723): a, c, t, g, unknown or other
  misc_feature (723)..(723): n is a, c, g, or t
tcagagctcacgtacacgaccggtgctcgatttagcactcgcacgttgggtttggggccgcagccctgggattcccagctgtttctgcttgctgatcaggactgcacacagagagcctcacctagtggtacgtcgtcggtctagacgtcggtttcggtttttcttgttcgtcttttaacgttttaaaggtcgtaccgtaggttggtaggtaggtcgacggtaggttaggtggtaccggggtccggggtagttacgtttagttcgaccgtccggtagggtaccgttccgtagacgtccttccgtcgtgttagtacgttctacgtagtactcgttacgttacgtacgttccgttgtagtacgtcgacgttacggtaccggtcccaaccgtaaccgtcggtaagggtacggtcgtggtggttcggtcacgtagttacncgtacgttcgtagacgtcgagtacgttagttaataagttacgcggacgttacgttacggtacggtaccgggtactattacggacgtactacgtaccctacgaaggtaaccgaaacggtacgtaacgtaaggtaacgttacgtacgtaggtaacttacggaaagtaacgtaacgacttacgtcgagacggtaccgtacgagttaacgcgttactgttaactacgtaggtttnttaacggtttcgtaagtcttccggtacccgttacggtaccggtaggttttacccggngggtaccggtaacggtccgttacggtcgg

SEQ ID NO: 164027 - DNA, 612 bp, Homo sapiens
  misc_feature: GYAE6OF02FKMRA.47.55.E11.1.454.CMB.1.raw
  modified_base (352)..(352): a, c, t, g, unknown or other
  misc_feature (352)..(352): n is a, c, g, or t
  modified_base (374)..(374): a, c, t, g, unknown or other
  misc_feature (374)..(374): n is a, c, g, or t
  modified_base (406)..(406): a, c, t, g, unknown or other
  misc_feature (406)..(406): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaacctccgaaggtaaggggcctggtgtgggtctcacgtatcaatcctgatggcagtnttataaattatgcgtactccgngaggggccattcagcatctcagagacaacggnaagagtactatagtatcgtagaatagaaacaatacgtagaagtacgtacgaacgagttaaccggacgtcgttacgttattccgttagtttacggtttggtttttaccgagtttcggttaccccgtttccggggttacccggtccggggttaacccgtttccgggtcgggggtaccccggtaacggggtaaccccccgttacggggg

SEQ ID NO: 164028 - DNA, 689 bp, Homo sapiens
  misc_feature: GYAE6OF02HRAC5.47.55.E11.1.454.CMB.1.raw
  modified_base (189)..(189): a, c, t, g, unknown or other
  misc_feature (189)..(189): n is a, c, g, or t
  modified_base (223)..(223): a, c, t, g, unknown or other
  misc_feature (223)..(223): n is a, c, g, or t
  modified_base (242)..(242): a, c, t, g, unknown or other
  misc_feature (242)..(242): n is a, c, g, or t
tcagagctcacgtacacgaccggtgctcgatttagcactcgcacgttgggtttggggagcttcagctgtggtagagaagacaggattcaggacaatcctccagcatggccggccttccctctcctcctccaccctcctcactcactgtgcaggtcttgggcccagtctgtgctgactcagcccaccctnagccgtcgtcgggaccccggcagacgtccaaccntcctcttagtcgagaacgnagcctacaatagtacgaatgagtaatgtatactcggtaaccagaccaacgtacccgaaccgaaccggtacccccaaaacgtccctacaactacttacgtaaaccaattacggactacgacgcccggtaccctaccggaccggggttcccgtccggaccgtaacgtttccgtacgtcggtaccgtaccgtaagtccgtcggccgtccgtacacgtccccgtaccgttccgaccgacgttccgaacggtccgggtcccgtacccgggacccgggaacgggtacgtacggtaacgggacgttacggttaacttaagtttaccgtggttaaccgggtaggtttacggggtccttaccggccgtacgtactcgtaccgtcgtaccgttcgtacgtcgtagtccggagtccgagtccgtactcgacgtcaccgtacccgacgcccgaacctcg

SEQ ID NO: 164029 - DNA, 794 bp, Homo sapiens
  misc_feature: GYAE6OF02IQZ7P.47.55.E11.1.454.CMB.1.raw
  modified_base (631)..(631): a, c, t, g, unknown or other
  misc_feature (631)..(631): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtcagtgtgaggtgcaggtagtggagtccgggggaggtcttagttcagccgtggggagtccctgagactctcctgtgtagtctctaggaatcagtttcacggttaccttctggatgcacgtgggtcccgccaaactccgaggtaacgggtctgggtgtgggtctacgacgttactactaacgtccgtgtacgttggaccgtaggttagtttaaattaaattttagcggtcccgggtaacgttcccggtaggggaacgggggtccgtaagtttccgaaggcctacgttccgtaaccctaagggtaaccggaacgaaaccgggacgtaaacgggttaagttaacgttaaccgttaggtttaactaccggtttaaagggaaaacgtttaacggtaaaacccgtaaattcccggttaaggaacggttaaaggtacccgggtaaaccggtaacgttaacccgggtnttaacggtttaccgttaacttaccggttacgttttagggttttaccgtttttaaccggtacgtttaccgttaccccggggttttcccgggtcccgggggttaccgggtacctttaccgggggttccggggacccggttaaccgggggttaaccccggttcggg

SEQ ID NO: 164030 - DNA, 761 bp, Homo sapiens
  misc_feature: GYAE6OF02GPV6V.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgcttacgttttaaaaggtgtccagtgtgaggtgcaggtagtggagtccgggggagcttagttcagccgtgggagtccctgagactctcctgtgtagtctcgtggaatctagtttcacgttaccttcgtggtactgcctacgtcgggtacccgaccctaaaacgtccggaaggggtaacgggggccttaggggttcgggttacggggttacctaccgtaacgttactaccgtaaacttccccgtagtacgtcgggtactaaggtttacgtttaaattaaaacgtttagtcggtaccggtaacccgttccgggtagggtaccggggtacccgtagttaccgacggtacctacgttacccgtaccgaaggaaccgtaaccgaaacggaccaaaggtaaggttaactacgttaggttaacgtacgttaaacgggtaaattaacgaaacctaattacgagtaacggtacgtaacgaacggtacgtaccggtactgtaactagttacttaggtttgttacgttttacgacgttccggtcccggtttaccgggtacccggtcgggttacccgtttcgggaccggggtaacccgtaccgggtaacccgttcggg

SEQ ID NO: 164031 - DNA, 722 bp, Homo sapiens
  misc_feature: GYAE6OF02J08JM.47.55.E11.1.454.CMB.1.raw
  modified_base (631)..(631): a, c, t, g, unknown or other
  misc_feature (631)..(631): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaggtgtccagtgtgaggtgcaggtagtggagtcggggaggctttagttcagccgtggggagtccctgagactctcctgtgtagtctcgtggaatctagtttcagttaccttctggattcgctacgtcgggtcccgaccgtaaacctccgaggttaacggggcttagggttcggttcggggtacctaccgtacggtactaccgtaaacgttccctaggagttacggaccgttaaggttaggttttaactaaaggttttacgtcgggtacggtaccgttaccgggtagggaccggggtaccgtaattcggtaacgcgtaactccgtaaccggtacgaaggtaaccgaacgggaactaaacggtacgttaacgttacgtagttaacttacgtaggtaaagtacgaaatacgtacgaaggtacgacgttacggaacgtacgtaacggtcgttagaccgttaataccgttnttacggttttacggtttacgacgttcggtacccggtttccggccggttcggttaccgttcggtaccgggacgttacccgggtacttccggg

SEQ ID NO: 164032 - DNA, 892 bp, Homo sapiens
  misc_feature: GYAE6OF02HEZYF.47.55.E11.1.454.CMB.1.raw
  modified_base (228)..(228): a, c, t, g, unknown or other
  misc_feature (228)..(228): n is a, c, g, or t
  modified_base (723)..(723): a, c, t, g, unknown or other
  misc_feature (723)..(723): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctaccaccctcctcactcactgtgcgtagggttcgttcgggccctagtctgtcgctagactcgacgcccacctcgacgtccgtccggtaccggggacccccggngaacggtaccgtaccacctacttcctttcgtttcggttacgtaacgggaacgtccacggtccttaacaagttacgtaacggtaaatgtaaattaagttgtaacgttacgtacggtaacagaccgtaaccgtaccccgaaacccggtaaccccgaaccccctaaacgttccctaacctaacttaccgtaaactaaaccgtagtacgtaactaccgacgggccccgttacccgtacgggttaccggggtaccctacggtacccgttatttcccggtacgtaccggtacccttaacggtaacggttccgtaccgggccctaccgtacccgaaccgttacccccgtaccggtcgacctaacggttccggtacggggttacccgggccccggtaacccgggaccgggtaagttacggtggtaaccggttaccgttaagtttaaactttacgtttaacgggttcggggttaggggtttaaccgggtcggtaccttacccgngttaacggtccgttacgttaaccggtcgtttaacccgtttacgggtttccggtacgggaaccggttccggtaaaccggggtaacccgttaaccgggttcccctaaccgggtttccgtaacgggtcccaaacccgggttaaccccgacccgttacccccgtaccgttacg

SEQ ID NO: 164033 - DNA, 556 bp, Homo sapiens
  misc_feature: GYAE6OF02JH2YH.47.55.E11.1.454.CMB.1.raw
tcagagctcacgtacacgaccggtgctcgatttagcactcgcacgttgggtttgggggaagaggagactgacggtcctgccacaggtggtgctgggcacggtgggcactcgacacaacatttgcgctcaactgtcttgctcaccatggagtctgggctgagctgggttttcctgttgctctttaaaggtgtccagtgtgaggtgcaggtagtggagtccgggggagcttagttcagcctggggagtccctgagactctcctgtgtagtctctggattctcctttacgtagttatgccatgtcttaaaaggtccgccaggctccagggaacggggcgtggaggtgggtcgtcgaggcagttggtggtagtggtgtcgaggacacgattacgtaagtccctgcgacgggccgattcgtttatctccagagactaactacgagaacatactgattctgcagtgacagactagagagtgagacgacgaccgtatagtagttcgttagttaagtggagtggtcgtcgtacgtacgtacgttcgggtacccgggtaacccgg

SEQ ID NO: 164034 - DNA, 728 bp, Homo sapiens
  misc_feature: GYAE6OF02JEFKD.47.55.E11.1.454.CMB.1.raw
  modified_base (609)..(609): a, c, t, g, unknown or other
  misc_feature (609)..(609): n is a, c, g, or t
tcagagctcacgtacacgaccggtgctcgatttagcactcgcacgttggggtttggggagccgcagccctgggattcccagctgtttctgcttgctgatcaggactgcacacagagagctcaccatggagtctgggctgagcttgggttttccttgttgcttacttttaaaaggtgtccagtgtgaggtgcaggtagtggaggtccggggagtcgttagtcaggtccgtggggacgtcccgtaggacgtactctccgtgtgtagtctcgtaggaatcgtagtttcacgttaccttctaggtatcgacgtacgtcgggtacccgacctaaacgtccgaagggtaacgggtcgttacggtggtcggtctacgtacgttactacgtacgtccgtagagtcggactagttacgtttaataaatttaggtacgtccggtaccttacgggtacggggtaccggggtaccgtacgttaccgtacgtcttaaacgttccgtaaccgaagggtaaccgaaccggtaacggacaaaggtagttaacttacgtgttaacgtacgttaaggaaattacgaaactagtcgtaggaagtacgtaccgtaagtacgttaccggntttacgtacgttaattcgttcgtttacggtttcggtttaccgaattccgggtaccccgtttccgggtaccggtaccggtttacggtccgggtaacggggacccgtaaccgggttaccgg

SEQ ID NO: 164035 - DNA, 733 bp, Homo sapiens
  misc_feature: GYAE6OF02G65L0.47.55.E11.1.454.CMB.1.raw
tcagagctcacgtacacgaccggtgctcgatttagcactcgcacgttgggtttggggagctgtggtagagaagacaggattcaggacaatctccagcatggccggcttccctctcctcctcaccctcctcactcactgtgcgagggtcttgggcccagtctgtgctgactcacgcccaccctcacgcgtcgtcggggacccccgggcacgaccggtcaccacttccttctttgttcgtgggaacgcacgcctaccaatacgtacggaaatgaataatgtatactcggtaaccagacaacgtcccacggaaccggacccccaaactcctcactactaactaacaatgtactacgcgaccggccctacggacgggttccccgtcggaccgtacttccgtcgtggtcctaccgagtcgtcggaccgtccgtcacgccctaccgtccggccacgtcgacggtcggtcccggtccccgggccggaggcgtacggacggtacgtaggttaactttaacgttacgttgggttacgggttaacgggtttgggaacgttcggaccgtacggtcccgttaggtaccgttcgttacccggtttcgtttacccggttacgggtacggttcccggtacggggaaccgttaccgggttacccgtacccggtaccgggttaccggtacccggtacccgacccggtaaccggacccccgttaacccgcgttaccgtaccgttaaccccg

SEQ ID NO: 164036 - DNA, 799 bp, Homo sapiens
  misc_feature: GYAE6OF02HLCVH.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggttttccttgttgtcttacgttttaaaaggtgtccagtgtgaggtgcgaggtagtggacggtccgggggaggtcgttagttcgaggtccgtggggtacgtcccgtggacgtacgttcctccgttgttcggtagttccgtcgtacggtaacttcgtagtttacctacggttaccctttcgtggtatcgtaccaccggttcgggtaccccgaaccgtaaaccgttaccggtaagggttaacggggtccggttgggtcggttcgggttcctaccgtaccgttaactaccgtaacttccgtagtacgtcggtacgtaagttacgtttaaattaaagtttacgttacggtaccggtaccgttaccgggtagggacggggtacccgtacgttacgtacggtactacgttaccctaccgaaaggtaaccgaaaccgtaaacgggactaaaggtaacgtttactacggtagttaaccgttgtaaagaaacctacgtaaataaccgttgaacggtaacgtacggtacgaaggtacgttacgtactcggttacttagtccgttagtttcgttttacggtttacgacgtttccggtaccgtttccggggaccggttacggttccggtttaccgggacggggttaccccgacggggttaccctcggg

SEQ ID NO: 164037 - DNA, 636 bp, Homo sapiens
  misc_feature: GYAE6OF02GHIMJ.47.55.E11.1.454.CMB.1.raw
  modified_base (368)..(368): a, c, t, g, unknown or other
  misc_feature (368)..(368): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggaggtccgggggaggcttagttcagccgtggggagtccctgacgactctcctgtgtagtctctggaactctagtttcagttaccttctggattgactacgttcggggtcccaccctaaactcccgaagggtaagggtctgggtggtgggtctcgtacgtatactaatccgtagntcggctagtagttaataaattgtgcgtacgtcgtaggacgggacctagttcagtctatccgtacgaggtaacgaacgaacggtagaaaggtatacttacgtagttacttcgtaaagtaatacgaaatagtacgtagagtacgtacgagtacgtacggtctagtcttactgtagttttgttacggtttcgacgttccggtccgttttaccgggcccggttacggtccgtttaccgggccggggtaccgtaacccggggtaccctacggg

SEQ ID NO: 164038 - DNA, 658 bp, Homo sapiens
  misc_feature: GYAE6OF02G16EH.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctactttaaaggtgtccagtgtgaggtgcaggtagtggagtccgggggagcttagtcagcgtgggactccgtgagactctctgtgtagtctctaggaatctagtttacgacgtaccgttctggtatcgctacgttcgggtaccgaccctaaacctccggaaggtaacggggcttgggttgtcgggttactctaacgttatacaacttccgtagtgtacggctaggttatttaataaaattgtaggccgtaccgtcgggtagacggggtactagtccagaccgtacttccaacgtagaacgaaccgaaacggacgtaaacggtattatacgtagttacgtacggaggtaaactagaaactagtaccgtaagtacgtaacgtaccgaagtacgtcgtactagtacttagtactttagtttcgtttcgacgttccggttcccgtacgggtcccgttacggtacgtttccgggacgggttaccggtaccggtaccgtggtaacccg

SEQ ID NO: 164039 - DNA, 700 bp, Homo sapiens
  misc_feature: GYAE6OF02IC3GO.47.55.E11.1.454.CMB.1.raw
  modified_base (586)..(586): a, c, t, g, unknown or other
  misc_feature (586)..(586): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgtctcttttaaaaggtgtccagtgtgaggtgcaggtagtggaggtccgggggagtcttagttcagccgtggggactccctgacgactctcctgtgtagtctcgtaggatctagtttcagttaccttgtggattcgacctagtcgggtacccgacaaaccgtccgaagggtaacggggtcgttgggtggttcgggtcctcgtaacgttatacctaaacgttcctaggacgtggacgttagttagtttaaataaagttgtcggtacggtaccgttccgggtagaccggggtccgtattccgacgtactagtccgtaccgaaggtaacgaacgtaaaccggaagaaagtacgtaacttagtacggttaatacgtaaggtaaactacgaaataaacgtcgtagaaggtacgttaaccgagtaacgttacccggtnttcgttaactagttacttgttttaggtttccgtttagaccgttccggttcccgttacgggtcccggttacggttaccttccggggtacgggtaccctaccggggaccgttcggg

SEQ ID NO: 164040 - DNA, 749 bp, Homo sapiens
  misc_feature: GYAE6OF02H5QBW.47.55.E11.1.454.CMB.1.raw
  modified_base (308)..(308): a, c, t, g, unknown or other
  misc_feature (308)..(308): n is a, c, g, or t
tcagagctcacgtacacgaccggtgctcgatttagcactcgcacgttgggtttgggggaagaggaagactgacggtcctgccacaggtggtgctgggcacggtgggcactcgacacaacatttgcgctcaactgtcttgctcaccatggagtctgggctgagcttgggttttcctcgttgcttcttttaagaggtgtccagtgtcaggtgcgcctggtggaggtcgggggagcgtggtccaggccgtggggatcccgtgacgactctcctgtgtagtctcgtggaatctagtttcagttaccctttgnggattgactacgttcgggtacccgacctaaacgtccgaggggtaacgggtctgggttggtcgggtctacgacgttactacctaacgttccgtaggagtcggacgtaaggtttacgtttaaattaaacgtttcgtaggtaccgggtacccgttcggggtacgggaaccgggggtcttacgtttacggacgtacctacgttacccgtaccggacggtaaacgaaccggtaaacccggtacgtaaacggtaacgttacttacgtacgtttaacgtacggtaaggttaaaacgtaacgtaaacgtaacttacgtaggaaacggttaccggtacgttaacgtacggtaacccggttcgttacggttaccttagtacgtttagtttcggttttacggtttacgacgtttcccgggttacccggtttcccggtacgggttacccgggg

SEQ ID NO: 164041 - DNA, 789 bp, Homo sapiens
  misc_feature: GYAE6OF02I95TJ.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggttttccttgttgcttacttttaaaggtgtccagtgtgaggtgcaggtagtggaggtccgggggagtacgttagtacgacccgtggggggtccctggacgacctctccgtgtcgcacgtcctcgtcggactcctacctttagccaactctgtctagtcgggcgtcgggtccgccgtacgggtccggtaccggggggaacgggtcgtaggggtacggttcggggtaccttaccgtaaaggttagttacggtaagttagggtaaggtaaaggtggggttaacggaaacggtacctaacgttaacgttccggttaaccgggtaggtaccggttacccgggtacggggtaaccgggggttacccgttaccgtaacccgtacgttacccgttaccggaaacgtaacggtaaaccgtttaacgtttcccggaaaggggactaccggacgttaaccgttggttaacctaccttaaacgtaaagtacgaaaccgtacgtccgtaagggaccgtaacggaaccggtaccggaaccgtaccggtaccgtttaattaaccgtttacgtaggaccgtaacgtaacgtactaagtacgacgtacgttcccgacccctaggccgtacttaccgtttctacggtccgttcggtaaccggg

SEQ ID NO: 164042 - DNA, 571 bp, Homo sapiens
  misc_feature: GYAE6OF02IGL8Y.47.55.E11.1.454.CMB.1.raw
  modified_base (371)..(371): a, c, t, g, unknown or other
  misc_feature (371)..(371): n is a, c, g, or t
tcagagctcacgtacacgaccggtgctcgatttagcactcgcacgttgggtttgggggccgcagccctgggattcccagctgtttctgcttgctgatcgggactgcacacagagagctcaccatggagtctgggctgagctgggttttccttgttgctcttttaaaaggtgtccagtgtgaggtgcaggtagtggagtccgggggagcttagtcagcctgggagtccctgagactctcctgtgtagtctctggaatcagtttcagttaccttctggatgctacgtcgggtccacctaaactcccgaagggtaaggggcttgggtgtcgggtactcgacgtatcaatcctagatggcagttgttaataaatntcgacggactcggtggacgggccgtattcgagtcatcctcgaagacgaacgaacggacaagagtatactagtatacgtagaaatagaactatacgtagagagtcgaacgagtacgcgtgtactatacgtattgttgttttcgatcggtccgttcggtccgacgggtacttcggtcgggtcccgtaggtacccgtggtccg

SEQ ID NO: 164043 - DNA, 681 bp, Homo sapiens
  misc_feature: GYAE6OF02I1C25.47.55.E11.1.454.CMB.1.raw
  modified_base (230)..(230): a, c, t, g, unknown or other
  misc_feature (230)..(230): n is a, c, g, or t
  modified_base (629)..(629): a, c, t, g, unknown or other
  misc_feature (629)..(629): n is a, c, g, or t
  modified_base (632)..(632): a, c, t, g, unknown or other
  misc_feature (632)..(632): n is a, c, g, or t
  modified_base (646)..(646): a, c, t, g, unknown or other
  misc_feature (646)..(646): n is a, c, g, or t
  modified_base (648)..(648): a, c, t, g, unknown or other
  misc_feature (648)..(648): n is a, c, g, or t
  modified_base (657)..(657): a, c, t, g, unknown or other
  misc_feature (657)..(657): n is a, c, g, or t
  modified_base (659)..(659): a, c, t, g, unknown or other
  misc_feature (659)..(659): n is a, c, g, or t
  modified_base (665)..(665): a, c, t, g, unknown or other
  misc_feature (665)..(665): n is a, c, g, or t
  modified_base (670)..(670): a, c, t, g, unknown or other
  misc_feature (670)..(670): n is a, c, g, or t
  modified_base (674)..(674): a, c, t, g, unknown or other
  misc_feature (674)..(674): n is a, c, g, or t
  modified_base (679)..(679): a, c, t, g, unknown or other
  misc_feature (679)..(679): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagcgttgggttttccttgttgcttacttttaaaaggtgtcctagtgtgaggtgcgaggtagtggaggtccgggggaggtcttagtcagtccgngggtacgtcctgaagctctctgtagtatctctggaatctagttctacgtaccttctggtatcgctacggttcgggtacccgtacctaaaacgtcccgacgtccctacccgaacccgtaaacggggcccctacggttcccggttccccgttcccccgtcgggtaccccgtccccttccggccctccggtaaacggaccgacccgtacctaccccggagaacggtcccaacggaccgtccgggtccccgtaggggccctacgggtccgtccgggtaacgaaccggtaacccgttaaccgttcccgttacggtacggtaaccgtcgttacccgtaggacggtaccgggttcggtaccgggtacgaaacccggggtcgtaaccgaaacggtccgtaagcggcncgngcgacgcgagagcncnactcgtcgncncgtcgngacgngtcncagcntc

SEQ ID NO: 164044 - DNA, 804 bp, Homo sapiens
  misc_feature: GYAE6OF02F84UP.47.55.E11.1.454.CMB.1.raw
  modified_base (233)..(233): a, c, t, g, unknown or other
  misc_feature (233)..(233): n is a, c, g, or t
tcagagctcacgtacacgaccggtgctcgatttagcactcgcacgttgggtttgggggccgcagccctgggattcccagctgtttctaaagcttgctgatcaggactgcacacagagagctcaccatggagtctgggctgagcgttgggttttccttgttgctatattagaaggtgtcagtgtagaggtgcagtcgtgggtgggagggtcgggggggaggtccgtgggtaacncggtccggttcgggggggtcccctggacgtactccgttccgtggtcgcacgtcctcgtggtattcattccttacagttagactaacgacatcgacgtacggtcgggtcccgtacccgtaaggttcgacgaagggtaaccgtaacccgtcgtacgggtaaacggttcggggttacccgttaccggtttaacgttcggtacccgttacggttcggggttcggttaccgtacccgaaacggtaacgtaacgttaacgtacggtacggacgggtcccgttccgggtacggggtaacgggggtacccgtaacgttccgtaaacctacttaccgtaaccgaaaggtaaaacgtaaaacggtacggaacctaaaacggtaaccttaccgttacgttacttaacctaaactaaagtacgtaaacgacgtaccgtacggaacgggtaccggggaaccgggtaacgaccggggttacgttaagttacgtttaacgtcggttaaggtaacggaacggtacgtaccggtacgtaaggttaccgggttaaacggtacggggttaacttacggtacgtttaacgg

SEQ ID NO: 164045 - DNA, 647 bp, Homo sapiens
  misc_feature: GYAE6OF02HNU6J.47.55.E11.1.454.CMB.1.raw
  modified_base (202)..(202): a, c, t, g, unknown or other
  misc_feature (202)..(202): n is a, c, g, or t
  modified_base (370)..(370): a, c, t, g, unknown or other
  misc_feature (370)..(370): n is a, c, g, or t
  modified_base (623)..(623): a, c, t, g, unknown or other
  misc_feature (623)..(623): n is a, c, g, or t
  modified_base (634)..(634): a, c, t, g, unknown or other
  misc_feature (634)..(634): n is a, c, g, or t
  modified_base (636)..(647): a, c, t, g, unknown or other
  misc_feature (636)..(647): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggttttccttgtgtcttacttttaaaaggtgtcctagtgtaggaggtgcaggtgtgggnggtcggggagtcttagtccagcgtggggactccgtgacgactctccgtgtgtagtctacgtaggaactctagtttacacgttacttgtggatcggacacgtcgggtacccaccaacctaccggaagggtaaccgggacgaacggtaacctggcaggcctactcctacncgtacctacgacgaaccggccagtccgtccccttcccgacggccgtacccgtgtacccgtaccgaacgggtaccacccgtaacccgtccggaacgtacgacccgtaaccggacgggttccccggacccgggttgggaccgtccgggtaaccgttacggtaaccgaaacggttaccttaccggttaccctaaggtctaccgtcggttacggaccgggcccggtagtaaccggacgtacggaccgtacaagtcgntacgctggacngnnnnnnnnnnnn

SEQ ID NO: 164046 - DNA, 629 bp, Homo sapiens
  misc_feature: GYAE6OF02GB1HQ.47.55.E11.1.454.CMB.1.raw
  modified_base (206)..(206): a, c, t, g, unknown or other
  misc_feature (206)..(206): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctcgggacccccggnagacggtcaccatctcttgttctggaagcagctaccaatagtacggaaattataatgtatacgtgtaccagcaacgtcccaacgaaccggacccccaaactcctacatactaataacaatgatcacgccgtccctacgacgggtccctggccgtattctctggcctaccgaagtcgaggtccgcctcacgcccacccgtcggaccacgtcgaggtcgggccgtcccgggaccgaggacgtcggacggtccgttagtaactttaacgttacgtcgggttaggttagggttcgggtatccggacgtacgtccgtagtacgtcgtacgttaccgtgttaccggagtccggtacgggaaccgtaaggtccctaccggttccgtaggtccacggaccccgtaaccggacccctaacccgtactacccg

SEQ ID NO: 164047 - DNA, 632 bp, Homo sapiens
  misc_feature: GYAE6OF02IOPIP.47.55.E11.1.454.CMB.1.raw
  modified_base (209)..(209): a, c, t, g, unknown or other
  misc_feature (209)..(209): n is a, c, g, or t
  modified_base (360)..(360): a, c, t, g, unknown or other
  misc_feature (360)..(360): n is a, c, g, or t
tcagagctcacgtacacgaccggtgctcgatttagcactcgcacgttgggtttgggggagcttcagctgtggtagagaagacaggattcaggacaatctccagcatggcccggcttccctctcctcctcaccctcctcactcactgtgcagggtcttgggcccagtctgtgctgactcagcccaccctcagcgtctcgggacccccggnagacggtcaccatctcttgtcgtggaagcagcctaccaatactacggaaatgaataatgtaatacgtgtaccagcaagtccccaacgaaccggacccccaaactccctacactactaataacaatgatcagccggccctcgacgggtcccnggaccgtattccgtacgtcggctccgaagtccgtggcctcctacgaccgtcccacccgtgcccagtcgaggtcgggaccttcccgggacccgtaggacgtggacggtctagtacttacttacgtaggtaggtagggttggacgtcgacgacggtccgtacgtactcggtaccttacgttcgtcgggagtcggtcgggtaacccgaaggttcccaaccggttacccgtaacgggtccgtaaccggacccgaaacgggtacccccaaccctacg

SEQ ID NO: 164048 - DNA, 733 bp, Homo sapiens
  misc_feature: GYAE6OF02GR3EJ.47.55.E11.1.454.CMB.1.raw
  modified_base (436)..(436): a, c, t, g, unknown or other
  misc_feature (436)..(436): n is a, c, g, or t
tcagagctcacgtacacgaccggtgctcgatttagcactcgcacgttgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcacgtgggtccgaccaaactccgaggtaagggctgggtggtggtctcgacgtatcaatcctgatcggactagttagtttaattaaaatttagtcggcggtaccgttacccggtggaacggggggtacccgtaatttcgaacggtctaacttccgtaccgaagaacgaaccgaaacggacgaaaggtaagtaatactagttacgtactaggtaaatagaaacgaatcgtagagagtacgaacgagtacgntagtactaatcgtattgttgttttcgagttccgtcccgtttcgggtaccggtcgggtaccgtttcgggacgggtacccgacgggtaacccgtggtacgcggtccgttccgtcccgacgtacgccctaccgaaccgtaaccggaccctaccgtccggttcccccgttccccgcggtaccccgtcccgtcgacccgtacgacggtacctacccgaaccgtacccgacgtaccgaccgtaccgccggtacccgggtcccgtacggggtcccgaccggtaccggttcggaaccgtaaccgg

SEQ ID NO: 164049 - DNA, 750 bp, Homo sapiens
  misc_feature: GYAE6OF02HAVRW.47.55.E11.1.454.CMB.1.raw
  modified_base (208)..(208): a, c, t, g, unknown or other
  misc_feature (208)..(208): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagcccaccctcagcgtcgtcgggacccccggnagcggtcaccatctcttgtctggagcagcacctaatatacggaaatgaataatagtatactgtacagcaagtaccccaacggaaccgacccccaaactcccacatctaactaacaatagactacagcccggaccctcggacggggtccctacgggaccgtatttcgtccgttcggaccctaccgtaacgtccgttaggcccgtaccctacggaccgaccccgtacccgtccggaccctaacgtaccgtaacgggttcccgggtacccgttccccgggacccggtaacggggtaaccgtcgggtaaccgggtacgtttaacggttaaacgtttaaacgtttaccgtttaaggggtttacggtttacggggttaccggggtacgttaccgggaccgtaccggttaccgttacgtaccgttacgttaccgtttaaccgttccgttacgggaccggtcggtaacgggtacccgtaaacggtccgtaacccgttaccgttacggtccggtaacccgacccgtaacccggacccctaacccgtaccgg

SEQ ID NO: 164050 - DNA, 731 bp, Homo sapiens
  misc_feature: GYAE6OF02JYA9H.47.55.E11.1.454.CMB.1.raw
  modified_base (266)..(266): a, c, t, g, unknown or other
  misc_feature (266)..(266): n is a, c, g, or t
  modified_base (328)..(328): a, c, t, g, unknown or other
  misc_feature (328)..(328): n is a, c, g, or t
tcagagctcacgtacacgaccggtgctcgatttagcactcgcacgtttggggttttccgttgttgctcttttaaaaggtgtccagtgtgaggtgcaggtagtggagtccggggaggcttagttcagcctggggagtccctgagactctcctggtgtagtctctggaatcagtttcagtacctctggatgcactgggtccgccaaactccaggtaagggctggtcgtgggtctcacgtatcaatcctgatggcagtgttataaattngcggactccgtgagggccattcgagcatctccgagacgcaacggcaaagtcgtatactgtancgtaggaaatgaaacatctaggagtacgtcgaacgagttaaccgggcttacggtactaattacagttttggttgtttttaccgaattcgtcccgttttacgggtcccggtacgggttaaccgtttcggttacggggaccgtaacggggtaacccgttggggtacctaacggtccggttaccgttcccggttaccgaaccggttcccgttaacccgtaaacccggaaacgggggtcccctaaacggttcccggttcccgtttacccccgggttacgggccccgttcccgtttaacgcccgttacccgaacgggtaccggccctaacccgttccggacggtacgacccgaacgtaccggcccggtcccgtcgggtcctaaccggccgtttacgggactaaccggg

SEQ ID NO: 164051 - DNA, 707 bp, Homo sapiens
  misc_feature: GYAE6OF02F74S1.47.55.E11.1.454.CMB.1.raw
  modified_base (197)..(197): a, c, t, g, unknown or other
  misc_feature (197)..(197): n is a, c, g, or t
  modified_base (218)..(218): a, c, t, g, unknown or other
  misc_feature (218)..(218): n is a, c, g, or t
  modified_base (372)..(372): a, c, t, g, unknown or other
  misc_feature (372)..(372): n is a, c, g, or t
tcagagctcacgtacacgaccggtgctcgatttagcactcgcacgttgggtttgggggggggaagctcagcttcagctgtggtagagaagacaggattcaggacaatctccagcatggccggcttccctctcctcctcaccctcctcactcactgtgcagggtcttgggcccagtctgtgctgactcagccaccctnagcgtctcggggacccccggnaggacggtcaccatctcttgttctggaagcagcctccaatatacggaaatgaataatgtatacgtggtaccagcaacgtccccacggaacccggcccccaaactccctacactctaataaacaatgactgacgccggccctcgaggggttcccnggccgtatttcgtcgtcggcctaccaggtcctggccgtcctcgacgtcccgaccctcgggcccacgtcgacggtcggggtacccgtcccgggccccggtagggatcgggacggtcgttagtacgtttacgtttacgttggttacggtttagggggtttacggggaagttccggacgtacgggtccccgttaggtaccgtttcggttaccgtttaaccggttccggtttcgggacgggttacccgggttacggggaacccggtaaccgggtttaccccggtacccggttacccggtttaccggggtacccgtaccggtacccccggtaaacccggg

SEQ ID NO: 164052 - DNA, 581 bp, Homo sapiens
  misc_feature: GYAE6OF02GG5ZY.47.55.E11.1.454.CMB.1.raw
  modified_base (564)..(565): a, c, t, g, unknown or other
  misc_feature (564)..(565): n is a, c, g, or t
  modified_base (567)..(567): a, c, t, g, unknown or other
  misc_feature (567)..(567): n is a, c, g, or t
  modified_base (570)..(581): a, c, t, g, unknown or other
  misc_feature (570)..(581): n is a, c, g, or t
tcagagctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagccggccctcgacggggtccctggccgattctcgtggcctccaagtctcggcgcctcagcccaccgtggccatcgagtgggcctcccgggcccgaggagtggacggtctgtatttattacgtggttggtagggttgggactcgcgacgtcctagtactgtcctttacggtcgttcgggagtcgtacgggaacctaacgggtcctacccggtccgtaggccaaccgacccgaaaccggtaccccaaccccgacgttcgtacctacttccttcgtttccccctaccctccttactaccggtgacctctcgtggaccggcggtcgtcggacgaacggccacgtaganngnagnnnnnnnnnnnn

SEQ ID NO: 164053 - DNA, 647 bp, Homo sapiens
  misc_feature: GYAE6OF02FIJIO.47.55.E11.1.454.CMB.1.raw
  modified_base (444)..(444): a, c, t, g, unknown or other
  misc_feature (444)..(444): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagccgtggggacgtccctgagactctcctgtgtagtatctggaatcagtttcacgttaccttctggatgcacgtcgggtcccaccaaacgtccgaagggtaacggggtcttgggtcggttggggtctcgacggttatcaatcctgagtggctagttagttaataaattagtggcgtactccggtggacggggccgtattcgagctatcctacgagacgacgaacgganaagtacgtatacgtgtaatcgtaaggaaatagaaactaatcgtagagtacgtacgaacgtagtaccggcttacgttactactacgttagtttgtttacggtttttacacgttccggttaccccggttttccgggacccgggtaccgggtttaccgtttccggggtaccgggggtaccctaaccgggggtaccccttaacgggg

SEQ ID NO: 164054 - DNA, 601 bp, Homo sapiens
  misc_feature: GYAE6OF02GFMWE.47.55.E11.1.454.CMB.1.raw
  modified_base (364)..(364): a, c, t, g, unknown or other
  misc_feature (364)..(364): n is a, c, g, or t
  modified_base (406)..(406): a, c, t, g, unknown or other
  misc_feature (406)..(406): n is a, c, g, or t
  modified_base (583)..(583): a, c, t, g, unknown or other
  misc_feature (583)..(583): n is a, c, g, or t
  modified_base (595)..(596): a, c, t, g, unknown or other
  misc_feature (595)..(596): n is a, c, g, or t
  modified_base (599)..(599): a, c, t, g, unknown or other
  misc_feature (599)..(599): n is a, c, g, or t
tcagagctcacgtacacgaccggtgctcgatttagcactcgcacgttgggtttggggccgcagccctgggattcccagctgtttctgcttgctgatcaggactgcacacagagagctcaccatggagtctggctgagcgttgggttttccttgttgcttacttttaaaaggtcgtccagtgtgaggtgacgaggttagtggaggtccgggggagtcgttagttcagccgtgggactcccgtgagtctcctctgtgtagtctctaggactctagttcacttaccttcgtaggatcgcgtacgtcggtccaccgaactccgaggtaacgggccgacggaccgtggtacgacgtcgtccgtcctacncgtcctaccgaccgacggcctaggtccgttacccgtccccgngccgtaccctcgtcccaccgtacggaccgtaccgaccgtaccgacgacgcgaccgacggtccggtcccgtcggccgtcgaccgtcgaccgaacgtcctaccgtaccgtacgtcgtacgtcgtcgacggtcggccggatcggacgaaccgggctacggtaacgcgagcgagcgcgcgncgagacgcacgnntgngc

SEQ ID NO: 164055 - DNA, 710 bp, Homo sapiens
  misc_feature: GYAE6OF02I2AQD.47.55.E11.1.454.CMB.1.raw
  modified_base (623)..(623): a, c, t, g, unknown or other
  misc_feature (623)..(623): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggtttttccttgttgtcttacgttttaaaaggtgtcctagtgtgaggtgcgaggtagtggaggtccgggggagtcttagttcagccgtgggacgtcctgagactctcctgtgtagtctctggaatctagtttcacgttaccttcgtggatgctacggtcgggtcccgacctaaaccgtccggaggggtaacggggtcttagggttggtcggttctacgtacggttactactaacgtccgtagagtcgactagttagtttaaactaaagtttgtcggaccggtacgttccggtggtacgggggtcctacgttcgagtcctacgtcctacgaacgacgtaaccgaggtaacaaaggtacgtaataacgttagtacgttacggtaacgtaaataacggtaaacctaagttacggtaagaacgtacggtacggaacgttacgttacggtcttattactacgtttcttagttttacgtttacggntttaccggtcccggtttcggtaccccggttacgggttacgttcgggtacccggggtaccggtaccgggttaccgttacggtacccgg

SEQ ID NO: 164056 - DNA, 620 bp, Homo sapiens
  misc_feature: GYAE6OF02IN8P5.47.55.E11.1.454.CMB.1.raw
  modified_base (357)..(357): a, c, t, g, unknown or other
  misc_feature (357)..(357): n is a, c, g, or t
tcagagctcacgtacacgaccggtgctcgatttagcactcgcacgttgggtttggggggaagaggaagactgacggtcctgccacaggtggtgctgggcacggtgggcactcgacacaacatttgcgctcaactgtcttgctcaccatggagtctgggctgagctgggttttccttgttgctcttttaaaaggtgtccagtgtgaggtgcaggtagtggagtccgggggaggcttagttcagcctggggacgtccctggagactctcctgtgtagtctctggaatctagtttcagttaccttctggtatgctacgtgggtccgaccaaactccgagggtaagggctggtgtggtctnacgtatctaatctagatggcagttagttaataaattgtgacgtactccggtaggacgggtcgtattcagtctatcctaccgagaacgtaaccgaacggtacaaagagttaactacgtacgtatcgtaaggtaaagtacgaactaaagtcagtaacggagtaccgaacgtaacgtacggacttcgtacttaacgttactaagtttagtttacgttttcgaacggtttcggtacccgtttccgggtacccggtcgggttaaccgg

SEQ ID NO: 164057 - DNA, 732 bp, Homo sapiens
  misc_feature: GYAE6OF02JG6R9.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctacttttaaaggtgtccagtgtgaggtgcgaggtagtggaggtccgggggaggcttagttcaggccgtaggggacgtccctgagtactctccgtggtgtagtctcgtaggaattctagtttcgacgttacctttcgtggtatgacgtacggttacgggtacccgtacctaaaccgtcccggtaagggtaacggggtccttggggttcggttcggggttacctaccgtaacggttaacttacgaaacttcccgtaggtacgtcggtaccgttaagttagttttaaattaaacgtttagtacggtaccgggtaccgttaccgggtagggacggggtcctaagtttcgaacgtcgtacgtttccacgaaggtaacgaacgaacggacaaagtacgttactacgtagttaacgtacgtaaggaaactacgtaaactattacgaagacgtaacggtacgaacgtaacggtacgttacgtcgttaactagttccgttagtttgttacgtttcgaacttccggtacccgttcgggtaccggtcgttacgttcgggaccggtacggtaccggtaccgttcggg

SEQ ID NO: 164058 - DNA, 658 bp, Homo sapiens
  misc_feature: GYAE6OF02H8V2F.47.55.E11.1.454.CMB.1.raw
  modified_base (642)..(643): a, c, t, g, unknown or other
  misc_feature (642)..(643): n is a, c, g, or t
  modified_base (645)..(648): a, c, t, g, unknown or other
  misc_feature (645)..(648): n is a, c, g, or t
  modified_base (650)..(658): a, c, t, g, unknown or other
  misc_feature (650)..(658): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggagcttagttcagccgtggggagtccctgagactctcgtgtgtagtctctggaatcgtagtttcagtaccttctggatgcacgtcgggtaccgacaaaccgttccgaaggtaacggggccaacgggtaaccctggaccgacgtccggttacctcccgtacgacgtccccgtaccgaacccgaacgggaccccctaagttcccggtttcccttccccccgtcgggcccgtcccctcggtacctcccgaacgggaccgaccctacccgtcccggaagaccgaccgtaaccggacggcccgggtaccccgttgggcccgttccgggtccttaggggtaccgaaaacgggttccttaacccgtttaccgttacgtacgaccgtcgtacgtacgggacggtccggggacgttgggaacctacgggtccgacgtacgttagcgnngnnnncnnnnnnnnn

SEQ ID NO: 164059 - DNA, 584 bp, Homo sapiens
  misc_feature: GYAE6OF02HT1TD.47.55.E11.1.454.CMB.1.raw
  modified_base (430)..(430): a, c, t, g, unknown or other
  misc_feature (430)..(430): n is a, c, g, or t
  modified_base (510)..(510): a, c, t, g, unknown or other
  misc_feature (510)..(510): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactcgggtccgaccaaactccgaggttaaggggcgtgggtgtggggtctcgtacgtatcaactcctgatggcagttgtttaataaattatcgacggactccggtaggacggggccgtattcgagccattcctacgagagaacaacggnaaggtatatacgtgtaatctaggaaatagaaactaatcgtagagtacggtacgaacggtacgttacggcttagtactatntagtttgttgtttcgagttcgtacccgttcggtccgcgggtacctcggtcgggaccgtacgggaacccttcggg

SEQ ID NO: 164060 - DNA, 632 bp, Homo sapiens
  misc_feature: GYAE6OF02FK7JY.47.55.E11.1.454.CMB.1.raw
  modified_base (202)..(202): a, c, t, g, unknown or other
  misc_feature (202)..(202): n is a, c, g, or t
  modified_base (231)..(231): a, c, t, g, unknown or other
  misc_feature (231)..(231): n is a, c, g, or t
  modified_base (439)..(439): a, c, t, g, unknown or other
  misc_feature (439)..(439): n is a, c, g, or t
tcagagctcacgtacacgaccggtgctcgatttagcactcgcacgttgggtttggggagctgtggtagagaagacaggattcaggacaatctccagcatggccggcttccctctcctcctcaccctcctcactcactgtgcagggtcttgggcccagtctgtgctgactcagcccaccctcagcgtctcgggaccccccggnagaccggtcaccatctcttgttctggaancagctccaatatcggaaatgataatgtatactggtaccagcaacgtcccaacgaaccggccccccaaactccctcactctaactaaacaatgatcgagccggccctcgacggggtccctggccgtattcctctcggtctccgaaagtcgtcggccgcctacgacgcccacccgtggcccatcgagtcgggtcgtcccggcccgaggtntggacggctgtaacttattacgttgttgttagggtttgggactcgtcagtccgtgtacttcgtccgtttacgtccgtttacgggacgtccggtacgggaacctaacgggtaccctacccggttacccgtagggttccgaaccggtaccccaaacgggaccccctaacccccgacgttaccgtacccgtaaccg

SEQ ID NO: 164061 - DNA, 769 bp, Homo sapiens
  misc_feature: GYAE6OF02IN0RK.47.55.E11.1.454.CMB.1.raw
tcagagctcacgtacacgaccggtgctcgatttagcactcgcacgttgggtttggggggaagaggaagactgacggtcctgccacaggtggtgctgggcacggtgggcactcgacacaacatttgcgctcaactgtcttgctcaccatggagtctgggctgagctgggttttccttgttgctctttaaaggtgtcagtgtgaggtgcaggtagtggagtcgggggaggcttagttcagccgtggggacgtccctgagactctcctgtgtagtctctggatcagtttcagttccttcgtggatgcacgtcgggtccgaccctaaactccgtaagggtaacggggtccgttggggttacggttcggggttcctaccgtaacggttacttacgtaaacgttccgtaggtacgttcgggacgttaggtttagtttaacttaaaagtttacgttacggacggggtaccttccgggttgggaaccgggggtccttaacgtttcgaacggtaccgtacgttactcccgtaaagggaaccgtaacccggtaacgggaacgttaaaacggtaacgtttaactaaccggtttagttaccttaacggtaacggtaaagttaccgtaaacgtaaacttacggttaggaacggttacggtaaccgggaacgttaccggacggtttcgtacgttacgttaccgttacgttagtttaggtttaccggttttacgaccgttaccggtttcccggttccgggttaccccgggcggtttaaccccgg

SEQ ID NO: 164062 - DNA, 725 bp, Homo sapiens
  misc_feature: GYAE6OF02IG56R.47.55.E11.1.454.CMB.1.raw
  modified_base (194)..(194): a, c, t, g, unknown or other
  misc_feature (194)..(194): n is a, c, g, or t
  modified_base (687)..(687): a, c, t, g, unknown or other
  misc_feature (687)..(687): n is a, c, g, or t
tcagagctcacgtacacgaccggtgctcgatttagcactcgcacgtttgggtttggggagagaagacaggattcaggacaatctccagcatggccggcttccctctcctcctcaccctcctcactcactgtgcagggtcttgggcccagtctgtgctgactcagcccaccctcagcgtcgtcgggacccccggnagacggtcaccatctcttgttctggaagcagcctaccaatatacggaaattgaataatgtatacgttacggtaaccaggacctaacgtcccccgaaaccgtaaaccccgggaccccccctaaaacgttccctacgtacttacgtaaaactaaacctaagttcgaactccgaacggtcccggtacccctacggaccgggggttcccctaggaccctacgtttcctcgtaccgggtcctacgaaagttccgcgccgtccctacgacgcccgaaccgtcggaccctacgtcgacgggttcgcccgtcccggtaacccggagacgtcggacgtctggtaattaacgtgttcggtaggttagggtacggactccgtcgacggtcctagaccttacggtcctttaccgggttctcggtacggtccgtaacgggacccgttaacgggtccacccgttacgtaccggtacacccggtccctaacggcccctaaaccccgtntaccgtccgtacccttcctttcccgtacccctaccccg

SEQ ID NO: 164063 - DNA, 739 bp, Homo sapiens
  misc_feature: GYAE6OF02GA2AE.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggttttccttgttgctacgttttaaaaggtgtccagtgtgaggtgcaggtagtggaggtccgggggagtcttagtcagccgtgggagtccctgagacctctcgtgtgtagtctctggaatctagtttcagttacttctgatgctacgtcggtcccaacctaaactccgaagggtaacgggtcgtagggttggtacgggttcctacgaacggttactacctaacttccggtagaacgttcggacgtaggttaacgtttaaagtaaatttacgtacggacggtaaccgttccgggagggtaaacgggggtccctagtttaccgaacgtacgtaacgttaccctaaccggaaagaaccggtaaaccgtaaaccgggtactaaaacgtaaggttaactaccggttaagttaactacgtaacggtaaaacgtcgaaaacgtaacgtacgtaagtaacggtacgtaacgaacgtaacgtacgtcttactaactagttcttagtttcggttagttttaccgacgttaccggtcccggtttacgggtccggtacgggtttaccgttacgggtccgggtaacccggtaacgggtacccttacggg

SEQ ID NO: 164064 - DNA, 748 bp, Homo sapiens
  misc_feature: GYAE6OF02JOKPQ.47.55.E11.1.454.CMB.1.raw
  modified_base (360)..(360): a, c, t, g, unknown or other
  misc_feature (360)..(360): n is a, c, g, or t
  modified_base (562)..(562): a, c, t, g, unknown or other
  misc_feature (562)..(562): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagcgtgggttttccttgttgcttacttttaaaggtgtccagtgtgaggtgcgaggtaggtggaggtccgggggagtcgttagttcgagccgtgggacgtccctgagtactcgttcctggtagtaggttctcgtaggaacttgtacgtttcaggttaccttataggtatcgtcacggttcggaccgtacccaacgttaccgagggtacgggccgttggttcggngggttacctacgtacggtacctataacgtccgttagaggttggaccgtaagtttaggttaaattaacgtttaagtcggtacggttaccgtacggtaacggggcgggttaacctagttaccgtaagcctaagtccgttacaggtaccgaacggaacgtagagaacggttacacgttacgaagtttaccgtaagtaaccgttanaaacgtacgtaacgtacggtacgaacggtttaccgggaaccggagttaccgggtacttacgtaacgttaccggttacttagttcgtttaacggtttacggtacgttcggtaccggtttcccgggaagttttaccccgggtagttacccggtacggggtaacccggtaaggttcccccgggttaagg

SEQ ID NO: 164065 - DNA, 679 bp, Homo sapiens
  misc_feature: GYAE6OF02FRYH8.47.55.E11.1.454.CMB.1.raw
  modified_base (210)..(210): a, c, t, g, unknown or other
  misc_feature (210)..(210): n is a, c, g, or t
  modified_base (316)..(316): a, c, t, g, unknown or other
  misc_feature (316)..(316): n is a, c, g, or t
  modified_base (380)..(380): a, c, t, g, unknown or other
  misc_feature (380)..(380): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagcccaccctcagcgtcgtcggggacccccgggnacggacggtcaccatctcttgttctggaagcagctccaatatcggaaatgaataatgtatactggtaccagcaagtcccacgaaccgccccaaactcctcatctanaacatgatcagcgcctcgacgggtccctggccgtacttctcgtcggctaccaagtcgtcggccnccgtacacgccctacccgtcggcccagtccgagggtcgggcccgtcccggggccccggtaagggacgtacgggacgggtactagtaactttacgttacgttggttacgggttagggttcgggagttccggcgtaaccggtccgttacggaccgttcggtcccgtttaacggttccgtttaccgggacggtccgggttaacggggaacccgtaacgggttaccccgtaacccggtttacccgttacgggtacccgtaacccgggtaccccggaaaccggtaccccccaaacccccgtacg

SEQ ID NO: 164066 - DNA, 754 bp, Homo sapiens
  misc_feature: GYAE6OF02JKAS3.47.55.E11.1.454.CMB.1.raw
  modified_base (200)..(200): a, c, t, g, unknown or other
  misc_feature (200)..(200): n is a, c, g, or t
  modified_base (228)..(228): a, c, t, g, unknown or other
  misc_feature (228)..(228): n is a, c, g, or t
tcagagctcacgtacacgaccggtgctcgatttagcactcgcacgttgggtttggggagctgtggtagagaagacaggattcaggacaatctccagcatggccggcttccctctcctcctcaccctcctcactcactgtgcagggtcttgggcccagtctgtgctgactcagccacctcagcgtctcggggacccccggnagacggtcaccatctcttgttctggaancagcctccaatgacggaaatgataatgtatactgtacagacaacgtcccacgaacggacccccaactcctcatctataacatgactcgtacgccggccctaccggacggggtcccctcgggaccgtatttccgtcgtcgggtacctacccgtaaggtccgtacgggtccgtacccgttccgaacggtcccccgtaacccgtccgggaccctacgtacgtaacgggtccggggacccgttcccccgggggaccccggtacgggtaacggtacgggtaacgggtaccgttcgttaaacgttttacttaacccgtttaggttacgggtttaacgggggtttcggggaagttccgggacgtaccgtaccgtacggtaaccgttcggtaccttttccgggtttaccgttccgggacggttccgtacggggaacctaacgggtcccgtaacccggttccgttaacggccgtaacccggtaccccggaaccggtacccccgtaaacccccgtcggtttacgtacccgtacccg

SEQ ID NO: 164067 - DNA, 833 bp, Homo sapiens
  misc_feature: GYAE6OF02G74BW.47.55.E11.1.454.CMB.1.raw
  modified_base (221)..(221): a, c, t, g, unknown or other
  misc_feature (221)..(221): n is a, c, g, or t
  modified_base (261)..(261): a, c, t, g, unknown or other
  misc_feature (261)..(261): n is a, c, g, or t
tcagagctcacgtacacgaccggtgctcgatttagcactcgcacgttggggtttggggggggggaagctcagcttcagctgtggtagagaagacaggattcaggacaatctccagcatggccggcttccctctcctcctcaccctcctcactcactgtgcagggtcttgggcccagtctgtgctgactcagccaccctcagcgtcgtcggggacccccggnagaccggtcaccatctcttgtctggaagcagctacaatanacgaaatgataatgtatactggtaccagacaacgtcccaacggaaccggaccccaaactccctacacttactaaataaaccaatacgaactacgacggcccggaccctcggtaacgggggtcccctagggcccgtaatttccgtacgtccggtaccttacccgtaaacggttccggtacggggtccccgtacccgttaccgaacccggtaccccctaacccccggttacgggaaccccctaaagtttcccggaaacgggggttcccggggggaccccgttcccccggggggaaccccgggtaaaggggttacggtaccgggtacggggtccttaacgggtaaactttttaacgttaccggttagggtttacggggtttaacggggtttacggggaccgtttacggaccgtaaccggtcccggttacggtaaccgtttacggttacccgtttaccggtttccgggtttaccgggtaacggtaccgggtaaccggggaaccttaacggggttaccccgtaacccgggttacccggttagggtaccccgtaaccggtaacccccggaaacccggg

SEQ ID NO: 164068 - DNA, 840 bp, Homo sapiens
  misc_feature: GYAE6OF02JXWT1.47.55.E11.1.454.CMB.1.raw
  modified_base (199)..(199): a, c, t, g, unknown or other
  misc_feature (199)..(199): n is a, c, g, or t
  modified_base (226)..(226): a, c, t, g, unknown or other
  misc_feature (226)..(226): n is a, c, g, or t
  modified_base (316)..(316): a, c, t, g, unknown or other
  misc_feature (316)..(316): n is a, c, g, or t
tcagagctcacgtacacgaccggtgctcgatttagcactcgcacgttgggtttggggagctgtggtagagaagacaggattcaggacaatctccagcatggccggcttccctctcctcctcaccctctcactcactgtgcagggtcttgggcccagtctgtgctgactcagccaccctcagcgtctcgggacccccggnagacggtcaccatctcttgtctggaancagctccaatgtacgaaatgaataatgtatacgtcggtaccaggactaacggtccccacggaaaccccggccccctaaaactcccgttanacttaccttaataaacctaaagtgtaacgtacccgaggtcccggtacccccttagtaaccggggggttccccttgggaccccgttatttccgtacctgggacccttaaccaaggttccggtaccgggtccgacccctttacgaacccggttcccctaaccccggttgggaacccctgtaaccggtagggtcccgggtcccggtaccccgggggtaccccgaagggttagtaccggggtaacggtccgttaacgggttaacctttaaacgtttaccggttaagggttgggtttaaccggggttaggggtaaccgtcgggtaaccctacgggtacccttaccggaccgttacggtttcccgtttaaccggttcggttaacggggtaccgggtccgtacgggggaaccgttaaccggggtcccggttaacccgtttacccggggtacgggttacccgaacccggaaccccggtaaacggtcccccccgtaaaccccggaacgtttccccggttaaccctaacccggg

SEQ ID NO: 164069 - DNA, 754 bp, Homo sapiens
  misc_feature: GYAE6OF02G1H4X.47.55.E11.1.454.CMB.1.raw
  modified_base (344)..(344): a, c, t, g, unknown or other
  misc_feature (344)..(344): n is a, c, g, or t
tcagagctcacgtacacgaccggtgctcgatttagcactcgcacgttgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgaccaaactccgaggtaagggctgggtgtgggtctcacgtatcaatcctgatggcagttgttaataaattatcgacggacttccggtggaggggcccgtaattccgagcactcctaccagaagaacaacggacaaagagtatacgtntagtcgtaaggaactagaacaatcgtagagacgtacgaagtacgtacgggtctagttaccgtatcttagtttgtttagttttacgagtttcgtacccgttcgggtaccggtaccggtacgtttccgggtcggggacccgtacgggtaacccgttcggtacgacggtccggtccttacccgtacgaccgtcccttacccgaaacccggtaaacggccccgtaccgtttaccgggtcccctttaccccggacggtccccgtacccgtccggtacccgttacccggaacggtaccggaccccgtacccgttacccggaacgggtacccgtaccggaacccggtaaccggccccgggttaaccccggtcgggtacccttcccggggacccgtttacggaacccgttaaaccggg

SEQ ID NO: 164070 - DNA, 681 bp, Homo sapiens
  misc_feature: GYAE6OF02HPC6P.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccagtggagtctgggctgagctgggtttttccttgttgcttacttttaaaaggtgtccagtgtggtaggtgcaggtagtggagtccgggggaggtcgttagttcagccgtgggggacgtccctgacgactctccgtatgtactctcgtggaacttctagtttcaacgttacccttgtggatgacctacgtcgggttacccgaccgtaaactccggaagggttaacggggctgggtgtcgggtctctacgtatactactaccgtgagtcggacttggttaagttaataaagttagtcggtacggtaccgttcggtggacgggggtactagttacacgctactctaaccgaaggtaacgaacgaaacggacgaaagtacgtaattacgtagtaataccgtaagtaaatcgaactaagtcgtaggaactaggtaccgtaacggtaacgtacgtcgttatacgttattactagtttcggttagtttactacggttcgttcccggttccggtacccggttcggtaccggttcggtaaccggggtccgtacgggttacccggtacgg

SEQ ID NO: 164071 - DNA, 819 bp, Homo sapiens
  misc_feature: GYAE6OF02IZR96.47.55.E11.1.454.CMB.1.raw
  modified_base (100)..(100): a, c, t, g, unknown or other
  misc_feature (100)..(100): n is a, c, g, or t
  modified_base (138)..(138): a, c, t, g, unknown or other
  misc_feature (138)..(138): n is a, c, g, or t
tcagagctcacgtacacgaccggtgctcgatttagcactcgcacgttgggtttgggggccgcagccctgggattcccagctgtttctgcttgctgagtcnggactgcacacagagagctcaccatggagtctggtcgnttaggctcggtttcgtttcttgtcgtctttaaacggttagtcagtgtgaggtgcgaggtaggtggacggtctacgggggagtcttacggttcggaggtcccgtagggggacttccctggtaccgactcgtaccgttgtagtgtacttcgtaggtactacgtacgtttacgtaggttaaccttcgtcgggtattacggccgacccgttcggggtaacccctccggaaaaccgttccggtaaggttaacggggtccgttaggggtcgttacggggtccttacgaacccggtttacccaagtaccttgggtacttagggtactaaggttaacgggtttaataacggtttagtacggtccggtaacgttcccgggtaggtacggggtcctaacgttccggacgttccaacgtacggtacaaaccgggtacgaacgaacggtacgtaacgtcgtaagttacctagggtaaatagttaaccggaaatagttaccgaaggtaacgtcgtaacggaacgttaacggtacgcccttttacgggtacttaacgtacgttattacggttacggttttaggtaacggtttcgttaaccggtttccgggtccggggtaacccggtttacccgtttacgggggtacccgggttacccggaacggggtaccccggttagggtacccggtaaccggg

SEQ ID NO: 164072 - DNA, 674 bp, Homo sapiens
  misc_feature: GYAE6OF02HOBV0.47.55.E11.1.454.CMB.1.raw
  modified_base (207)..(207): a, c, t, g, unknown or other
  misc_feature (207)..(207): n is a, c, g, or t
  modified_base (392)..(392): a, c, t, g, unknown or other
  misc_feature (392)..(392): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagcccaccctcagcgtctcgggacccccggnacgacggtcaccatctcttgttctgaagcagcctccaatatacggaaatgataatgtatactgtaccagcaacgtcccaacgaaccggaccccaaactcctacactactaataacaatgactcacgccggtccctacggacgggtcctcggccgtattctccgtggacctacaacgtctcggccncccttacgacgtacccacccgtcggaccctacgtccgacggtcgggccgttccgggacccggtagggacgtcgggacggtcgttagtaacgttttacttacgttagggttacggttaggggtttacgggtacgttcggacgtacggtaccgttgtaccgttggtaccgtttacgttcggttacgggacggttaccggtaacggggtaacccgtaacggtcccgtacccgttaccggtacggtaccgaccgtaccccggtaacggacccctaacccgtaccgg

SEQ ID NO: 164073 - DNA, 587 bp, Homo sapiens
  misc_feature: GYAE6OF02HJ410.47.55.E11.1.454.CMB.1.raw
  modified_base (204)..(204): a, c, t, g, unknown or other
  misc_feature (204)..(204): n is a, c, g, or t
  modified_base (231)..(231): a, c, t, g, unknown or other
  misc_feature (231)..(231): n is a, c, g, or t
  modified_base (234)..(234): a, c, t, g, unknown or other
  misc_feature (234)..(234): n is a, c, g, or t
  modified_base (323)..(323): a, c, t, g, unknown or other
  misc_feature (323)..(323): n is a, c, g, or t
  modified_base (325)..(325): a, c, t, g, unknown or other
  misc_feature (325)..(325): n is a, c, g, or t
  modified_base (350)..(350): a, c, t, g, unknown or other
  misc_feature (350)..(350): n is a, c, g, or t
  modified_base (371)..(371): a, c, t, g, unknown or other
  misc_feature (371)..(371): n is a, c, g, or t
  modified_base (423)..(423): a, c, t, g, unknown or other
  misc_feature (423)..(423): n is a, c, g, or t
  modified_base (476)..(476): a, c, t, g, unknown or other
  misc_feature (476)..(476): n is a, c, g, or t
  modified_base (498)..(498): a, c, t, g, unknown or other
  misc_feature (498)..(498): n is a, c, g, or t
tcagagctcacgtacacgaccggtgctcgatttagcactcgcacgttgggtttggggagctgtggtagagaagacaggattcaggacaatctccagcatggccggcttccctctcctcctcaccctcctcactcactgtgcagggtcttgggcccagtctgtgctgactcacgccaccctcgagcgtcgtcggggacccccggnaggacgtcaccatctcttgtctaggancanctaccaatcgtacggaaatgaataagtgtatacgtgtaccagtacaacgtcccacgaaccggaccccaaactcctacatctataacatnancagcgcctgacggtcctggctatcncgtgtcctcgatcgtgctccnaccgccaccgtgcctacgtcacggtcggccgtacccggccggtagacgtcgnggtctgatttacgttcgtgttagtacgggttggactcgcgactccggatcgtntaccgtttaggtcgttaccggngtccgacgggaaccctcggttaccggacccgttcgttaacggaccgtaccggacccaaccggtacccacccgtacgtccgtactaccgg

SEQ ID NO: 164074 - DNA, 915 bp, Homo sapiens
  misc_feature: GYAE6OF02GUUOA.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctggctgagcttggttttccttgttgtcttacttttaaaaagtgtccagttgtgaggtgcagcgtggtggagtcgtgggggaggtacttagtacgacggccggtcggggggtccctgagtaccttccttccgtcggccgcgacgtccgttcgttggtactttccttaccgttttaaggttagtttaattcgcctaagttcgtacgttcgggtccccgaccgacggtccgtaccggaagggggaacggggtcggtaggggtaggtcggggttcctacggagggtccgttaggtttggggttagggttaggttacgggttcggaccgaagggtaacctaaaccgttaaacgttttaaaccggtaaaacggttccccggtacggaccggtaccgggtacccgtttaatttttcccgtttaacgtcccgttaaccgaacggtaaaccgtaaccttaaaccgttacccgaaaggtaaacctaacgttaacggttcgttaacgtttcgttaggtaccttaacgggtttacccgtaaaccgtacggttaaccggtagggtaaccggttaacgggttaacccgggaacgggtaaccccgttaaccggggttaaccgtttaaagttttaaaacggttttacgtttagggtttaaagggttttaaacgggtaggggttaacgggtttacggggttaacggttaacccggtaaccgggtttaacccggtttccggggttaccggggggtaaccccggggttaccccgggttggttaccccggttacccggtttcccg

SEQ ID NO: 164075 - DNA, 616 bp, Homo sapiens
  misc_feature: GYAE6OF02HAAUJ.47.55.E11.1.454.CMB.1.raw
  modified_base (275)..(275): a, c, t, g, unknown or other
  misc_feature (275)..(275): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaggtgtccagtgtgaggtgcaggtagtggagtccgggggagcttagttcagcctggggagtccctgagactctcctgtgtagtctctggaatctagtttcagttaccttntggatgcacgtcgggtccaccaaactccgagggttaacgggctgggtgtcgggtctcacgtatcatcctgatggctagtgttaataatgtgcggactcgtggagggctatcagtctatcctacagaagacgaacggacaagtatagtactagtactacgtagaaatcgtaaactagttcgaggaacgtagtacgaaccgtagttaaccggtcttacggtacttaagtccgttaagttttcggtttacgttttacggaatttccgggtacccgtttcccgggtaccggttccgggttacgtttaccgggtccggggtacccggtaacggggtaccccttggg

SEQ ID NO: 164076 - DNA, 562 bp, Homo sapiens
  misc_feature: GYAE6OF02GNWW4.47.55.E11.1.454.CMB.1.raw
tcagagctcacgtacacgaccggtgctcgatttagcactcgcacgttgggtttggggggaagaggaagactgacggtcctgccacaggtggtgctgggcacggtgggcactcgacacaacatttgcgctcaactgtcttgctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagttaccttctggatgcacgtcgggtccgccaaactccgaggtaacggggctgggtgtgggtctcgacgtatcaatcctgagtggcagttgttaataaattgtgcggtactccggtggacggggcctattcgagcatctaccgagacgacaacggacaagagtatactgtactcgtagaaatgaacatctagagacgtacgacgtagtacggtctaggtctatctagtttgttgtttacgtagttcgtccggttcggtcccggcggttaccg

SEQ ID NO: 164077 - DNA, 777 bp, Homo sapiens
  misc_feature: GYAE6OF02H6NHM.47.55.E11.1.454.CMB.1.raw
  modified_base (226)..(226): a, c, t, g, unknown or other
  misc_feature (226)..(226): n is a, c, g, or t
  modified_base (243)..(243): a, c, t, g, unknown or other
  misc_feature (243)..(243): n is a, c, g, or t
tcagagctcacgtacacgaccggtgctcgatttagcactcgcacgttgggtttgggggagcttcagctgtggtagagaagacaggattcaggacaatctccagcatggccggcttcccctctcctcctccaccctcctcactcactgtgcaggtcttgggcccagtctgtgctgactcagcccacctcagccgtcgtccggggaccccggcgaggaccggtcaccnttctcttgttcgagganctagcctacaagtagtacggaaatgaataatagtagtacacgtacagaccacgtaccaaccgaaccgacccccctaaactcctaccgaattactaactaacgaacttacggacttaccgaacggtccccgggtacccctacgggacccggggttcccgtcggtaccccgttattccgtcgtccggtcctaaccgtacgttcgtccgcgtaccctcgtaaccgccctacccggtcgccgtacgtacgtacgggtccggtcccggacccgggtcccgaaggggtattacgggacggttaccgtttaagttaaagtttcccggttttaagtgggttaccggggtttaggggtacgggtacctcccggtaaccggacggttcccgttacgttaccggtcgttaccgtttacggttacccggttcggggaactttcccggggtaacggggtaaacccgttcggtaccccggtttaacccgtcccggtttaaggccccaaaccgggtacccccgtaaacgcccccccgtaaactcccggg

SEQ ID NO: 164078 - DNA, 629 bp, Homo sapiens
  misc_feature: GYAE6OF02FNGII.47.55.E11.1.454.CMB.1.raw
  modified_base (213)..(213): a, c, t, g, unknown or other
  misc_feature (213)..(213): n is a, c, g, or t
  modified_base (249)..(249): a, c, t, g, unknown or other
  misc_feature (249)..(249): n is a, c, g, or t
  modified_base (257)..(257): a, c, t, g, unknown or other
  misc_feature (257)..(257): n is a, c, g, or t
  modified_base (282)..(282): a, c, t, g, unknown or other
  misc_feature (282)..(282): n is a, c, g, or t
  modified_base (453)..(453): a, c, t, g, unknown or other
  misc_feature (453)..(453): n is a, c, g, or t
tcagagctcacgtacacgaccggtgctcgatttagcactcgcacgttgggtttgggggagcttcagctgtggtagagaagacaggattcaggacaatctccagcatggccggcttcccctctcctcctcaccctcctcactcactgtgcagggtcttgggcccagtctgtgctgactcagcccaccctcagcgtcgtcggggaccccccgggnacggaccggtccaccatctcgttgttctggaagcanctaccaanatacgtaaaaatttgtatatggtancagcaacctcccgaggaccgacccccaactcctcagtcgtactaaggaataactcacggccgccctcgacgggtcctcgaccgtacttcgtctcggcctaccgagtcgtcgaccaccgtcgacgtccctccgtcgacctactcgaggtcggtccgtccgggtcggagtagnggtacggtctagtacttacgttacgtcgtgacgtacgcgtagttgggatacgacgacgtccgtacgtcgtcggtacgtcgggttcgggttcggtaccgggcgggtacgggaccaggtccggtaccgtaccggttaccgtacggtccgaccggtacccgtacggtcccgtaccccgg

SEQ ID NO: 164079 - DNA, 735 bp, Homo sapiens
  misc_feature: GYAE6OF02ISY86.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggtttttccttgttgctacttttaaaaggtgtccagtgtgagtgcaggtagtggagtccgggggagtcttagtcagccgtggggatcccgtgagactctcctgtgtagtctcgtggaatctagtttcacgttaccttcgtggatggacacgtcgggtcccacctaaaccgtccgagggtaacggggctagggtgtcgggtctacgtacgtatacgaactcctagacgtggactaagttagtttaaataaagttagtcggtaccggtacgtccggtaggggtaacgggggtaccgtaacgtttccgaacgtaccaacgttccgtaacccgaaggtaacggaaaccgtaaacggaacaaaagggtacgttaacgttaacgtacggttaataacgtaaggaaaacttaaggtaaacacgttccgaggtaacggtacgtaacggacggtaacgtaccgggtattcgtacgttacttacgttattttggtttacggtttacggtaacttccggttacccgtttaccggggccggtttaccgggtaccggttttacccgggaccgggggtaacccgttaccggggtacccgttcgggg

SEQ ID NO: 164080 - DNA, 773 bp, Homo sapiens
  misc_feature: GYAE6OF02G9BPJ.47.55.E11.1.454.CMB.1.raw
  modified_base (743)..(743): a, c, t, g, unknown or other
  misc_feature (743)..(743): n is a, c, g, or t
  modified_base (748)..(748): a, c, t, g, unknown or other
  misc_feature (748)..(748): n is a, c, g, or t
  modified_base (758)..(758): a, c, t, g, unknown or other
  misc_feature (758)..(758): n is a, c, g, or t
  modified_base (763)..(763): a, c, t, g, unknown or other
  misc_feature (763)..(763): n is a, c, g, or t
  modified_base (765)..(765): a, c, t, g, unknown or other
  misc_feature (765)..(765): n is a, c, g, or t
  modified_base (769)..(770): a, c, t, g, unknown or other
  misc_feature (769)..(770): n is a, c, g, or t
tcagagctcacgtacacgaccggtgctcgatttagcactcgcacgttgggtcttgggcccagtctgtgctgactcagccaccctcagcgtctcgggaccccgggcagacggtcaccatctcttgttctggaagcagctccaatatcggaaatgataatgtatactggtaccagcaagtcccacgaaccggccccaaactcctcatctaataacaatgatcacgccggccctcgacggggtccctggtcgtatttctcgtcggcctaccgaagttccgtcgggccgtaccccttcgaccgcccctaccccgtgggccctaacgtccgacgggtcgggcccgtccccggggccccggaagggtactgggacgggtcttaggtaactttaagttacgttggttaggttaggggttcgggtactccggacgtacgtccgtaggtaccgttcgttaccgtttaaccggttccggtttacggggacgtccggtacggggtaaacccgtaacggggttccctaacccgggttccgttaacgggttacccaaaccgggtaccccgaaaccggggtaccccctaaaccccgtacgttccgtacccgttaccgtttcccgttacccggtttacccccctacccctttaccccgttaccgttaaccgggtcgtaacccgtccgtttaccggtacgggaccggggtccgggttaccgtcggggaacccggtacgggtccgacgttacgacgtacncgtanctcacgtcgngcgcncngacnngcg

SEQ ID NO: 164081 - DNA, 620 bp, Homo sapiens
  misc_feature: GYAE6OF02JZTQ4.47.55.E11.1.454.CMB.1.raw
  modified_base (279)..(279): a, c, t, g, unknown or other
  misc_feature (279)..(279): n is a, c, g, or t
  modified_base (437)..(437): a, c, t, g, unknown or other
  misc_feature (437)..(437): n is a, c, g, or t
  modified_base (465)..(465): a, c, t, g, unknown or other
  misc_feature (465)..(465): n is a, c, g, or t
  modified_base (475)..(475): a, c, t, g, unknown or other
  misc_feature (475)..(475): n is a, c, g, or t
  modified_base (551)..(551): a, c, t, g, unknown or other
  misc_feature (551)..(551): n is a, c, g, or t
  modified_base (614)..(614): a, c, t, g, unknown or other
  misc_feature (614)..(614): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgtctcttttaaaggtgtccgagtgtgaggtgcgaggtagtggaggtccgggggaggtcgttagttcagccgtggggactccctagcgactcctccgtgtgtagtctcgtggtaatcgtagtttnacgttaccttcgtggtatgacacgtacgggtcccaccaactcgaacgggtagggctgggtgtcgggtctcgtacgtatacaagtcctagacgtggctaggttagtttaataaagttagttcggacggtcgttccggtaggtacggggccgtaatcgancgtactcgtaccagtacgaacgacggtnaaagtattanaacgttgtactagaaggtaatagtaacatcgagatacgacgagtagtcgtagtctatagtcttatttggttaaccngttaccgtctacccggggtaccaggggtttaccttcggaaccggggtacccacgggttacccngttacg

SEQ ID NO: 164082 - DNA, 902 bp, Homo sapiens
  misc_feature: GYAE6OF02GO6XM.47.55.E11.1.454.CMB.1.raw
tcagagctcacgtacacgaccggtgctcgatttagcactcgcacggttgggtttggggagccgcagccctgggattcccagctgtttctgcttgctgatcaggactgcacacagagagctcaccatggagtcgtgggctggagtcgttgggtttttccttgttgacttacgttttaaaaggtgtcctagtggtggaggtgacgtaggtaggtgggtaggtccgggggagtcgtttagttcgacggtccggtaggggtacgtcccgtaggacgtaccttccgtaccgttggttacgtacgtcttacgtaggtaacttcgttaggtttaccgaacggtttaccctttacgtagggtaattcggtaccgtaacggtcgggttaccccgaacctaaaccggtacccggtaaggggtaaccggggttcggttagggttcggttcgggttacctacgtacggttaactacgtaacgttaccgttagaggttcggtaacgtaggtttaaagttaaattaaagtttcggtacggaccggttaacggtcgggtaacggacggggttacctaagtttacgacggttacctaaccgttacgtaaccggtaaggaaaccgtaaaccgtaaaacgggaccgttaaaaagggtaccctttaaagttacggtttaaactaaccgggttaaacgttaaaggggtaaaaccttccggtaaaaagtacgtttcgggtaacgggaacgttaaaccgggtaccggtaaaacggttgtaacccggtttgttaacgttacgacttttacggtagtttttaggggttccttttaacgcggtacccggtttacccgggttcgggtaacccggtacggggttttacctccgggggaaccgggtaaccccggttaaggtaaccccggg

SEQ ID NO: 164083 - DNA, 739 bp, Homo sapiens
  misc_feature: GYAE6OF02JONJP.47.55.E11.1.454.CMB.1.raw
  modified_base (170)..(170): a, c, t, g, unknown or other
  misc_feature (170)..(170): n is a, c, g, or t
  modified_base (706)..(706): a, c, t, g, unknown or other
  misc_feature (706)..(706): n is a, c, g, or t
  modified_base (709)..(709): a, c, t, g, unknown or other
  misc_feature (709)..(709): n is a, c, g, or t
  modified_base (713)..(714): a, c, t, g, unknown or other
  misc_feature (713)..(714): n is a, c, g, or t
  modified_base (716)..(716): a, c, t, g, unknown or other
  misc_feature (716)..(716): n is a, c, g, or t
  modified_base (726)..(726): a, c, t, g, unknown or other
  misc_feature (726)..(726): n is a, c, g, or t
  modified_base (733)..(733): a, c, t, g, unknown or other
  misc_feature (733)..(733): n is a, c, g, or t
  modified_base (735)..(735): a, c, t, g, unknown or other
  misc_feature (735)..(735): n is a, c, g, or t
  modified_base (737)..(737): a, c, t, g, unknown or other
  misc_feature (737)..(737): n is a, c, g, or t
tcagagctcacgtacacgaccggtgctcgatttagcactcgcacgttgggtttgggggccggcagccctgggattcccagctgtttctgcttgctgatcaggactgcacacagagagctcaccatggagtctgggctgagcttgggtttccttgtgctacttttaaaggngtccagtgtgagtgcgaggtagtggaggtccggggaggtcttacgttcacgtccgtaggggacttcccgtaggacgtactcgtccgtgtagtacgtctcgtaggaacttcgtacgtttcgacgttaccgttctaggagtacgtcctaacgtcgggtcccgtaaccctaaacgtccggtaaggggtaaccgggtacccgaacgggtaacccgttaggtacgacggtccgttaccttaccgtaccgtaacgtcccgttaaccgacccggaacggtacccctaacggtttccccggtaaccgtttacccccgtgggtccccgtcccttaggccccttacccggagggtaccgcccgtaacccggtacccgacggtaacggtaccaccgaaccgggtacccggtcccggtacgggtaccttccgggacccgttaccgggttaacgaaccggtaacctttacccgtcccgttaaacgtggtaaaccgtcctcggttacggacgggtaccgtcggtacccggagaaccgggtcacgttacgngcncgcnncncgcgcgcgcncgctacncngngc

SEQ ID NO: 164084 - DNA, 517 bp, Homo sapiens
  misc_feature: GYAE6OF02FJVCF.47.55.E11.1.454.CMB.1.raw
  modified_base (347)..(347): a, c, t, g, unknown or other
  misc_feature (347)..(347): n is a, c, g, or t
  modified_base (371)..(371): a, c, t, g, unknown or other
  misc_feature (371)..(371): n is a, c, g, or t
  modified_base (497)..(497): a, c, t, g, unknown or other
  misc_feature (497)..(497): n is a, c, g, or t
  modified_base (500)..(502): a, c, t, g, unknown or other
  misc_feature (500)..(502): n is a, c, g, or t
  modified_base (504)..(505): a, c, t, g, unknown or other
  misc_feature (504)..(505): n is a, c, g, or t
  modified_base (507)..(517): a, c, t, g, unknown or other
  misc_feature (507)..(517): n is a, c, g, or t
tcagagctcacgtacacgaccggtgctcgatttagcactcgcacgttgggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcgaggggtccctggccgattctctggctccaagtctggcgcctcagccaccctggccatcagtgggcctccggcccgaggatgaggctgattattactgtgtaggttggatcgcagccngactcgtacgttacgttcgtcggngtcggtacggaccgacgtccgaccgtcgtagcgaccgacccgacgaccccaccctacgtcgctactcgttccctacccctccctcctactcgtacgtctgacggacggcgtcgtcgacgcggcacnagnnngnncnnnnnnnnnnn

SEQ ID NO: 164085 - DNA, 778 bp, Homo sapiens
  misc_feature: GYAE6OF02GP87F.47.55.E11.1.454.CMB.1.raw
  modified_base (618)..(618): a, c, t, g, unknown or other
  misc_feature (618)..(618): n is a, c, g, or t
  modified_base (773)..(773): a, c, t, g, unknown or other
  misc_feature (773)..(773): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtcgtgggctgagtcgttcgggtttttccttgttcgtcgtttaacgttttaaaaggtcgtacgtagtggtggaggtgacgtaggttaggtagggtacgggtccgggggagttacgttacgttcgacggtccggtacggggtaccgtcccgttaggaacgttccttccgttccgttggttacgttacgttccgtacgttaggtaacttccgttacgtttaccgtacgtttacccgttggtaggtacgtccggtaccgttacggtccggtaccccgaaccgtaaaccggtacgggtaaggggttacgggtccggttgggttcgggtacgttacctacgttacgtactacgttaacgtcgtagtacggtgttacgttaagttagtttaaatacgtacggtcgacgtaccggtacggtcggaacggttctacgtcgacgtacctcgaaccgtagaaacgaacggaaccaaggtataacgttaagtactacgttanaacgtaagtaacgtaagtaacgtaatagtcgtaaggacgttagaccgtaggtaccgttgtgttactagttcttagtttcgtttagttacggttcggtacgttcccgggttccgtaggtcccgtcggtttccgggcgaccgggtactacccggttntccgg

SEQ ID NO: 164086 - DNA, 707 bp, Homo sapiens
  misc_feature: GYAE6OF02JDI90.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaggtgtccagtgtgggtgcacctgatggagtcgtgggggagcctcataaaggccggggggtacccttaaactctcctgcgcagcgtctggtatttcctttcagtcaagtctggataagcgtggtccgccgaggctccgagggactgggccgtggaggtgggtggccggtgtacgaaggacgacacgtactgagtggtgacgacatcgtagaacgtacgctcgaccgaacccggtagaaacggcagtacttaccgaacctattcccgtaccaaggtacgtagttacgtaacttaacgtaaatttaaaacgtactttacgtaacctaattttaactaaccgttaaacttaaaacgttggggtaaacttaaccggacccgttaaaggtaaaacgttacgggaagtaaacgttaacgtttacggttttaacgtttttaacttaccggttaacgttacccggtaaagggtaacgggttaacttcggggttaccggttttaccgtaccggggttaccgggggaaccggtaacgggtaaccttaacggg

SEQ ID NO: 164087 - DNA, 714 bp, Homo sapiens
  misc_feature: GYAE6OF02IUM6I.47.55.E11.1.454.CMB.1.raw
  modified_base (138)..(138): a, c, t, g, unknown or other
  misc_feature (138)..(138): n is a, c, g, or t
  modified_base (555)..(555): a, c, t, g, unknown or other
  misc_feature (555)..(555): n is a, c, g, or t
tcagagctcacgtacacgaccggtgctcgatttagcactcgcacgttgggtttggggccgcagccctggattcccagctgtttctgcttgctgatcaggactgcacacagagagctcaccagtggagtcgtgggctgngtcgttcgggtttttcctgttgtcttacgttttaaaaaggtcgtccagttgtgaggtgcaggtagtggaggtccggggagtcgtttagttcgagccgttgggacgtcccgtgacgtcgttccgtcgtgtagtagtctcgtagatctacgtttcagttaccttgtggactcgactacggtccggtaccgaccctaacgtccgtaagggtacgggtcgtggttaggtggtcctacgtacgtaagtacgtaactccgtagtacgtgacgtaagttagttaaacgttaatagtacggtacgtaaccgtcgtacggaacggtccgtaacttcgacgtacttacacgtaccggaagtaaccgaccggaagtaactaaaggtacttacgtacgttacgtaactagtaacggaaattaacgaaanagttccgaaggaccgtaacgtacggtaacgtacgtcccgtaaagttctaaccgttagtcctttaagttcgtttaacgtttcgaacgttcgttacccgttaccggtcccgtacggttaacgtttccggaacggggttcccgtaacgggttaccccttggg

SEQ ID NO: 164088 - DNA, 696 bp, Homo sapiens
  misc_feature: GYAE6OF02FIA1I.47.55.E11.1.454.CMB.1.raw
  modified_base (323)..(323): a, c, t, g, unknown or other
  misc_feature (323)..(323): n is a, c, g, or t
tcagagctcacgtacacgaccggtgctcgatttagcactcgcacgttgggttttccttgttgctcttttaaaaggtgtccagtgtgaggtgcaggtagtggagtccgggggaggcttagttcagcctggggagtccctgagactctcctgtgtagtctctggactcacctttagcaactctgtcatgggctggtccgccaggctccggggagggctggagtgggtctcaagtattgatgagaatgggtggaagcacattctacggtggactccggtaggaacggggccggttcacctatcctccagacgactatttcgaggancacgtctgtactactaacaaatacgaacacgtcctaggagacgaccggacggaccgaccggtaccgtattacgtttcgtggtcgacgtaaagtctatacgctacggtccgacccccgtagccgctacctttcttcgtaccttcggtcggggaccgagggtaactccgtcggtacctacccgtcctcccaccgtaccgtaccctacccgaaccgaaccgggtcccctacgttacccgggttccccttcccccggtcggtccccgtccccgttcgaccctacccggtaacgggaccgtacccctaccccgttacccggaacggtaccgtaccgtaacccgacggggtccccgggtaccccggtcggggtacccgg

SEQ ID NO: 164089 - DNA, 640 bp, Homo sapiens
  misc_feature: GYAE6OF02H3BV8.47.55.E11.1.454.CMB.1.raw
  modified_base (502)..(502): a, c, t, g, unknown or other
  misc_feature (502)..(502): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggagtcttagttcagccgtggggagtcccgtgagactctccgtgtgtagtctcgtggaatcagttttcagtaccttctggatgcctacgtgggtcccaccaaaccgttccgaaggtaacggggtctgggttggtcgggtctccgacggttatcaaattccgtgaacgttggactagttagttaaataaagttgtacggacggtaacttccggtggacggggcctagttaccgagtcatcctaccgagaacgacgaaacggcaaagcgtatacgtgtatcgtaaggtaactagaaaccgnttacgaggaagtacgtacgaacgtagtaccggcttgtaactagtcgtagtttcggtttcggtttacgacttcggtacccggttttccggcccggtggttaccgttccgggacggggtacctaccggggtacccttggg

SEQ ID NO: 164090 - DNA, 729 bp, Homo sapiens
  misc_feature: GYAE6OF02HI9YM.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggttttccttgttgcttacttttaaaaggtgtccagtgtgaggtgcaggtagtgggaggtccgggggagtcttagttcagccgtggggactcccgtgacgactcctccgtgtgtagtctcgtaggatctagtttcagttaccttgtggactgcctacgtcggtcccgaccaacgtccgagggtaagggctgggtgtcggtctacgactatacacgttcctgtagtggactagttacgttaaattaaagttgtacggtaccggtacttcgggtacggggacggggtccttattaccgagtactacgtccgtacgtaacggtaaaccgaaccggtaaaccggaacgtaaacgtacgttaactttacgtaaggtttaacttacggtaaaggtaaactaaagaaacttaacttacgtaaggtaacggttacgaccggtaaacgtacgttaccggtacgttcgtaacgttagttaccttaggtttacgtttacgtttcggtacctttccgggttaaccccgtttcggggtacccggttacgggttaccggttcgggttaaccgggtacccggttacggaacccgtttcggg

SEQ ID NO: 164091 - DNA, 699 bp, Homo sapiens
  misc_feature: GYAE6OF02J02WJ.47.55.E11.1.454.CMB.1.raw
  modified_base (469)..(469): a, c, t, g, unknown or other
  misc_feature (469)..(469): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagcgttgggttttcctttgttgtcttacttttaaaaggtgtccagtgtgaggtgcgaggtaggtggaggtccgggggaggtcttagttcgagccgttggggacgtcccgtggacgactctccgtgttacgtagtctcgtggaatcctagtttcacgttaccttcgtgggattagctacgtcggggtcccacccgaaaactccgaagggttaacgggcttgggtggttcgggtctcgtacggttataccgtaacgtccgtagagttggctaggttattaacgttaaattacgtcggtaccggtacgtacggtggacggggtccgtacttacgngtacctgtaccgtaccgaaggtaaccgaacgacgaacgtaaggtagttactacgtagttacgttgaaacggtaatacggaactaagtcgtaggaacgtacggtcaacgtacgtacggtcttagttctaatcgtagtttgtttacggtttacgtcgttacgttcccgttacggtcccgggttacggttaccggttccggtacgggtaccggtacccggtaccgttaccggg

SEQ ID NO: 164092 - DNA, 855 bp, Homo sapiens
  misc_feature: GYAE6OF02I1L21.47.55.E11.1.454.CMB.1.raw
tcagagctcacgtacacgaccggtgctcgatttagcactcgcacgtttgggtttgggggccgcagccctgggattcccagctgtttctgcttgctgatcaggactgcacacagagagctcaccagtggagtcgtgggctggagtcgttcgggtttttccttgttgtctttacgtttttaaaacggtcgttaccgtagttggtagtagggtgacgtagggttaggtagggacgggtaccggggggtacggtacgtttaacggttccgaacggtccgggttagggggtaccggttcccggttaggtaacggtacccgttccgtttaccgttcgggttagtaccggttccgttaccggttaggtaaacttcggttacgttttaccggtacgtttaacccgtttcgtaggtacgttacggacctacggttcggtaccccgtaaccgtaacccgttaccgggtaacgggtacggggtaccgttgggttcgggtcggtccttacgtacggttactactaacgttaccgtgtacgtggacgttagtaagtttataaacgttcgtcggtacgtaccgtcgggaggaccgggtcgtaacttcgactacgttactccgtaacggtacgaaccgaagtacggaacgtaacgtaacgttacgtaactaccgtttaaggtagttaaccggaacgttaacgggaaacctttaggtaccgtgtaaccggtaacgtagggaacctaggacccgttgttaccggtattacgttgttagtttccgtacgttacgggttaccttcgtttaaccgggtcgttacgggttacgtccgggttccgggacggtaacccggttagggttaccctcgggg

SEQ ID NO: 164093 - DNA, 732 bp, Homo sapiens
  misc_feature: GYAE6OF02HMLUV.47.55.E11.1.454.CMB.1.raw
  modified_base (207)..(207): a, c, t, g, unknown or other
  misc_feature (207)..(207): n is a, c, g, or t
  modified_base (318)..(318): a, c, t, g, unknown or other
  misc_feature (318)..(318): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagcccaccctcagcgtctcgggacccccggnagcggtcaccatctcttgtctggacgcagtcctaccaatagtacggaaatgaataatgtatactggtaccagcaacgtcccacgaccgacccccaaactcctacatctaanaactaatgactcacgccggaccctcgacgggtccctacggcccgtattccgtctcggacctaccgtaagtcgtcggtaccgccgtccgtacgcccctaccgtggacccatacgaggtccgggccgtcccgggacccgaggtactcggaggccgttagtactttaacgttacgttggttacgggttacgggttggggaacttcccgacgtaccggtaccgttacgggtaccgttacgttccggttttaaccggttccggttaccgggggtacggtaccccggtttacgggggtaaaacccccgtaaggggtttaacccccgtacccgggttacccggtttaaacccgggttcccggaaacccgggttaacccccggaacccgggtaaccccccggtaaaccccccgttacccggg

SEQ ID NO: 164094 - DNA, 775 bp, Homo sapiens
  misc_feature: GYAE6OF02IKQJ3.47.55.E11.1.454.CMB.1.raw
  modified_base (220)..(220): a, c, t, g, unknown or other
  misc_feature (220)..(220): n is a, c, g, or t
tcagagctcacgtacacgaccggtgctcgatttagcactcgcacgttggggtttggggagcttcagctgtggtagagaagacaggattcaggacaatctccagcatggccgcttccctctcctcctcaccctcctcactcactgtgcagggtcttcgggccctagtctgtgctgactcacgcccaccctcaggccgttccgtaccggggaccccccgggnacggaccggtccaacctattccttctttgttccgtagggaacgcagcctaccaaatagtacggaaaatgaattaaattgtaactacgtacggaaccagacaacgtccccaacggaaccccgaccccaacttcctactacacttaaataacaatgactcgacggtccggacccttacgggaccgggtccctcgggtaccctactttccgtccgtcggaccttacccgaaggttccgtaccgggccctccgtacgaaccgcccctaaccgtccggaccctactccggtacggtccgggtaccgtcccgggacccggaggtacgtacgggtacgtacgttagttaactttacgttacgttagggttaggtttacggggttaggtacgttccggtacgaccggtacgtacggttaaccgttcggttaccgtttacggttccggttaccgggacggttaccgggtaaccgggtaccgttaaaccgggttcccgtaaccggtttccgtaaccggtaccgtaaacccggaccccgtaaaccgggcccccctaaaccgtaccg

SEQ ID NO: 164095 - DNA, 728 bp, Homo sapiens
  misc_feature: GYAE6OF02G346N.47.55.E11.1.454.CMB.1.raw
  modified_base (200)..(200): a, c, t, g, unknown or other
  misc_feature (200)..(200): n is a, c, g, or t
  modified_base (273)..(273): a, c, t, g, unknown or other
  misc_feature (273)..(273): n is a, c, g, or t
tcagagctcacgtacacgaccggtgctcgatttagcactcgcacgttgggttttccgttgttgctcttttaaaaggtgtccagtgtgaggtgcaggtagtggagtccgggggaggcttagttcacgcctggggagtccctgagactctcctgtgtagtctctggaatcagtttcagtaccttctggatgcactgggtccnccaaactcgaggtaagggctggtgtgggtctcacgtatcaatcctagagtggactagttacgttaataaattntggtgtactccggtagacgggcctagttcgacgcactctctagacgacaacggcaagagtactacgtagtactcgtagaatacgaactactgtagagagtacgagagtacggctagtctagtctagtttgttgttttacgagtcgttaccgttcggtaccggtcgggtacctttcgggagggaccgacgggtaccgtcggtacgtacggtcgttaccgtccgttacgacgtccctaccgaacccggtaccggtaccccgtacggttccccggttcccgtttaccccggtcggtaccccgttcccgttccggtaccggttacccgacgggtaaccggtcccgttaaccccggtaccggtaaccggtaccgaacccggacccgggtaaccgggtccccgggttacccggtcgggttaccccggtaccgggtccggtaccggtaaccgttaacccggg

SEQ ID NO: 164096 - DNA, 680 bp, Homo sapiens
  misc_feature: GYAE6OF02HSZMN.47.55.E11.1.454.CMB.1.raw
  modified_base (211)..(211): a, c, t, g, unknown or other
  misc_feature (211)..(211): n is a, c, g, or t
  modified_base (217)..(217): a, c, t, g, unknown or other
  misc_feature (217)..(217): n is a, c, g, or t
  modified_base (221)..(221): a, c, t, g, unknown or other
  misc_feature (221)..(221): n is a, c, g, or t
  modified_base (224)..(224): a, c, t, g, unknown or other
  misc_feature (224)..(224): n is a, c, g, or t
tcagagctcacgtacacgaccggtgctcgatttagcactcgcacgttgggtttggggagctgtggtagagaagacaggattcaggacaatctccagcatggccggcttccctctcctcctcaccctcctcactcactgtgcagggtctgggcccagtctgtgctgactcagccaccctcagcgtctgggacccccggacgcgtcacatctntgttcnggancanctacaatagcgaatgaataatgtatactagtacagacaacgtcccgaacggaacccgaccccaaactcctacacttactaactaacaatcgactacgacgccgtcctcggtaccgggtcccgtacggtccgtatttccgtcgcggtacctaccgtaacgtcgtcggccctccgtcgaccgtccccgtacccgtcgacctagtccgtacgggtccgggtccgtacccgggaccggtaggtacgtacgggacggtccgttaggttactttaacgtttacgttaggttaggttacgggtgggtacgtcgtaacgtacggtccgtacgtcgttacgttaccgtttaaccggttcgttacgggtacgtccgtacgggtaacccgtaacggtcccgtaacccggttacgtacggaccgtaaccgacccggaaccgacccctaacccgtactccgtaccgtcc

SEQ ID NO: 164097 - DNA, 752 bp, Homo sapiens
  misc_feature: GYAE6OF02GUZ0D.47.55.E11.1.454.CMB.1.raw
  modified_base (216)..(216): a, c, t, g, unknown or other
  misc_feature (216)..(216): n is a, c, g, or t
tcagagctcacgtacacgaccggtgctcgatttagcactcgcacgttgggtttgggggagcttcagctgtggtagagaagacaggattcaggacaatctccagcatggccggcttccctctcctcctcaccctcctcactcactgtgcagggtcttcgggcccagtctgtgctgactcacgcccacctcacgccgtacgtccggggacccccgggnacggaccggtcaccattcctctttggtctggagcagcctacctaatagtacggaaatgaactaatagttactaccgtacggacctacgactaaccgtacccccgaacgggaaaccccgacccccctaaaacttcccctactaactaccttaaagtaaactaactagactacgaacgcccggtacccgtaccggtacggggttcccctaggacccttagttacctcgtcggtcctaaccgtaaggttccgccgggcctcccgtacaacccgtccccgtacccgtcgtacctaacgtccgacgggtccgggtacccgtccgggacccgtagggacgtacggacggttctagttaactttacgttaacggttgggttacgggttacgggttacgggtactcggtcgtaccttccggtactacgttccgtaccgtttcggtaccgttcgggaggtacggtccgggtactaaccggttcccgtacccggtacgttacggtcccgaacccggtaccccggaaccgtaccccgtaacccgtcg

SEQ ID NO: 164098 - DNA, 688 bp, Homo sapiens
  misc_feature: GYAE6OF02FGVX0.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggtttccttgttgctcttttaaaaggtgtccagtgtgaggtgcaggtagtggagtccgggggagcttagttcagcctggggatccctgagactctcctgtgtagtctcgtggaatctagtttcagttaccttcttggatgctacgtcgggtcccgcctaaaactccgaaggtaagggctggtggtgggtctcgacgttatcaacttcccgtagagttgggacctaggttcgtttaaattaaactttagtcggaccggtacctccgggtagggaacggggggtacctaagtttcgagtacctatcctaccgagaacggaccgaaacggactaaaggtaacgtactacgttagttaacttacgtaacggtaaatacgtaacgtaacgtacgtacggagtacgtacggaacgtaacgttacggacttaggtacttagtacgttattggttacgttttacgactttcggtcccgttttaccggggtcccggtacggggttaccgtttccgggtacgggtaccccggtacggggttaaccccgttacgggg

SEQ ID NO: 164099 - DNA, 689 bp, Homo sapiens
  misc_feature: GYAE6OF02IIDZP.47.55.E11.1.454.CMB.1.raw
  modified_base (187)..(187): a, c, t, g, unknown or other
  misc_feature (187)..(187): n is a, c, g, or t
  modified_base (208)..(208): a, c, t, g, unknown or other
  misc_feature (208)..(208): n is a, c, g, or t
  modified_base (239)..(239): a, c, t, g, unknown or other
  misc_feature (239)..(239): n is a, c, g, or t
  modified_base (251)..(251): a, c, t, g, unknown or other
  misc_feature (251)..(251): n is a, c, g, or t
  modified_base (341)..(341): a, c, t, g, unknown or other
  misc_feature (341)..(341): n is a, c, g, or t
  modified_base (376)..(376): a, c, t, g, unknown or other
  misc_feature (376)..(376): n is a, c, g, or t
tcagagctcacgtacacgaccggtgctcgatttagcactcgcacgttggggtttggggagcttcagctgtggtagagaagacaggattcaggacaatctccagcatggccggcttccctctcctcctcaccctcctcactcactgtgcagggttcttgggcccagtctgtgctgactcagccacctnagcgtcgtcgggacccccggnaggacggtcaccatcgtcttgttctggaacncagctaccaatntacggaaatgaattaatgtaattacgtggtaccagcaacgtccccaacggaaccgaccccccaaacttccctcacgtactaataacagtnactcgacgccgccctgacgggtcctggcctattcncgtcggacttcgaacgtcgtcgccgtcgtcacgccccaccgtcggacccagtccgtaggtcggcccgttacccgggacccggaaggtacgtggacggttctacgtaactttacgttacgtggttacggttagggttcgggaacgttccgtacggtacccgttagtaccgttcggtaccgtttaaccggttccggtttaccgggagttacccggtacggggtaaccccgtaagggttacccgtaacccggttccgttaaccgggtcgtaacccggtacccgaacccggtaccccctaaccccggctttacccgg

SEQ ID NO: 164100 - DNA, 786 bp, Homo sapiens
  misc_feature: GYAE6OF02IR3NH.47.55.E11.1.454.CMB.1.raw
  modified_base (592)..(592): a, c, t, g, unknown or other
  misc_feature (592)..(592): n is a, c, g, or t
tcagagctcacgtacacgaccggtgctcgatttagcactcgcacgttgggtttgggggccgcagccctgggattcccagctgttttctgcttgctgatcaggactgcacacagagagctcaccatggagtctgggctgagtcgttgggtttttccttgttgtcttactttttaaaaggtgtcctagttgtaggaggtgacgaggttagtgggacggtccggggggagtctttaggttcgacggccgtggggtacgttcccgtagacgacttcctccgttgtgtagtctcgtagattcgtagtttctacggttacctttcgtggagttcgaccgtacgtccgggttacccacctaaaaccgtcccggaaggggttaacggggtcgttggggtacgtcgggtccttcgacgttagttactactccgtagtacgtgacttagttaacgtttaataagttagtcggtcggtaccgtgggtcgggacgggtctactccgatcgtctactacgaagacggaacgaacggaactaacggttaagttacgtagttacgttaacgttacggtaagtaaacgttaacgaaacgtaccgttanaacggttaagggtaccggtaacgttaaccgtaaccgttacgggtacttacgttaaccttagtttaccgttacgttttttggtttacggttttaacgtccggtttacggttccccggtttaccgggttacccgggttccggttaccgggttttacggacccggggtaaccggttacccgggtacccggttccggg

SEQ ID NO: 164101 - DNA, 826 bp, Homo sapiens
  misc_feature: GYAE6OF02IZI08.47.55.E11.1.454.CMB.1.raw
  modified_base (258)..(258): a, c, t, g, unknown or other
  misc_feature (258)..(258): n is a, c, g, or t
  modified_base (298)..(298): a, c, t, g, unknown or other
  misc_feature (298)..(298): n is a, c, g, or t
  modified_base (558)..(558): a, c, t, g, unknown or other
  misc_feature (558)..(558): n is a, c, g, or t
tcagagctcacgtacacgaccggtgctcgatttagcactcgcacgttggggtttgggggccgcagccctgggattcccagctgtttctgcttgctgatcaggactgcacacagagagcctcacagtggagtctgggctgagtcgttggggtttttccttgttcggtcttacgtttttaaaagggtcgtccgtaggttggtaggtagggtgcgtagggtaggtcgggtagggtccggggggtaggttcgttacgttcgnggtccgtgggggactcccgtgacgtctctcgtgtacggtntctcgagtatcgtagttctacgttaccttgtaggtagtgcgtaacggttcggtcccgaacctaaccgtaccggaggggtaacgggtcttggggtaggttcgggtctacgtacgttacgtacgttaacttccggtgtaggtggtacgtaacggttaagtttaaataaaggttctcgggtaccgtacgttaccggggtacggtacggggtcccgtaagttcgaaacgtcttaaccgttccgaaacgtaggaacgtaaaccgnggtaacgtaaagtacgtaacgttctaaggttaaccgtgtaaaacgtagaacgtaaacgttacgttgaacgggtaacgtaccggtaacggttaactaccggggttaaccgtagttcctaaacggtttaacgtcgtttacggtttacggttttaggtttccgtaaggtttccccggggtttaacccgggttcccggttaccggggttacgtttcccgggttaacgggttaccgggggaaccccggtttaacccgggggcttaacccgggg

SEQ ID NO: 164102 - DNA, 749 bp, Homo sapiens
  misc_feature: GYAE6OF02IJBWD.47.55.E11.1.454.CMB.1.raw
  modified_base (506)..(506): a, c, t, g, unknown or other
  misc_feature (506)..(506): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtcgtggctgagtcgttgggtttttccttgttgtacttacgtttttaaaaaggttcgttcctagtggtagaggtgcgtaggtagtggacgggtaccgggggagtcgttagttcagtccgtggggtacgtccgtgacgtactccgtcgtgtcgtagtctcgtaggaattctagtttctacgttaccttcgtaggtactcgtacgtacggtccggtacccgtaaccctaaaccgtccggtaaggggtaacggggtcgtggtcgtaggtccgtacgtacgttactacgtaacttccgtagtacgtggtacgtagttaagtttaacgttaaagttacgtcggtaccggtaacgtcgggtagggaccgggtacgtacgttacgngacctacgtctaaccggagtacggaacacggaacaaagtacgttacgttaactgttatacgtagaaacgtagaaacgtatcgtagaaggtacgtaacgaagtacgttcgtcgttagtacgttattcggttttagttttacggttcgtaaccggtttccgtttacccgggttccggtacccggtacggggtttcccgttacggggttaccccggggaccgttaaccggggtcctacggtaccgg

SEQ ID NO: 164103 - DNA, 746 bp, Homo sapiens
  misc_feature: GYAE6OF02IZMCW.47.55.E11.1.454.CMB.1.raw
  modified_base (206)..(206): a, c, t, g, unknown or other
  misc_feature (206)..(206): n is a, c, g, or t
  modified_base (217)..(217): a, c, t, g, unknown or other
  misc_feature (217)..(217): n is a, c, g, or t
  modified_base (237)..(237): a, c, t, g, unknown or other
  misc_feature (237)..(237): n is a, c, g, or t
tcagagctcacgtacacgaccggtgctcgatttagcactcgcacgttgggtttggggagcttcagctgtggtagagaagacaggattcaggacaatctccagcatggccgcttccctctcctcctcaccctcctcactcactgtgcgaggtcttgggcccagtctgtgctgactcacgccaccctgacgcgtcgtcgggaccccgnacgacgtcacntcttcttagtcgtaggaacncgagtcctaccaagtacgtacggaaatgaattaatgtaactacgtcggtacacgacgtaacgtcccgaaccggaacccgacccctaaacctcctacgtaactacgtaaactaacctaagtcgtaactacgacggtcccgtaccgtacgggtaccgggtaccctacggtacccttaactttccggtccgttacggtaccccttacggaaacggttccgtacggggaccctccgtaccggacccgtaccccgtaacccggtccgaccgttaacgtccggtagggtcccggtcccgggttacccggaccggtacggtaacgttacggccgtcgttaacgttaactttacgttacgttcggttagggttaaggtccggtaacgccgtacgccgttaccgtgttaccgcgttaccgttacgttcgggtacgaccggtcggtaacggtaccgtaacggtcccgtaaccgtttcggacctacgtacccgaacccggtaccaccccggacttaccgg

SEQ ID NO: 164104 - DNA, 759 bp, Homo sapiens
  misc_feature: GYAE6OF02H5UCZ.47.55.E11.1.454.CMB.1.raw
  modified_base (186)..(186): a, c, t, g, unknown or other
  misc_feature (186)..(186): n is a, c, g, or t
  modified_base (205)..(205): a, c, t, g, unknown or other
  misc_feature (205)..(205): n is a, c, g, or t
  modified_base (237)..(237): a, c, t, g, unknown or other
  misc_feature (237)..(237): n is a, c, g, or t
  modified_base (419)..(419): a, c, t, g, unknown or other
  misc_feature (419)..(419): n is a, c, g, or t
tcagagctcacgtacacgaccggtgctcgatttagcactcgcacgttgggtttggggcagcttcagctgtggtagagaagacaggattcaggacaatctccagcatggccggcttccctctcctcctcaccctctcactcactgtgcagggtcttgggcccagtctgtgctgactcagccaccctnagcgtctgggacccccggnaggacgtcaccctatcctcttgtctaggaacncagctccaaattactcggaaatgaacttaatgttactacgtcggtaccagcaaacggtcccctaaggaacccggaccccctaaacgttccctacagttcttaactaacaagtacgactcgtaacgccggggtacccttcggaacggggttcccacgggtacccgtacttcctcgtcggtacncccgtaaacgtcgtacggccgccttaccgaccgacccgtacccgtagggtaccctaacgttacgaacgggttcgggcccgtttacccggggacccggtaacggtacgtaccgggttacggtaacccgttggttaactttaacggtttaaccgtacgggtttaggttaacgggttacggggtaactccggtaacgtaaccggtccgttaacggtaccgttcgggtactttaccggttaccgtttccgggaacgtccggtaacgggtaaccgaacggttcccgtaccggttaccggttacgggtacccgttaacgacccggtaccggacccgtaaacccccg

SEQ ID NO: 164105 - DNA, 837 bp, Homo sapiens
  misc_feature: GYAE6OF02GI1BJ.47.55.E11.1.454.CMB.1.raw
  modified_base (140)..(140): a, c, t, g, unknown or other
  misc_feature (140)..(140): n is a, c, g, or t
  modified_base (161)..(161): a, c, t, g, unknown or other
  misc_feature (161)..(161): n is a, c, g, or t
  modified_base (211)..(211): a, c, t, g, unknown or other
  misc_feature (211)..(211): n is a, c, g, or t
tcagagctcacgtacacgaccggtgctcgatttagcactcgcacgttgggtttggggagctgtggtagagaagacaggattcaggacaatctccagcatggccggcttccctctcctcctcaccctcctcactcactgtncgagggtcttgggcccagtcngtgctgaactcacgcccaccctcacgtcgtcgtaccggggacccccgganacggtaccggtcacctattccgttccgttttaggttccgtacgggaaaacgttccgaacgtccttaacctaaaacgttaggttaaccgggtaaaatgtaaaactaaagttacgttaacgttacgttacgggtaaccaaggtaaccgtaaaccggttaaccccgaaccgggtaaacccgtaacccccctaaaaccttccctacttaacttaacttaaataaacctaagtacgtacctaacgaccgtccccgggtacccttaccgggtaaccggggtccccgtaggcccgttaattcccggtacgtcggtaacctacccggtaaggttcgtacggacttccgaccgccttacccgaccgtcgtaaccgtgtaccgaacggttccggacccggtaccccgggaccggtaaggtacgtacgggtccgtacgttacggtaacttacgtttaacgtttggtcgggtttaaaggggtcgtacggtaccggtccgtaacggttccgtacgtacgttccgggttacttaccggttcgggttacctacgggccggttacggtacccgtaacggtccggaaccgttccggaagttccgaacgacccgtaccgaccctaaccgtcggttcaccttacg

SEQ ID NO: 164106 - DNA, 769 bp, Homo sapiens
  misc_feature: GYAE6OF02HLWW6.47.55.E11.1.454.CMB.1.raw
  modified_base (300)..(300): a, c, t, g, unknown or other
  misc_feature (300)..(300): n is a, c, g, or t
  modified_base (563)..(563): a, c, t, g, unknown or other
  misc_feature (563)..(563): n is a, c, g, or t
  modified_base (616)..(616): a, c, t, g, unknown or other
  misc_feature (616)..(616): n is a, c, g, or t
tcagagctcacgtacacgaccggtgctcgatttagcactcgcacgttgggtttggggccgcagccctgggattcccagctgtttctgcttgctgatcaggactgcacacagagagctcaccaatggagtctgggctgagcgtggttttccttgttgcttacgttttaaaaggtgtccagtgtgagtgcaggtagtggaggtccggggagtcgttagttcgacgtccgtggggacgttccctagagtacgttcctccgtgtgtagtcgtcgtaggaactctacgtttctagttacctttcnggtactgacctacggtacggtccccgaaccaaacgtaccggtagggtaacgggcgttagggtcgtcggtcctacgtagttactaccgtaactccgtagtagtcggtagtaggttactttaaattaaagttgtacggtaccggtaacgtacggtgggacgggtacctagtacgacgtactcgttaccgtccggaagtaaccgaaggtaaaccggagtaaacgtacgtaaacttacgttaaggttactacggtaaggttaaaacncgtaaactagtttcgaaggtaacggtaacgttccgaaacgtacggttacccgngtttacgtaacgtttcgttacttacggtttttacgtttaccgtaagggtttacccttacccgggtttccggtaccccgggtttgggtttaaccccgttccgggggtacgggtaacccccggtaaacgggttccccgtaggggtttaaccccgg

SEQ ID NO: 164107 - DNA, 787 bp, Homo sapiens
  misc_feature: GYAE6OF02G5721.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtcgtgggctgagcttgggttttccttgttgcttacttttaaaaggtgtccagtgtggaggtgcgaggtaggtggaggtccgggggaggtcgttagttcagccgtgggggacgtcccgtgagactctcctgtagtgtctcgtaggatctagtttcacgttaccttcgtggtatggactacggtcgggtacccgaccctaaaccgtaccgaagggtaacggggcttggggtggtcggtcctacgacgttagtacgtaacttccgtgacgtcggtacgtaagttattaattaaattaggtacgtacggtaccgtacgggtacgggtacggggaccgtattcgaacggtactaccgtttccaacggaacgtaaacggaccgtaaacggacgtaaaggtaacggttaacttacgtagttacgtacgtaaggaaactagtaaacgtaagtcgtaaggaacggtacggtaccgtaacggaaccgttaccgtacgtttacggtaacgttacttaccggtttaagttttccggggtttacgttttaacggtaacggttttccccgggttacccggtttaccccggggttaacgggtccccggggtttaccgttttaccgggggttcccggggaaaccggttacccgggggttaccccgttacccgggg

SEQ ID NO: 164108 - DNA, 714 bp, Homo sapiens
  misc_feature: GYAE6OF02HBOPI.47.55.E11.1.454.CMB.1.raw
  modified_base (188)..(188): a, c, t, g, unknown or other
  misc_feature (188)..(188): n is a, c, g, or t
  modified_base (264)..(264): a, c, t, g, unknown or other
  misc_feature (264)..(264): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggttttccttgttgcttacttttaaaggtgtaccagtgtgaggtncgaggtagtggaggtccggggagtcgttagtcagtccgtgggacgtccctagacgacttcctccgtgtgtagtctntaggtaatctagtttcagttaccttgtggtatgctcgtcgggtcccacctaacgtcggaaggtagggcgtgggtgtaggtcctagtacgtataccgtagtcctaggtgtgtactagtagtttaattaacttaggcgtacggtacttcggggtacgtagggtacctgttacacgtctacgtccgtacgaacgaacggtaccgaaacggtacctaaagtagttaaaccgagtttacgtaacgtaaccgttaaggtaactaaagtaaactaacgtcggtaacggaagtacggtaaccgtaacgtacgtaacgttacgttagtaaccgttagttaccgttagttttacggtttaaccgttttcggtaacgtttcccgggttaaccggttccggttaccggttaaccggttccgtttacggggccgggttaacccgacgggttccgtaacccggg

SEQ ID NO: 164109 - DNA, 735 bp, Homo sapiens
  misc_feature: GYAE6OF02JE6GJ.47.55.E11.1.454.CMB.1.raw
  modified_base (212)..(212): a, c, t, g, unknown or other
  misc_feature (212)..(212): n is a, c, g, or t
tcagagctcacgtacacgaccggtgctcgatttagcactcgcacgttgggtttggggcagcttcagctgtggtagagaagacaggattcaggacaatctccagcatggccggcttccctctcctcctcaccctcctcactcactgtgcagggtcttgggcccagtctgtgctgactcagcccaccctcacgcgtcgtcgggaccccccgggnacggaccggtcaaccattccttcgtttcgttctgggaacgcagcctaccaatactacggaaatgataatgtaatacgtaggtaccaggactaacgtaccccgaaccgaaccccggacccccaaacgttccctacaacttacctaaataaaccaagtgaacttaccgacggcccggtccctaccggacgggggttacccctcgggtacccgtactttccgtccgtggacccttaccgaacgttccgtcgggccctcctccgacgccccgtacccgtcgcctaacgtcgacgggtccgggtcccgtcccgggaccggaggtacgtcggacgtcggttacgtacgtttagttacgtaggttacgggttaagggttacgggtactaccgggacctacggtacccgttacgtacgttcggtaccgttttaccggtcgttacgggacgtccggtacgggaccctaacggttacccgtacccgttccggttacggtaccgaccggtaacccgaccggacccctaaccccg

SEQ ID NO: 164110 - DNA, 648 bp, Homo sapiens
  misc_feature: GYAE6OF02I87OG.47.55.E11.1.454.CMB.1.raw
  modified_base (216)..(216): a, c, t, g, unknown or other
  misc_feature (216)..(216): n is a, c, g, or t
  modified_base (256)..(256): a, c, t, g, unknown or other
  misc_feature (256)..(256): n is a, c, g, or t
  modified_base (301)..(301): a, c, t, g, unknown or other
  misc_feature (301)..(301): n is a, c, g, or t
  modified_base (346)..(346): a, c, t, g, unknown or other
  misc_feature (346)..(346): n is a, c, g, or t
  modified_base (378)..(378): a, c, t, g, unknown or other
  misc_feature (378)..(378): n is a, c, g, or t
  modified_base (394)..(394): a, c, t, g, unknown or other
  misc_feature (394)..(394): n is a, c, g, or t
tcagagctcacgtacacgaccggtgctcgatttagcactcgcacgttggggtttggggagcttcagctgtggtagagaagacaggattcaggacaatctccagcatggccggcttcctctcctctcaccctcctcactcactgtcgcagggtcttcgggcccagtctggtcgctgactcacgccctacctcacggcgttcgtcggggacccccggnacggacggtcacctattctcgttacgttcgaggaacgccngacctctaatagtaccggaatagaatactgtactactggtaccanacgtacgaccaacggtacccgaccccaacttcctacactactaanaacagtcatcgacgccgtcacgcggggtaccngggccgtacttcgtcncggtactacgtacgtcgcggtcctccgtactacccggccgtaacccgcggtaccacgtcggcggtcggcccgtacccgggacggacgttcggacgggacgtacgtacgtttacgtcttacgtaggtttagggaggttcggggttaactcggtcgacggtcgtacgtacgttctcgttacgttacggcgtaggcggtacggtacggtaactcgaccgttacgagttaccgaccggacctaccgaccctacgtacg

SEQ ID NO: 164111 - DNA, 681 bp, Homo sapiens
  misc_feature: GYAE6OF02IZ804.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagtcgttgggttttccttgttgcttacttttaaaaggtgtccagtgtgaggtgcgaggtagtggaggtccgggggagcttagttcagccgtgggactccgtgagactctctgtgtagtctcgtgaatctagttcagtaccttcaggatgcacgtcggtccaccaacgtcgaggtacgggctggtgtggtctcgtatacgtactaatcctagacgtggatagttagtttaataagttagtcgacggtactacggtagggacgggccgtatacgacgtactacctacgtacgaaggtaacgaaccaacggtaacaaaggtagttaacgtacgttagtaactacgttaaacggtaaaagtacgtaaactaagtcgtaagtaacggtaacgtaaccgagtaaacgttaccgtataccgtaacttagttaaccgttagtttacggtttaggtttaccgagttaccggttcccggtttaccgggtcccgggtacggttaccgggtttaccggtacccggggtaccggttaaccgggtacccggttacggg

SEQ ID NO: 164112 - DNA, 617 bp, Homo sapiens
  misc_feature: GYAE6OF02FSD1H.47.55.E11.1.454.CMB.1.raw
tcagagctcacgtacacgaccggtgctcgatttagcactcgcacgttgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaaactccaggtaaggggctggtgtgggtctcacgtatcaatcctgatggcagtgttataaattatgcggactccgtgaggggccgtattcagcatctccagagacaacggcaagagtatactgatctaggaaatgaacaatctgagagtcgacgatacggctgtctatctattgttgttttcgatggtccctttcgggtcccggtcgggtacctttcggtacggggtccgaacggggtaaccctgggtcacgtccgttcctcctcacgccctacccaccgaacgggcccctagtccggtccttcccccgtggcccgtcccgtcgtcccgtaccgacggaccgcctaacccgtccggacgtacgccgaccgacggcccggcccgtcgggccgttcggcccgtaggtcctaaaccggg

SEQ ID NO: 164113 - DNA, 716 bp, Homo sapiens
  misc_feature: GYAE6OF02H7HK2.47.55.E11.1.454.CMB.1.raw
  modified_base (189)..(189): a, c, t, g, unknown or other
  misc_feature (189)..(189): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggttttccttgttgcttacttttaaaaggtgtccagtgtgaggtgngaggtagtggaggtccgggggagcttagtcagcgtgggagtcccgtgagactctccgtgtgtagtctgtagtatctagtttcacgttaccttcgtaggatgtacctcgtcgggtaccgacctaaaccgtccgaaggggtacggggtcttgggttcggtcggtctacgtacgtaatccgtaatccgtagagtcggactagttagttaattaaagttgtcggtacgtacgtccgggtaggtaccggggacgtaacttcgagtctacttacgaccgtaaggaacgaacgtaacgggataaaggtaacgttaacgtaacgttagttaacgtaccgttaaaggtaaacgtaacgaaactaaagttcggaggtaaacggtacgtaccggtaacgtaacgttaccgggtcttaggttactaacgttcgttagtttacggttacggttttgaaccgtttcgggttacccgtttccgggtcccgggtaacgggttcgtaccgggtacgggtaaccggtacccgggtaccgtacggg

SEQ ID NO: 164114 - DNA, 705 bp, Homo sapiens
  misc_feature: GYAE6OF02G6CWQ.47.55.E11.1.454.CMB.1.raw
  modified_base (208)..(208): a, c, t, g, unknown or other
  misc_feature (208)..(208): n is a, c, g, or t
  modified_base (236)..(236): a, c, t, g, unknown or other
  misc_feature (236)..(236): n is a, c, g, or t
  modified_base (371)..(371): a, c, t, g, unknown or other
  misc_feature (371)..(371): n is a, c, g, or t
  modified_base (384)..(384): a, c, t, g, unknown or other
  misc_feature (384)..(384): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagcccaccctcagcgtcgtcgggacccccggnagacggtcaccatctcttgttctggaancagctaccaatatacggaaatgaataatgtaatactcggtaccagactaacgtacccgaaccggtaaccggaccccctaaaactcctacactactaataacaatgactacacggccggtccctggacgggtcccnggccgtactttcncgtggacctaccgtaaggtccgtcgccgtccctacgacgtcccgacccgtcggccctaacgtccgacggtccggggaccctccccgggaccggaaggtacgtcgggaacggtcgttaggtaactttacgtacgttggttacgggttaagggttcgggtaccgttcggccgttaacggcccgttaacgtcgttacggtacgtttaccgttccggttacgggtacggtccggttaacggggaacccgttacggtaacccgtacccggtttacggtaccggaccgttaaccgaccccggaacgtacccccgaacccgttaccgg

SEQ ID NO: 164115 - DNA, 724 bp, Homo sapiens
  misc_feature: GYAE6OF02GYXJE.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagtctggttttccttgttgctactttaaaaggtgtccagtgtgaggtgcgaggtagtggaggtccgggggagcgttagtcgagcgtggggactcccgtgagactctccgtgtgtagtcctgtaggtaactcgtagttttaccgacgttaaccttcgtggtactcgtactaccgttcgggtaccctacccgtaaacgtccggtaaagggttaacggggtcgttcgggtaggttcggtaccgttacgtaacggttataccgtaacgttccgtaggtacgtggacgtagtagtttaaataaacgtagtacggtacgacggtacggtggaacgggtcctagtcacgctagtcccgtagaagcgtaaacggacgtaagaagtagttaacgtacgtagttaaacgtcgtaaaggtaacacggtaaactaggttacacgggtaaagtacccgtacggtaagtaaccgtttcggcgttacgttaaacgtagttacgttacgtttttggtccggtaactcgggttacccgttcgggtaccggttaccgttcggtacgggtacccggggaccgttacggtaacccgtgtaacccggg

SEQ ID NO: 164116 - DNA, 783 bp, Homo sapiens
  misc_feature: GYAE6OF02HVDQH.47.55.E11.1.454.CMB.1.raw
  modified_base (211)..(211): a, c, t, g, unknown or other
  misc_feature (211)..(211): n is a, c, g, or t
tcagagctcacgtacacgaccggtgctcgatttagcactcgcacgttgggtttggggagcttcagctgtggtagagaagacaggattcaggacaatctccagcatggccgcttcctctctcctcacctcctcactcactgtgcaggtcttgggccctagtctgtcgctgactcacgcccaccctcacgtcgtccgtacgggaccccccggnacggaccggttcaccgaacgtccttccgttgtttcgtcggtaaacgccgtaacggtccttaccgaaagttacgtacggaaattcgaattaaactggttaactacgtacggttaccagactaacgttcccaacgaacccgccccaaacgtcctagactacctataacaactgaatccgaagccggccctagaccgggtccctaggtcctagtttcctcgtaccggtactaccggaacgttcgtacgggtccctcccgtactacggacccctacccgtaggaccctaagtcccgtaacgggtccgggacccgttaccgggaccccgttaagggaccgtacggtaccggttaccgtttaggtacttttaacggttacgttaggttacgggtttaaacgggtcgggttactaccgggtacgtaacggtaccgttccgtaaccgttcgggttaaccttttaccggtacggtttacgggtaccgtaccgggtaaccgggttaacccgtacggttacccgtacccgtttaccgtacggtaccgaccgtacccggtaacccgacccgtaacccgtaccgg

SEQ ID NO: 164117 - DNA, 832 bp, Homo sapiens
  misc_feature: GYAE6OF02JGEAV.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagtcgttgggttttccttgttgcttacgttttaaaggtgtccagtggtgaggtgcaggtagtggacggtccgggggagtcttaggttcgacggtccgtacggggtactcccgtagaacggtccttccgtccgttggtagttagtccgtcgtaggtaattcgtagtttaccgacgttaccttcgtaggtactcgtacctcggtacgggtcccaacctaaacgtccgaagggttacgggtcgtgggtgtacgggtctacgacggttacaccgtaacttccgtgtaacgtggtaccgtagttacgttaaaagttaacgttacggtacggtaccgtacgtcggtagggtacgggtaccgtaagttcgagtccacgtttccacggaagtaaccgaaccgaaacgggtacagggttaacgtacgtactacgggttaaccgtaacggttaaacggtaaacaaccggttaaaactaacggtttccgtaaacgggaaaggggtttaaccccgttaaacccggggaaacgtaaacccgttttaccgggcgttttaaaccggttaaccgttaagtttacccggtttaggtttaccggttttaccgttaggacccgtttccggttccccgggttacccgggtacccggttacggtttaccccgttaacggggccggggtaaacccgtaacccgggttcgttaccggg

SEQ ID NO: 164118 - DNA, 705 bp, Homo sapiens
  misc_feature: GYAE6OF02H8UEN.47.55.E11.1.454.CMB.1.raw
  modified_base (613)..(613): a, c, t, g, unknown or other
  misc_feature (613)..(613): n is a, c, g, or t
  modified_base (624)..(624): a, c, t, g, unknown or other
  misc_feature (624)..(624): n is a, c, g, or t
tcagagctcacgtacacgaccggtgctcgatttagcactcgcacgttgggtttgggggccgcagccctgggattcccagctgtttctgcttgctgatcaggactgcacacagagagctcaccagtggagtctgggctgagtcgttgggttttcccttggttcgtcttacgtttttaaaaggtcgtaccgtaggtgttggaagggtgcgtaagggttaggtgggtaacgggtccgggggtagttcgtttacggttcgtaaggccggtggggtacgttcccgtaggacggtacttccgttccgtggttcgtagtctcgtaggtaactctagtttcacgttacttcgtaggattcgcgtacgtcgggaccctaaccgaactcggaggtacgggtcgtggtcggtgtcgtaccgtgtacgtactacgtcgtagcgtcgagttagtacgttaataagtttacgcggtaccggttacgtaccgggtagggtaccggtaccgtacgtcgtacgcttaacgtccgaacgacggtaagaaccgtaacgggaaactagggtaacctttagacttagtacgtagtaagaacgagtaacgagtaccgagtacgacgaagtctcgnttcgaacgttntacgtagttcgtttgtacgcgttacccgttgtccgtaccgtgttccggttacggaccggtaacggttcccacggtagtcgg

SEQ ID NO: 164119 - DNA, 724 bp, Homo sapiens
  misc_feature: GYAE6OF02H80SG.47.55.E11.1.454.CMB.1.raw
  modified_base (691)..(691): a, c, t, g, unknown or other
  misc_feature (691)..(691): n is a, c, g, or t
  modified_base (696)..(696): a, c, t, g, unknown or other
  misc_feature (696)..(696): n is a, c, g, or t
  modified_base (708)..(708): a, c, t, g, unknown or other
  misc_feature (708)..(708): n is a, c, g, or t
  modified_base (714)..(714): a, c, t, g, unknown or other
  misc_feature (714)..(714): n is a, c, g, or t
  modified_base (718)..(718): a, c, t, g, unknown or other
  misc_feature (718)..(718): n is a, c, g, or t
  modified_base (722)..(722): a, c, t, g, unknown or other
  misc_feature (722)..(722): n is a, c, g, or t
tcagagctcacgtacacgaccggtgctcgatttagcactcgcacgtagggtcttgggcccattctgtgctgactcagccaccctcagcgtctcggggaccccggcagacggtcaccatctcttgttcgtggaagcatctccaatatcggaatgatatgtatactggtaccagactaacgtcccaacgaaccggacccccaaactcctcatctataacactagatcgagccggtcctaggacgggtccgtggccgtattcctcgtcggccttacgagtcgtcggccgtcctacgcgaccccaccgtcggtccatcgtcgggtcgggtcccgtcccgggaccggaggtacgtcggacgtcgtagttaagttttactacgtgggttacgggttaacggggtttggggacttcgaccgtacgtaccgttgtaccggttcgttaccgtttaccggtagttccggaagttcggtacgggtaaccgtaacgggtcccgtaccgtttaccgtaccggtaccgacccggtaccccgaaccggtacccccgaaacccgtccgttaaccgtccgtaacccgttccgttaccccggtttaccccctaccctttccccggtaacgttcgccggttaaccgtccctttacggaccggtaccggggtcggtaccgggttgaaccggttacgaccgtcgattcgggntaccngcctagtgacgntacgcngacngcancg

SEQ ID NO: 164120 - DNA, 682 bp, Homo sapiens
  misc_feature: GYAE6OF02H2W5A.47.55.E11.1.454.CMB.1.raw
  modified_base (284)..(284): a, c, t, g, unknown or other
  misc_feature (284)..(284): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggttttccttgttgtcttacttttaaaaggtgtccagtgtgaggtgcaggtagtggaggtccgggggagtcttagttcagccgtggggacgtcccgtgagctctccgtgtgtagtctctggaatctgtttcagttaccttntggatgctacgttcgggtacccgacctaacgtcgaagggttaacggggcgttgggtggtcgggtcctacgtaacgttactactaacgtcgtaggagtcgggtacgtaggtttacgttttaaattaaacgttgttacggtacggtaccgttccgggtaggggaacggggtccgttaagtacgacgtctacgttcctacgtaaggaacgtaacgaacggacaaagtagttacttaacgtgttaacgtacgtaaggtaaattcaaactatcgtaaggaagtacgtagacgaacgttgtacctagttatagttcgttatttggtttcgttgcgtttccgtccggttcccggtccggtaccggttccggttccggaccggggtaccgtaccgggttctacggg

SEQ ID NO: 164121 - DNA, 696 bp, Homo sapiens
  misc_feature: GYAE6OF02HCJA6.47.55.E11.1.454.CMB.1.raw
  modified_base (303)..(303): a, c, t, g, unknown or other
  misc_feature (303)..(303): n is a, c, g, or t
  modified_base (678)..(678): a, c, t, g, unknown or other
  misc_feature (678)..(678): n is a, c, g, or t
  modified_base (681)..(681): a, c, t, g, unknown or other
  misc_feature (681)..(681): n is a, c, g, or t
  modified_base (683)..(687): a, c, t, g, unknown or other
  misc_feature (683)..(687): n is a, c, g, or t
  modified_base (689)..(695): a, c, t, g, unknown or other
  misc_feature (689)..(695): n is a, c, g, or t
tcagagctcacgtacacgaccggtgctcgatttagcactcgcacgtagggtcgttgggcccagtctgtgctgactcagccaccctcagcgtctcggggaccccgggcagacggtcaccatctcttgtctggaagcagctccaatagtacggaaatgaataatgtaatactggtaccagcaacgtcccaacggaacccggccccctaaactccctcatactaataacaatgatcgagccggcctcggacggggtccctggccgtattccgtctgccgtacaagtccgtggccgtccctcgaacnccccaccccgtggcccagtcgaggtcgggcccgtcccgggaccccggaggacgtggaacggcgttagaattttaagttcgttggttcgggtaagggtttcgggaacttccggactcggcctaggtaccttggtaccctttacggtccggttcggagcggtacgggaacccgagggtcccgtaaccgtccgtaaggtcccgaacgcccccgtaaacgggaccccaacccgtacgtccggttaaccgtacttacccggtttaccccggtccccctaaacccgtttccccgtacgtttaagggtcccgtaggtaccccttggtaccggggaccgggggtcggttcccgggaggttaccgaacggccgtacgtatacgnacncnnnnngnnnnnnnc

SEQ ID NO: 164122 - DNA, 769 bp, Homo sapiens
  misc_feature: GYAE6OF02GLXOM.47.55.E11.1.454.CMB.1.raw
  modified_base (209)..(209): a, c, t, g, unknown or other
  misc_feature (209)..(209): n is a, c, g, or t
tcagagctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaaccggccccaaactcctcatctanaacaatgatcagcgccctcgaggggtccctggccgattctccgttggcctaccgaagtcgtaggccgcctcaacgcccaccccgtcggcctaacgtcgtaaggtcgggtcccttccccggggaccccggaaggtacgttggaaccggtcgttacggtaacgttttacgttaaccgtggttacgggttaacgggggtttagggtacgttaccggtaccgtaacggtcccgtttacggtaaccgttcggtacccgttttaaccggttcgtttaccggggaacggttccggtacggggtaaacccgtaaccgggttacccggtaacccgtttacccggtaaagggttccgaaaccggtcccccgaaaccggaacccccgtaaacccctacgtcgtacccgtaccttcgtcccgttacccccggtccccttaccgtccgttaacgtacggtacgtccgtaccgttacggacggtccgggtacctgggtaaccgaccgggtccgtacgtaacggttacgctacgtccgagcgtcgtacgacgcgtcgacgtacgtccacgtgtcg

SEQ ID NO: 164123 - DNA, 708 bp, Homo sapiens
  misc_feature: GYAE6OF02HYP4J.47.55.E11.1.454.CMB.1.raw
  modified_base (680)..(680): a, c, t, g, unknown or other
  misc_feature (680)..(680): n is a, c, g, or t
  modified_base (686)..(686): a, c, t, g, unknown or other
  misc_feature (686)..(686): n is a, c, g, or t
  modified_base (689)..(689): a, c, t, g, unknown or other
  misc_feature (689)..(689): n is a, c, g, or t
  modified_base (702)..(702): a, c, t, g, unknown or other
  misc_feature (702)..(702): n is a, c, g, or t
tcagagctcacgtacacgaccggtgctcgatttagcactcgcacgtagggtcttgggcccagtctgtgctgactcagccaccctcagcgtctgggacccccggcagacggtcaccatctcttgttctggaagcagctccaatatcggaaatgataatgtatactggtaccagcaagtcccaacgaaccggccccaaatcctcatctaataacaatgatcagccgcctcgacggggtccctggccgtattcctcgtacggacctaccgaagttccgtggccgtacccttacgaacgcccctacccgtggaccctatcgaacggtcgggaccttcccgggaccggtaaggactggacggtccgttagtaacgttttacgttacgtggttacggttacggggttggaacttccggacgtacggtcccttaggacccgttggtacccgtttaacgtccggttacggacggtccgtacggggtaaccgtaacgggtccctaacccgggttccgttaacggtaccaacccggtacccgtaaaccggacccctaaacccgtacgttcgacctacccgttccgtacccgtttcccccgaccctttcccgtacgtaccgtacggcctaccgttccgtagggaccggtccggtcgttacggaaccgtacggtacccgatacgtagcgtancgtagntgngactgcgatacgntgtcag

SEQ ID NO: 164124 - DNA, 1025 bp, Homo sapiens
  misc_feature: GYAE6OF02GW3II.47.55.E11.1.454.CMB.1.raw
tcagagctcacgtacacgaccggtgctcgatttagcactcgcacgttggggtttggggagagaagacaggattcaggacaatctccagcatggccggcttccctctcctcctaccaccctcctctactcacgtgtgcgacgggttcgttccgggaccctagtcgttggtcgtcgtacgacctcgaccgacccctacccctacgacggtccgttccgggtacccccggggggacccccccgggagtaacgggtacccggtacccaacccttactttcccgtttcgttttcgttccggtagggaaccgccaacggtccctaacctaaattaaccggtaaacggtaaatagtaaagttaagtagttaaccttacggttaccggtaaccgacgaaccgtaaaccgtaccccgaaccggaacccccggtaaccccctaaacctccctactacttacctaaataaaactagtacgtactaccgacggtccccggtacccgtaccgggtacccggggttcccgtaccgggacctttacgtttccgttacggtccgtaccgttaaccgtaacggtccggtacgggtaccccgtacctacccgacccgtacccccgttacccggtaccggaccctaacgtccgggtaaccggggtcccgggtaccccgggtacccccggggacccggtaacggtacgggtacgggtaaccggttcgttaacggttaaactttaccgtttaacgggttaggggtttacggggtttaaacgggggttcgggttaacccgtaccggtacgtacccggtaccggttaaccgtaccgtttcccggttaacccggtttaacgttcccgggttaaccgggtaggttcccgggtaaaccgggtaaaccggtaccggttacccgttacccgttacggttaacgggcccaacccgggtaacccccgaaacccggaacccccgttaaacccttcggttaccgttacccgttaccccgtttaccggtttacccccgttaccccccttaacccccgg

SEQ ID NO: 164125 - DNA, 454 bp, Homo sapiens
  misc_feature: GYAE6OF02F5ASZ.47.55.E11.1.454.CMB.1.raw
  modified_base (423)..(423): a, c, t, g, unknown or other
  misc_feature (423)..(423): n is a, c, g, or t
  modified_base (425)..(454): a, c, t, g, unknown or other
  misc_feature (425)..(454): n is a, c, g, or t
tcagagctcacgtacacgaccggtgctcgatttagcactcgcacgttgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcacgtgggtccgccaaaactccagccctccaccgaacgggcccagtccggttccttcccccgtggcccgcccgttcgccgtccgagggacgccaccctaccggagacggccaacgaggcccggtcccgtcggggcctcggtcccgttgggtaccgaaagggtacttacccttaccctacggtgacgcttcgtcggacggccggggtcttgggaccgaagggtcccgactaacgtangnnnnnnnnnnnnnnnnnnnnnnnnnnnnnn

SEQ ID NO: 164126 - DNA, 675 bp, Homo sapiens
  misc_feature: GYAE6OF02HEKL0.47.55.E11.1.454.CMB.1.raw
  modified_base (169)..(169): a, c, t, g, unknown or other
  misc_feature (169)..(169): n is a, c, g, or t
  modified_base (355)..(355): a, c, t, g, unknown or other
  misc_feature (355)..(355): n is a, c, g, or t
  modified_base (401)..(401): a, c, t, g, unknown or other
  misc_feature (401)..(401): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtnctgactcagcccaccctcagccgtcgtcggggaccccccgggacggacggtccaccatccttcttgttcctggaacgcagcctccaatagtacggaaatgaataatgtatactggtacagacagtcccacgaaccgaccccaactcctcactctaataacatgatcgagccggcctgacgggtccnggccgtacttctcgtggcctacgaagtcgtggacctcctacgaccnccacccgtcggcctactcgacggtcgggcccgtccggccggaggtacgcggtaggtctagtaacttttacgtacgttaggtagggttacgggttgggtactaccggtcgtacgtcccgttagtaccgtgttacccgtttaacgtccggttacgggacgtaccgggtaacgggtaaccgtaacgggttacccgaacccgggtttccgttaaccggggtcccgtaaaccgggtacccccgggaaacccggtacccccgtaaacccccgttaaccgg

SEQ ID NO: 164127 - DNA, 755 bp, Homo sapiens
  misc_feature: GYAE6OF02JQRKQ.47.55.E11.1.454.CMB.1.raw
  modified_base (147)..(147): a, c, t, g, unknown or other
  misc_feature (147)..(147): n is a, c, g, or t
  modified_base (239)..(239): a, c, t, g, unknown or other
  misc_feature (239)..(239): n is a, c, g, or t
  modified_base (664)..(664): a, c, t, g, unknown or other
  misc_feature (664)..(664): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctccaccctcctcactcactgtncagggtcttgggcccagtctgtgctgactcacgccacctcagtccgtcgtccgggaccccggcagtacgcacctatctcttacgtctggaancagtcctacaatacgtacggaaatcgtaattaagttacgttaactacggttacgaaccgacgtaacgaaaccgttaccccgaaccggtaaccccggaacccctaaaacctcctacctactaacttaaactaaaacgtaacgtacgtactacgtaaccggacccggtccccgtacggggtacccgggtccgccggtacgttaccttacgtcgttacggtacctaccggtacgtacgtcggtccgtacctacgtacccgcctaccgtccgacgtacctacgtacgggtccggtacccgtccgggtaacgacggtacgtacgtaccggtactttacgttaacgtttacgtttaacgttggttaaccgggttgggtacggtaccgtcggaccttacggaccgttcgtaacgttcgtaaccgtttccggnggttaccgcggtaacgggtcctaaacgggtccgtaacccgttccggttacgacccggtaacgccggtaaacccgccgtaaccccgcctacg

SEQ ID NO: 164128 - DNA, 762 bp, Homo sapiens
  misc_feature: GYAE6OF02IVH25.47.55.E11.1.454.CMB.1.raw
  modified_base (218)..(218): a, c, t, g, unknown or other
  misc_feature (218)..(218): n is a, c, g, or t
tcagagctcacgtacacgaccggtgctcgatttagcactcgcacgttggggtttgggggagggcttagttcagcctggggagtccctgagactctcctgtgtagtctctggaatcagtttcagtaccttctggatgcactgggtccgaccaaactccagggtaaggggctggtgtgggtctcacgtatcatcctgatggcagtgttataattatcggngactcgtgagggccattcagcatctcagagacgaacggcaagtagtatactgtaatcgtaaggtaatacgaacaaattcgtagacgtaacggtacgaccgtaagtaccggcttacggttacctaataccgtaacttttggttcggttttacgacttcggtcccgtttcgggtccggtcgggtaccttcggtcgggggacctaaccggggtaaccctcgggtactacggtccgttcctcccgttacaccggtccctaccgtaaccgaacgggtcccctaagttcccgggttccctttccccgggtcggccccgtccgtccgtacccgtacggaccgggtacgtacccgtaccggttacccgacggtaccgacgaacccggtaccgtcccggggtccccttagggggcccttcgggtacccggttcggtaaccgtaacgggttacccgttaccgttacccgttaaccggtcggtaccgttaccggtccggtaacggtccgggtacgggtccggtacgggtaccgtaacgggccggtacgtaacggg

SEQ ID NO: 164129 - DNA, 735 bp, Homo sapiens
  misc_feature: GYAE6OF02FNWN5.47.55.E11.1.454.CMB.1.raw
  modified_base (181)..(181): a, c, t, g, unknown or other
  misc_feature (181)..(181): n is a, c, g, or t
  modified_base (185)..(185): a, c, t, g, unknown or other
  misc_feature (185)..(185): n is a, c, g, or t
  modified_base (189)..(189): a, c, t, g, unknown or other
  misc_feature (189)..(189): n is a, c, g, or t
  modified_base (235)..(235): a, c, t, g, unknown or other
  misc_feature (235)..(235): n is a, c, g, or t
  modified_base (599)..(599): a, c, t, g, unknown or other
  misc_feature (599)..(599): n is a, c, g, or t
  modified_base (660)..(660): a, c, t, g, unknown or other
  misc_feature (660)..(660): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtcgtgggctgagcgtggtcgtcttacgtggtggtactttttaaaaggtgtcgngtgngtgnactagttggtagtgtgggaggatagtacaccgtcggggtcggtcgngacgtcctcgtcgtgcacgccgtccgtcgcgtcctaccgttacgtactacttacgtctcgtagtacggtcgtcggtcccggaccgacgggcgggtaccggggacggggtacgtcggtacggtcggttcgtacgaagtagttgagtagtagtaacggtaggttacggaagtacgaacgtacgttaccgtttacggtaccggttaccggtacggttaccggggtaaaccgggttccgggttaccccttaaccgtacccgtcccgttaacccggaacgtaaacgtacgttaaacgtttccggaaaggtcgaaccgtccgtaacggtaacttccttaaactaacgtaacgtaaacgtaccgttaaagngttaacgggacgaaggccccggtaagaccgtacccggtttagtaaccttgttacgtcgtanaggttaactaggtctaccggaagtcccgtaactcccgtcgcgttacggttccctttgtaccgttcggtaaccggg

SEQ ID NO: 164130 - DNA, 641 bp, Homo sapiens
  misc_feature: GYAE6OF02FQ2UN.47.55.E11.1.454.CMB.1.raw
  modified_base (208)..(208): a, c, t, g, unknown or other
  misc_feature (208)..(208): n is a, c, g, or t
  modified_base (248)..(248): a, c, t, g, unknown or other
  misc_feature (248)..(248): n is a, c, g, or t
  modified_base (323)..(323): a, c, t, g, unknown or other
  misc_feature (323)..(323): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctcggggacccccgggnagacggtcaccatctcttgttctggaagcagctccaatanacggaaatgataatgtatactggtacagcaacgtccccaacgaaccggacccccaaacgtcctacactacctaanaactaatgactcacggccggcccctcgacggggtccctacggcccgtatttccgtcgtacggcccttacctaacgtcgtcggccgtccgtacacggccctaccccgtggacccatccgaggtccgggccgtcccggggaccgtacggacgtcgggacggcgtagtacgtttaacttacgttgttagggttagggttagggacgtccgacgtcgtccgttacgtctcggtccgttacgtttcgtcgggctcgggtacgggtacctaacgggtacctcccgttcgtacggtccaaccggcccaacggcccaaccccgtcg

SEQ ID NO: 164131 - DNA, 893 bp, Homo sapiens
  misc_feature: GYAE6OF02IH1NS.47.55.E11.1.454.CMB.1.raw
  modified_base (290)..(290): a, c, t, g, unknown or other
  misc_feature (290)..(290): n is a, c, g, or t
tcagagctcacgtacacgaccggtgctcgatttagcactcgcacgttggggtttggggagagaagacaggattcaggacaatcctccagcatggccggcttccctctcctcctccaccctcctcactcactgtgcgagggtcgttgggcccagtctggtgctgactcacgcccaccctcaggcgtcgtccgggacccccggcaggacggtccacctactcttcgttgttcgtaggaagcagtcctaccaatacgtacggtaaatagaataaactgtaactactcggttancgacgactaacctacccgaagggtaacccccggaccccctaaacgtcctctaacgttcgtaccgtaagggtaaaattacgtacgaacgggtcccggtccccgtaccgggtccgggggtacccgttccggggacccttagtttccctcggttcggtacccgtaccgttaaacggtcccggttcgggtaccccgtccgttacccggacccggtacccctaaacccgggtccgtacccgttaacggtacccggttacgggtaccccgggggttccccggttacccggggacccccgggtaaagggtaacgttccgggccgggtaccggttcggttaactttaacgtttaacggttcggttacgggtttaacgggttcggggtaattccggtaccgtacgggtacccttacggtaccgttacgggtttaccgttttacccgggttccggttttacgggagtccgggtaccgggtaaacccggtacgggttacccggtaccggttaccggttaccggtacccgtaaccgggacccggtaacccggtacccctaaaccccggcgtttaccggtacccttaccggtacctttcccgttccccgtaccccg

SEQ ID NO: 164132 - DNA, 742 bp, Homo sapiens
  misc_feature: GYAE6OF02JIAN2.47.55.E11.1.454.CMB.1.raw
  modified_base (283)..(283): a, c, t, g, unknown or other
  misc_feature (283)..(283): n is a, c, g, or t
  modified_base (317)..(317): a, c, t, g, unknown or other
  misc_feature (317)..(317): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcacgccaccctcagcgtcgtcgggacccccgggcagacggtcaccatctcttgttctggaagcagcctccaatactacggaaatgaataatgtactacgtggtaaccngacaacgtcccacgaaccggcccccaaactcctnactctaataacaactgactcgaggccgtccctcggacgggtccctggcccgtatttctccgtcggctaccgagttccgtcgggcctccctcgacctcccacccgtccggcctagtccgacggtcgggccgtacccgggcccggaggtacgtgacggttccgtagttaacgtttacgttaacttggttacggttagggttacgggacgttacccggagtaacccggttcccgttacgggtaccgttacggttacccgtttaccggttacccgtttaccggggtaccggtccggttaacccggggggtaaacccgttaaccggggttaaccccggtacccggttttacccggtaaccgggttaccccggaacccggtaaccccccgggtaaacccggggtacccccctaaccccccgttaacccggg

SEQ ID NO: 164133 - DNA, 730 bp, Homo sapiens
  misc_feature: GYAE6OF02GGXOJ.47.55.E11.1.454.CMB.1.raw
  modified_base (434)..(434): a, c, t, g, unknown or other
  misc_feature (434)..(434): n is a, c, g, or t
  modified_base (633)..(633): a, c, t, g, unknown or other
  misc_feature (633)..(633): n is a, c, g, or t
  modified_base (710)..(710): a, c, t, g, unknown or other
  misc_feature (710)..(710): n is a, c, g, or t
tcagagctcacgtacacgaccggtgctcgatttagcactcgcacgttggggtttgggggccgcagccctgggattcccagcgtgttctgcttgctgactcaggactgcacgacgagagagcgtcaccagtggacgtcgtcggctgagtccgttgggttttcctggttgtcgttaccgttttaaaaggtcgtacctaggtgtaggacggtcggtcgtaggtaggtggaacggtccgggggacgtcgttacgtcgtaggcccggttagggggtactcccgaggtacgactccgtacgtggtgtacggtctacgtacggaacttcgtaacgtttcgaacgttaccttccgtaggtactgccttacgtcggtacccgacctaaccgtcgagggttacggcgtaggttggacggtcctacgaacgttgaccgtattcgnggtatccggattacgtactttaagttaaacttggtacggcgttacggtccgttaggaccgggtacgtaactcgtacggtatacctacggtcgaacgttacgaccgtaacggtagtaagttaacgtacgtagttaccggtattacccgttaaggaacttacggaactagttcggaagttaggaccttaacgaggtttacncgttactcgtacagttcttagtttccgttaggttccaggttcccgtccgtacggtcccgtacggttgttaccgggtnaacccggttacggccttacg

SEQ ID NO: 164134 - DNA, 776 bp, Homo sapiens
  misc_feature: GYAE6OF02JCSHF.47.55.E11.1.454.CMB.1.raw
  modified_base (115)..(115): a, c, t, g, unknown or other
  misc_feature (115)..(115): n is a, c, g, or t
  modified_base (141)..(141): a, c, t, g, unknown or other
  misc_feature (141)..(141): n is a, c, g, or t
  modified_base (689)..(689): a, c, t, g, unknown or other
  misc_feature (689)..(689): n is a, c, g, or t
tcagagctcacgtacacgaccggtgctcgatttagcactcgcacgttgggtttgggggccgcagccctgggattcccagctgtttctgcttgctgatcaggactgcacacagagngcctcaccagtggagtcgtgggctgngtcgttgggttttccttgttcgtcttacgtttttaaaaggtcgttccgaggttgttcggaggtggacgtaggttaggtcgggtacgggtccgggggaggtacgttaggttcgacggtccggtggggtcgtcccgtagacgtacgttctccgtggtcgtaggttctcgttaggaacttccgtagttccgtacttaccgttcgtggtactcgtcggtaacgttcggggtacccgaaccttaaacggtcggaacgggttacgggcgttacgggcggttcggtacctcgtaacgttaacgtctaaccgttccgttaggacgttcggacgtaggttaacgttaagttaaacgttagtcggtacggtacctttaccgggttaggaccggggttacctagtttaccgggactacgtacgtaccgtaccggagtaacggtaaaccgaccggtaacgtaacggtacgttaattaccgtaagtacgttaacgtaacgaagtaacgtaacctaggtactaggaacgtacgacgtaggtacgtagttagcgttaaccgtnttacgtgtttagtcgttacgtcggtcgttccggttaccgtcggtacggtacccggttggtacccgggtaacctgggtacccgttcgg

SEQ ID NO: 164135 - DNA, 657 bp, Homo sapiens
  misc_feature: GYAE6OF02FUBIZ.47.55.E11.1.454.CMB.1.raw
  modified_base (272)..(272): a, c, t, g, unknown or other
  misc_feature (272)..(272): n is a, c, g, or t
  modified_base (473)..(473): a, c, t, g, unknown or other
  misc_feature (473)..(473): n is a, c, g, or t
tcagagctcacgtacacgaccggtgctcgatttagcactcgcacgttgggttggggccgcagccctgggattcccagctgtttctgcttgctgatcaggactgcacacagagagctcaccatggagtctgggctgagctgggtttccttgttgctctttaaaggtgtccagtgtgaggtgcaggtagtggagtccgggggagcttagttcagcctggggactccctgagactctacctgtgtagtctcgtggaatcagtttcagttaccttntcggtatgctacgtcgggtacccgccaaaacgtccgaaggggttaacggggcttgggtgtcgggttcctcgaacgtactcaattccgtgacttggactaggttagtttaataaagttactcggacggtacctccggtggacggggctaagttcagcctagtccgtacaggtaacgacgaaccgagaacggtagtatacgtnttaacacgttaggaaatcgaaacattacgtagggagtacggtaccgaacgtaacgttcgggaactcggtttaactacgttacgtttagtttacgtttacggtacgttccggttacccgttcgggttccccgggtaggttccgttacgggttaccggacgttaacccggggtaccctagggtccg

SEQ ID NO: 164136 - DNA, 984 bp, Homo sapiens
  misc_feature: GYAE6OF02ITJU8.47.55.E11.1.454.CMB.1.raw
  modified_base (163)..(163): a, c, t, g, unknown or other
  misc_feature (163)..(163): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctggctgagctggtttctgtgctactttaaaggntacagtgtgaggtgctaggtagtggacgtccgggggagtcttagttcgagtccgtaggggtacgtcccgtagagtacctcgtccgtgtcggtacgtctcgtacggaattcgtaacgtttcgaacgtttaccctttcgtagggtaacttcgaccgttacggtttaccgggggtacccgtaaccccgtaaaacgtacccggttaacgggggtttaaaaccggggtgtttaccgggggttaacgggttttccggggttaccgtttaccggaaaccgggtttaactacccgttaaacgttcccgttacggtaacgttaccggggtaaccgttaagggtttaacggttttaaaacgtttaaaacgtttacgggtttaccgggtaaccgggtaaccggtttaccggggtaaccggggttacggggggggtaaccctttaggttaacccggtaacggttaacggttaacccgtttacccggtttaaaccgggaacgggtaaccggtaaaccggtaaaccgggtaacccgttaaagggttaaacgttaccggtttaacggtaacgttttaaacgggttaccggttaaacggttaacgttaaaccggtaaaacgttacgttacccggtaaggttaacccgggtaagttaaccgggaacgtttaacggtaccggttaccgtttagaaccgtttacggttaagttacgttttacgggttacgttttcggtaaccgtttccggtacccgggttttagggccccgttttaaccgggggtccctttaccggggtaccgggggttaacccggttaccgggtttacccgggtacggg

SEQ ID NO: 164137 - DNA, 718 bp, Homo sapiens
  misc_feature: GYAE6OF02FLNEI.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgcttcttttaaaaggtgtccagtgtgaggtgcaggtagtggacgtccgggggaggcgttagttcagccgtggggactcccgtgagactctcctgtgtagtctgtggaatcgtagtttacacgttaccttctggtatgacctaccgtcgggtccccgacccaaaccgttccgaagggtaacggggtctgggttggtgggttcctacgaacgttactacgtaacgtccgttagacgtggggtctaaggttagttaaagtttaaagttacgtacggtacccggtaaccgttccgggtaggggaacccggggtcgttacgttaccgaaggtcctaaacttccgtaccgtaggtaaaccgacgtaaaccggaactaaaggtacggttaactacgttagtaacgttagtaaaggaaattacgaaacatttacgagtaacggtcgtaccgaagacgtaccggactcgtacttatcgttaagttcgggtttattacggagttccgttccggttacggtacggttcgggttaccttcgggtaaccggggtccccgtaacgggtaccctgggg

SEQ ID NO: 164138 - DNA, 577 bp, Homo sapiens
  misc_feature: GYAE6OF02F1MIX.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtcccgccaaactccgaggtaagggctggtgtgggtctcacgtatcaatctgatggcagtgttaataaattatgacggactccgtgacggggccattcgagcagtctccagaacgacaacggcaaagactatactgtatcgagaaatgaaacaatctagaagtacgtacgaacgtaacgtaacggctacgttactatacgtagtttggttgttttacgagttacgtcccgttcgggttcccggtcggggttacttaccgggtacggggaccgtacggggtacccctaggg

SEQ ID NO: 164139 - DNA, 803 bp, Homo sapiens
  misc_feature: GYAE6OF02IDFIT.47.55.E11.1.454.CMB.1.raw
  modified_base (228)..(228): a, c, t, g, unknown or other
  misc_feature (228)..(228): n is a, c, g, or t
  modified_base (518)..(518): a, c, t, g, unknown or other
  misc_feature (518)..(518): n is a, c, g, or t
tcagagctcacgtacacgaccggtgctcgatttagcactcgcacgttgggtttggggcagcttcagctgtggtagagaagacaggattcaggacaatctccagcatggccggcttccctctcctcctcaccctctcactcactgtgctagggtcctggcccattctagtggtgactcacgccacctcaggccttcgtccggggacccccggtgaggtacggtccgtanacgttcctcgttacgtctcgtaggaacgctacgccgtaccaacgtacgtacggaaaggtagtagtaagttggtaggttaccgtagggttcgacgtcgtaccgtaaaccccggttcccgggaaccccggtaccccccaaaacttcccgtacgtaacttcctaaccggttaacgaaaaccgttatccggaacgtacccggttacccgtcgggtaaccggtcccgtaccgtaccgttactttccgtccgtacggtaccctacgtacggttcctaaccgtaacccgtcccgtanacccgttccccgttaccgtaccggtaccgtaacttaccgggtagggtcccgggttaccggtacccccggggttagtaacgggctagggtaaccggtacttacgggttaatttacgtacgtaggaacctacgtaacgtacggtacggtcgtaaggccgttaacgtgttacggtacggttttcgggtaccgggtttcgggaaccgttacggaaccggttaaccgtcggttacccgtagtaccgacggttaccgaccggttaacggcccgttacccgtcccgtaccgg

SEQ ID NO: 164140 - DNA, 682 bp, Homo sapiens
  misc_feature: GYAE6OF02HX45P.47.55.E11.1.454.CMB.1.raw
  modified_base (292)..(292): a, c, t, g, unknown or other
  misc_feature (292)..(292): n is a, c, g, or t
  modified_base (658)..(658): a, c, t, g, unknown or other
  misc_feature (658)..(658): n is a, c, g, or t
  modified_base (669)..(669): a, c, t, g, unknown or other
  misc_feature (669)..(669): n is a, c, g, or t
  modified_base (671)..(671): a, c, t, g, unknown or other
  misc_feature (671)..(671): n is a, c, g, or t
  modified_base (673)..(673): a, c, t, g, unknown or other
  misc_feature (673)..(673): n is a, c, g, or t
  modified_base (675)..(675): a, c, t, g, unknown or other
  misc_feature (675)..(675): n is a, c, g, or t
  modified_base (682)..(682): a, c, t, g, unknown or other
  misc_feature (682)..(682): n is a, c, g, or t
tcagagctcacgtacacgaccggtgctcgatttagcactcgcacgttgggtttggggccgcagccctgggattcccagctgtttctgcttgctgatcaggactgcacacagagagctcacatggagtctgggctgagcgttggttttccttgttgcttacgttttaaaaggtgtccagtgtgaggtgcgaggtagtggaggtccggggagcgttagttcgagccgtgggactcccgtgacgactcctccgtgttcgtagtctcgtaggtatctagtttcacgttaccttcgngacgtgaccgacggttcgggtcccgacctaacgtaccgagggtaacgggtccgacgggtacccgtggtcgacggtccgttcctccgtcgacgtccctaccgtaaccggaaccggtccctacgtccccggttcccgttcccccggcggcccgtcccgtacgtcccgtaccggacggtaccgcccgaacccgtccggaagtaccgacctacggccggtcccggcccgttcgggtccttaccggcccgttagggtaaccaacgggtttaccctacgttcccgtaaacggtgacctccggttacgcgggtaaccggtcgggtacctacgggaccgtaaccgggcctaaccgtaagtcggcagtcgaacgntgcgcgcgcgngngngngcgtgtn

SEQ ID NO: 164141 - DNA, 842 bp, Homo sapiens
  misc_feature: GYAE6OF02IRGTU.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccagtggagtcgtgggctgacgtcgttcgggtttttccttgttcgactttacgttttaaaaggtgtccaggttgtaggtaggtgcgtaaggttaggtggacgttccgggtggaggtactttagttcgacggccgttagggggacgttccccgttaggacggtaccttccgttccgtggttacgtacgttccttcgtaggtaacttcgttaacgtttcgtacgttaccgttcgtggtattcggccgtacgggtccggtcccgaacctaaaccgttccggaaggggtaacggggcgttgggtacggttcgggttacctacgtaaccggtactaccgtaacgttccgtaggtagtcggtacttaggttaacgtttaaagttaaaagtttcgtaccgggtacggtaccgttaccggggtacggggtaccggggtacccgtaacgtttcccggaaggtaccctacgtacccggttacccgaacggaaaccggtaaccggaaaccgggtacggaaacgtaagttacgttaacgttagttaaccgttacggtaagtaaacgtaacgaacgttaacgtagtaacgacgtaaggtaccggaacgtacgttacggtacgtagttacgtaattcgtaggtttcgttttaggttccgtacgttcggtttacccgtaccgggtccgtacgggttaccgttaccgggtaccgggttaccggtacccggttaccggg

SEQ ID NO: 164142 - DNA, 673 bp, Homo sapiens
  misc_feature: GYAE6OF02FN840.47.55.E11.1.454.CMB.1.raw
  modified_base (282)..(282): a, c, t, g, unknown or other
  misc_feature (282)..(282): n is a, c, g, or t
  modified_base (299)..(299): a, c, t, g, unknown or other
  misc_feature (299)..(299): n is a, c, g, or t
  modified_base (337)..(337): a, c, t, g, unknown or other
  misc_feature (337)..(337): n is a, c, g, or t
  modified_base (391)..(391): a, c, t, g, unknown or other
  misc_feature (391)..(391): n is a, c, g, or t
  modified_base (575)..(575): a, c, t, g, unknown or other
  misc_feature (575)..(575): n is a, c, g, or t
  modified_base (600)..(600): a, c, t, g, unknown or other
  misc_feature (600)..(600): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctctttaaaggtgtccagtgtgaggtgcaggtagtggaggtcgggggaggcttagttcagccgtggggacgtccctgagactctccgtgtgtagtctctggaatcagtttcagttaccttctggancgctacgtcgggtcccncctaaaccgtccgagggtaaggggctggtggtcggtcncgtacgtacgtcaactccgtagtagtcggacgtagttagtttaagtaaacgttntcggacggtacttaccggtagggaccggggtaccgtagttacgacgtacgtactaccgtccgaaggtacgaaccgaaccggacaaacgtagttacgtacgttacggtaatacgtaaagtaataacgaaatacgtacgtgaacggtacgtaacggacggtaacgtacgggtcttacggtaccttntccttagtttggtttacggtttacncgttcgggtacccgtttcgggtccggtccgggttacgttcggggtaccggtaaccggtaccgggtaccgtcgg

SEQ ID NO: 164143 - DNA, 777 bp, Homo sapiens
  misc_feature: GYAE6OF02IU8UR.47.55.E11.1.454.CMB.1.raw
  modified_base (198)..(198): a, c, t, g, unknown or other
  misc_feature (198)..(198): n is a, c, g, or t
tcagagctcacgtacacgaccggtgctcgatttagcactcgcacgttgggtttggggagagaagacaggattcaggacaatctccagcatggccggcttccctctcctcctcaccctcctcactcactgtgcgagggtcttgggcccagtctgtgctgactcacgcccaccctcagtccgtcgtcggggacccccggnaggaccggtcaccattcctacgtttcgttcgtagggaacgcacgtcctaaccaattacgtacggaaattcgtaataagttgttacgtacttacggtaaccgagaccgtaacgtaccccgaaccggaacccggaccccctaaacctcctacctacgttactaactaaactaatacgactacgacggccggtacccctacggacgggtcccgtacggccgttacgttcttacgtccggtaccgtaccgtaacggtcctcggacctccgtaccgaccgtaccctacccggtcgaccctaacgtccggtacggtccgggtcccggtcccggtaacccggaggtacgtaggtaccggtcgttaacgttagtttaccgttacggtttaggttacgggttacgggtttcgggtacgtcggtacgccgtaccgttgtaccgttcgtaccgttacggttcggtacggtacggacgttacggaaccgtaggtaccctaccggtacgtaccgggtaactacccggaaccgtaaccgtaccccgaacgtaccgttccgaccctaccgtcccgttcccgtcccccgttcccg

SEQ ID NO: 164144 - DNA, 630 bp, Homo sapiens
  misc_feature: GYAE6OF02GYLJ0.47.55.E11.1.454.CMB.1.raw
  modified_base (263)..(263): a, c, t, g, unknown or other
  misc_feature (263)..(263): n is a, c, g, or t
  modified_base (275)..(275): a, c, t, g, unknown or other
  misc_feature (275)..(275): n is a, c, g, or t
  modified_base (344)..(344): a, c, t, g, unknown or other
  misc_feature (344)..(344): n is a, c, g, or t
  modified_base (540)..(540): a, c, t, g, unknown or other
  misc_feature (540)..(540): n is a, c, g, or t
tcagagctcacgtacacgaccggtgctcgatttagcactcgcacgttgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccaggtaagggctggtgtgggtctcacgtatcaatcctgatggcagtgttataaattntgcggactccgnggagggccattcagcatctcagagacaacggacaagtagtatactgtatcgtaggaaatagaacaatcngaagagtacgaacgagtacggtctgtactatactatttcgttgttttgattcgtcccgtttcgggtcccggtcgggtacttcgggtcggggaccgaacgggtacccgtggtacgacggtccgttccttccgcgaccgtccctaccgaccgaccgggccctaggttcccgtcccctttccccgccgcccgtacccgngccctaccgacggcctcccgtacccgtccgaggaccgaccgtaaccgccggcccggtccgcgggtcctccggtccgtcggaacgtaccgg

SEQ ID NO: 164145 - DNA, 883 bp, Homo sapiens
  misc_feature: GYAE6OF02HTXTU.47.55.E11.1.454.CMB.1.raw
tcagagctcacgtacacgaccggtgctcgatttagcactcgcacgttgggtttggggccgcagccctgggattcccagctgtttctgcttgctgatcaggactgcacacagagagctcaccatggagtctggctgagcttgggttttcttgttgtcttacgttttaaaggtgtccagtgtgtaggtgcgaggtaggtggaggtccggggagtcttagttcagtccgtgggacgtccctgacgtactcctccttggtgtagtcgtcgtaggtaatacgtagttttacacgttacctttcgtaggactcgctacggtcgggtcccgtaacccaaacgtccggaggggtaacgggtcgtagggttcggtcggttctaccgtacgttataccgtaacttccgagtacgtcgggtacgttagtttaacgtttaaaagttaaagtttacggtaccggtaccggttaccgggttaccgggtaacggggaccggggttaccctagtttccgacgttacgtactacccgtaccggaaaggaccccgtaaacgggaaccgtaaacggtaaacgtaacggtttaacttacgttacggtttaacgtaaaccggttaaggtaaaacttcgggaaaacttaacgttggtaaccggaagggtccgttaaaccgggagttaacccgggtaccggttcgttaaccgttacgtacgttttaccgtttaggttttaccggttttttaccggtttccggtaaccggttttaccccgggtttccccgggttacccccgggggttttaacccgggttcccggggggtttttaacccgttccccggggggttaccccggggggttaaacccccgttaccccgggggttaccccggggtttacccgg

SEQ ID NO: 164146 - DNA, 636 bp, Homo sapiens
  misc_feature: GYAE6OF02GFIIO.47.55.E11.1.454.CMB.1.raw
  modified_base (366)..(366): a, c, t, g, unknown or other
  misc_feature (366)..(366): n is a, c, g, or t
tcagagctcacgtacacgaccggtgctcgatttagcactcgcacgttggcttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccgaggtaaggggctggtgtgggtctcacgtatcaatcctgatggctagtgttaataaattatgccggactccgtggaggggccgattcagcatctccagagacaacggcaagagtatactgtatctaggaaatgaacaatctgagagtcgaagatacggntagtctatctagttgtgttttcgatcgtccgttcggtccggcgggtacttcgtcggggccagggtaacccgtggtcgaggtccgttccgtcctcgacgtccctcccaaccgaaccggggccctacgttcccgggttccctttaccccccggtcggcccgtccccgttcgcccgtacccgacgggaccgacccgtaacccgtcccggaaggtaccgacccgaacgaccggccgggacccgttcgggcccgtcggtcccgtggtaaccccgg

SEQ ID NO: 164147 - DNA, 825 bp, Homo sapiens
  misc_feature: GYAE6OF02F78NO.47.55.E11.1.454.CMB.1.raw
  modified_base (211)..(211): a, c, t, g, unknown or other
  misc_feature (211)..(211): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttcgggccctagtctgtgctgactcagccaccctcagcgtcgtacggggacccccggnaggacggtcaccatcctcttgtctggaacgcaacgctaccaatacgtacggaaatcgaataatgtaatacgtcggtaccaagctaaacgtcccaacggaacccggacccccaaaacctccctactactacctaagtaaacctaatgaactcgaacgccgacccgtcgtacggggtccctacggccgtatttcgtccgtcggtcgtacctaagtccggtcgggccctacccgttaccgacccgacccctaccccggttcggtaccctaacgtccgtaaccgggttcggggtcccgtaccccggggacccgggtaacggtaacggtccgggtaacggggtcccttagggttaaaccgttttaccggttaaaccgttgggttttaccggggttaagggttttccgggggaaactttcccggacgtacccggtccgttagggtaacccgtttcggttaacccttaaccggtttccgggtttaccggggaaccgtacccgggtttacggggaaaccccgttaacggggttccccgaaaccccggttttcccgggttaaacggttcccggaaaccggtaaccccggaaccccggggtaaccccgtaacccccttaacggg

SEQ ID NO: 164148 - DNA, 736 bp, Homo sapiens
  misc_feature: GYAE6OF02HNYJQ.47.55.E11.1.454.CMB.1.raw
  modified_base (554)..(554): a, c, t, g, unknown or other
  misc_feature (554)..(554): n is a, c, g, or t
  modified_base (697)..(697): a, c, t, g, unknown or other
  misc_feature (697)..(697): n is a, c, g, or t
  modified_base (706)..(706): a, c, t, g, unknown or other
  misc_feature (706)..(706): n is a, c, g, or t
  modified_base (731)..(731): a, c, t, g, unknown or other
  misc_feature (731)..(731): n is a, c, g, or t
tcagagctcacgtacacgaccggtgctcgatttagcactcgcacgtagggtcttgggcccagtctgtgctgactcagccaccctcagcgtctcgggaccccgggcagacggtcaccatctcttgttctggaagcagctccaatatacggaaatgataatgtatactggtaccagcaagtcccaacgaaccggaccccaaactcctcatactaatacaatactcagtccgtcctcggtacgggtcctacggacctacttcgtccgtggtcctaccgtaaggtcgtcggctcccgtcacgccctcccgtggccatacgcggtcgggcccgtcccgggaccgtaggacgtcggaggtcctgtactttagttacgtggtttacgggtagggttcggacgtccggactccgtcctcgtaccggttcgtaccgtttaccggttccggtacggtccgtaccgggttacggggaaacccgttaacgggtcctacccggttaccgtaaacggttcccgaaacccggaccccgtaaacccgggtacccccctaaaccccggttnttacccggtacccgtaaccgtttacccgttccccggtttacccccgacccctttaccgtaccgttcggtaccacggttccgttacggtcggaccgggtccggggtaccgaccggtagaacccgggtcgaaccgtacggagtcnccgtagcgngcgaactcgcgcgttacgcgtaccnctgcg

SEQ ID NO: 164149 - DNA, 754 bp, Homo sapiens
  misc_feature: GYAE6OF02GDS1S.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggttttccttgttgcttacttttaaaaggtgtccagtgtggaggtgcaggtagtggaggtccgggggaggtcttagttcaggccgtggggacgtccctgagactctccgtgtagtagtctcgtaggtaactctagtttcacgttaccttcgtaggtatcgctacggtcgggtaccacctaaacgtaccggtaaggggtaacggggccgttggggttacggttcggggttactaccgtaacggttaactccgtaacgtccgtaggtaacgtggtaaccgtaagttacgttaaagttaaacttagtcgggaccggttaccgttccgggtacggggtaaccggggtaccgtagttacccgaggtacctaccgttaccgtaacggtaacgaaccggtaaacggaaccggaacgtaaaggtaaccgttaattaaccggttagttaacgtacggtaacggtaaaactagtaaacgtaagtacgtagaaggtacgtacgtaacgtagtaccgtgtcgtaacttagtacttacgtttcggttacagttcccgtccggttaccggccggttaccggtagttcccgggtacggtaccccggacggttaccgtggtaacccg

SEQ ID NO: 164150 - DNA, 695 bp, Homo sapiens
  misc_feature: GYAE6OF02I8STI.47.55.E11.1.454.CMB.1.raw
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtctgggcccagtctgtgctgactcagcccaccctcagtcgtcgtccgggacccccgggcaggaccggtcaccgatccttctttgttcgtagggaacgcacgtctacccgaattacgtacggaaatgaataatgtatacgtggtaccagcaacgtcccaacgaaccggacccccaactcctacatacctaataactatgactcgacggccgccctcggtaccggggtccctcggaccgtatttccgcgtcggtacctacgtaacggtcgcggccgccctacgaccgcccacccggtcggacctacgtcgtaggtccggcccgtcccgggaccggaacgggtgtcgggacggtgtacgtaacgttttaatacgttcggtagggttagggtcgggtacgtccggtacgaccggtccgtacgtcgtcgttaacgttaccggttcgtacggtaggtaccggtaaccggtaaccggttaacgggtcccgtaaccggttccgtacggtcccgaaccgtacccgaaccggtacccccgtaacccgtaaccgg

SEQ ID NO: 164151 - DNA, 731 bp, Homo sapiens
  misc_feature: GYAE6OF02JS9A1.47.55.E11.1.454.CMB.1.raw
  modified_base (194)..(194): a, c, t, g, unknown or other
  misc_feature (194)..(194): n is a, c, g, or t
  modified_base (217)..(217): a, c, t, g, unknown or other
  misc_feature (217)..(217): n is a, c, g, or t
  modified_base (304)..(304): a, c, t, g, unknown or other
  misc_feature (304)..(304): n is a, c, g, or t
  modified_base (382)..(382): a, c, t, g, unknown or other
  misc_feature (382)..(382): n is a, c, g, or t
  modified_base (390)..(390): a, c, t, g, unknown or other
  misc_feature (390)..(390): n is a, c, g, or t
  modified_base (517)..(517): a, c, t, g, unknown or other
  misc_feature (517)..(517): n is a, c, g, or t
  modified_base (527)..(527): a, c, t, g, unknown or other
  misc_feature (527)..(527): n is a, c, g, or t
  modified_base (622)..(622): a, c, t, g, unknown or other
  misc_feature (622)..(622): n is a, c, g, or t
  modified_base (709)..(709): a, c, t, g, unknown or other
  misc_feature (709)..(709): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactcgtgcgagggtcttcgggacccagttctggtgctgactcacgcccaccctnagcgtccgtcgggacccccgggnaggaccgcgtaccactcttccttcttacgttacggacgacgtactacgtacctacctaagttaacggtacgtaatacgaattaagtnttaacgtccgtacggtaacacgaccgtaactacccgaacccgtaacccgaccccctaactccgtactacgttactaanaactactnaactcgaacccggtcccgtacgtacggggtacccgttccgacgggacctttacgttccgcggtttcgaaccgtaacgttacgtcccggtccggcctacccgtcgacccgtccctaccgtcgtaaccncgttaccggnggtccggtcccgtaaccgggcgtaagcggtacgtacggtctaatttacgttcgttacgtcgggttaggttaggtaaccgtgaccgctaccgggtnacgttcgaacgtttccgtcggtacgtcggtacgtccgggaaccttccgggaaccgttccgtaccgtacgggttacgacccggtaacnccccggaacggttaccctccgg

SEQ ID NO: 164152 - DNA, 696 bp, Homo sapiens
  misc_feature: GYAE6OF02FWT1V.47.55.E11.1.454.CMB.1.raw
  modified_base (670)..(670): a, c, t, g, unknown or other
  misc_feature (670)..(670): n is a, c, g, or t
  modified_base (674)..(674): a, c, t, g, unknown or other
  misc_feature (674)..(674): n is a, c, g, or t
  modified_base (678)..(678): a, c, t, g, unknown or other
  misc_feature (678)..(678): n is a, c, g, or t
  modified_base (681)..(681): a, c, t, g, unknown or other
  misc_feature (681)..(681): n is a, c, g, or t
  modified_base (683)..(683): a, c, t, g, unknown or other
  misc_feature (683)..(683): n is a, c, g, or t
  modified_base (685)..(685): a, c, t, g, unknown or other
  misc_feature (685)..(685): n is a, c, g, or t
  modified_base (688)..(689): a, c, t, g, unknown or other
  misc_feature (688)..(689): n is a, c, g, or t
  modified_base (691)..(693): a, c, t, g, unknown or other
  misc_feature (691)..(693): n is a, c, g, or t
  modified_base (695)..(695): a, c, t, g, unknown or other
  misc_feature (695)..(695): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggttttccttgttgcttcgttttaaaaggtgtccagtgtgaggtgcaggtagtggaggtccgggggagcgttagttcagccgtgggacgtcctgagactctcctgtgtagtctctggaatctagtttcagttccttcgtaggatgcacgtcgggtccgaccaaactccgagggtaacggggaccgaacgggtaacccgtggtacacggtccgtcctcccgtcgacgtccctaccaacccggaaccgggccctacggttcccggttacccctttcccccggtcgggcccgtccctcggtcccgttcccgaaccgggtaccacccgtaccctccgggaacgtaccggaccctaccggacccggcccgggtaccccggtcgggtcctaccggcccggttacggtaccgaaaccgggttacctttacccgttacccggtaaccggttagaccggttcccgtaccggtacggggtaccgggtaccgggggtccttacggggaaccgtaaccgggggcctaacgtaggtacgngacngcgngcngngngcnncnnnanc

SEQ ID NO: 164153 - DNA, 536 bp, Homo sapiens
  misc_feature: GYAE6OF02H5N2R.47.55.E11.1.454.CMB.1.raw
  modified_base (355)..(355): a, c, t, g, unknown or other
  misc_feature (355)..(355): n is a, c, g, or t
  modified_base (404)..(404): a, c, t, g, unknown or other
  misc_feature (404)..(404): n is a, c, g, or t
  modified_base (424)..(424): a, c, t, g, unknown or other
  misc_feature (424)..(424): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgagtgcaggtagtggagtccgggggaggcttagttcagcctggggagtccctgagactctcctgtgtagtctctggaatcagtttcagtaccttctggatgcactggtccgaccaaactcgaggtaagggctggtggtggtctcacgtatcaatcctgatggcagtgttaataatntgcgactcgtgagggcatcagcatctcagagacaacgacaagagtatangtatcgagaatagaacaatngagagtcgaacgtatacggtctgtactatctatttgtttacgagttcgtccgtttcggtccggtacggtacgtttccgcggggtaccccgaacggggtaccccgtggtaccg

SEQ ID NO: 164154 - DNA, 922 bp, Homo sapiens
  misc_feature: GYAE6OF02JLWDA.47.55.E11.1.454.CMB.1.raw
  modified_base (803)..(803): a, c, t, g, unknown or other
  misc_feature (803)..(803): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctccaccctcctcactcactcgtgacgtagggtccgttcgggccctagtccttggtcggtcctcggaccttcacgccctaccctcgacgtcgttccgtccgggacccccgggcacggacggtaccaccatccgttcgttgttcgtacggaacgcgacgtcctacctaagtacgtacggtaaaacgtgtaattaagttagtaacttacttacgggtaaccgacggacctaacggtacccccaaccggtaaaccccggtacccccctaaaccttaccccgtacaacctttacctaaactaaaaccgtacgtacgtacgttacccgaaccgggttcccggtcccccgttacccgggtaaccggggttaccccccgtcgggttaccccgttaaccgttttttaccggtccgtttaccgggtacttacccggtaaaaccggtttcccggtttaaccgggcccgtaaccccggtccgtaaacccgtacccccgttacccggtacccgggaaccctcgtttaccgtaccggggttcggggcccccgttaacccggggtcccgggtaacgggtcggaccgggtaagggttccgttaacgtttaacgtttttaccggttacgtttaacgggttggttaaccgggggttgggttaacgtcccggacgtaccgggtccttaccggttacnccggtttcgttaaccgttcccgggtttaggaccggtaccgtccgggaacgttacgggtcccgttaacccgtcggttaacggtccgaacccgtaccggaaccccggtacgaacccctcgg

SEQ ID NO: 164155 - DNA, 797 bp, Homo sapiens
  misc_feature: GYAE6OF02HJOXC.47.55.E11.1.454.CMB.1.raw
  modified_base (194)..(194): a, c, t, g, unknown or other
  misc_feature (194)..(194): n is a, c, g, or t
tcagagctcacgtacacgaccggtgctcgatttagcactcgcacgttgggtttggggagagaagacaggattcaggacaatctccagcatggccggcttccctctcctcctcaccctcctcactcactgtgcagggtcttgggcccagtctgtgctgactcacgccaccctcagcgtcgtcgggacccccgggnacggacggtcaccatctcttgttctggaagcagcctccaatagtacggaaatgaataagtgttaactacgtggtaaccagacaacgtcccaacggaaccggaccccccaaactccctacacttactaataaacaatgactacgacgcggtccctacgacgggtccctggccgtattccgtctcggtcctaccgaacgtcgtggcctacccgtcaccggccctaccccgtcgggaccctaacgtaccgtaagggtccgggtacccgttaccccgggacccggtaacgggacgttacgggaacgggtccgttaggttaacgttttaaacttaccggttttagggttaacgggtttacggggtttacggggtaacgttcggtaacgtaccggtccgttaaggttccgttacgggttaccgtttaccggtttacggttccgggtacgtacccgggttcgggtaaacccgttaacgggttcccggtacccggtttaccggttaccgggttaccgacccggtaacccggaaacccgggtaccccaaaccccgttaccggttaccggtaaccttcccgtttccggtttccccggttccccccgtaccccg

SEQ ID NO: 164156 - DNA, 759 bp, Homo sapiens
  misc_feature: GYAE6OF02JWQCD.47.55.E11.1.454.CMB.1.raw
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcaggtcgttcgggcccagtctgtcgctcgactcacgccctaccctcgacgcgttccggtaccggggacccccgggcacggtaccggtccaccacttcttcgttgttcgtagggaaccgtcacgtcctactaaacgtacgtaacggtaaaatcgtaaattaagttacggtaacttaaccgttacgggttaaccgaacgtaaccgtaaccggtaacccccgaaccgggaaaccccggtaacccccctaaaccgttccctacgtaacctaactaactaaactagtacacgtacgaccggtcccgtacccgtacgggaccgggtccctcgtaccgtacttaccgtcgtcgtccctaacgtacgttcgtccgtcccgtacctaccgaccgtaccgtacccgtcgacctacgttcgacgggtccgtaccgtacccgggtacggaagtacgtcgagtcttacgtactttagtacgtggttaggtaggtacgtacgtcgacgtcgtccgtacgtcgttcgtaccgttcgtacggacgttacgcggtaaccgggaccgttgtaaccccgttcggtacccgtaggacccgtacccgtaccgaacccggtcccgtaacccgttg

SEQ ID NO: 164157 - DNA, 545 bp, Homo sapiens
  misc_feature: GYAE6OF02F2U4A.47.55.E11.1.454.CMB.1.raw
  modified_base (370)..(370): a, c, t, g, unknown or other
  misc_feature (370)..(370): n is a, c, g, or t
  modified_base (458)..(458): a, c, t, g, unknown or other
  misc_feature (458)..(458): n is a, c, g, or t
  modified_base (490)..(490): a, c, t, g, unknown or other
  misc_feature (490)..(490): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcacgtgggtcccgccaaaactccaagggtaaggggcttgggtgtggggtctcgacgtatcaattcctgatggctagtgttaataaattngcggactccgtgaggggcattccagcatctccagaagacgaacggcaagacgtatactgtaatcgtaggaaatgaacaatctagaagngtacgacgatacggctggttctatcattgttntttcggattcgtccgttcggtccgcggtacttcggacgggccgagggacctcggg

SEQ ID NO: 164158 - DNA, 689 bp, Homo sapiens
  misc_feature: GYAE6OF02JXI37.47.55.E11.1.454.CMB.1.raw
  modified_base (274)..(274): a, c, t, g, unknown or other
  misc_feature (274)..(274): n is a, c, g, or t
  modified_base (295)..(295): a, c, t, g, unknown or other
  misc_feature (295)..(295): n is a, c, g, or t
  modified_base (402)..(402): a, c, t, g, unknown or other
  misc_feature (402)..(402): n is a, c, g, or t
  modified_base (659)..(659): a, c, t, g, unknown or other
  misc_feature (659)..(659): n is a, c, g, or t
tcagagctcacgtacacgaccggtgctcgatttagcactcgcacgttgggttttccttgttgctctttaaaaggtgtccagtgtgaggtgcaggtagtggagtccgggggaggcttagttcagcctggggagtccctgagactctcctgtgtagtctctggaatcagtttcagtaccttctggatgcactgggtccgccaaactccgaggtaagggctgggtgtgggtctcacgtatcaatcctgatggcagtgttaataaatatgcgactcgngagggccatcagcatctcagngacacggcaagatatctagtatccgtagaaatcaaacgaactcgtagaaggtagtacgaagacgtacggacttcggttactaatctaagtttgttacggttttacgngttacggtccgtttccggtccggtccgggtaacgtttcgggcgggtaccgtaaccggggtaaccttcgggactagtccgttccttccgtaccgtcgacccttaccgaacccgtacgggccctaacgttcccggttacccgttcccccgtgggaccccgttcccgtcgtccccggtaccgtaagggccccgtaccgtacccttaccggggaccgaacttccgaaaccggtccggtaacccgggtccgtcggggtaccnccggtacccggtacggtacccggtaaccgg

SEQ ID NO: 164159 - DNA, 837 bp, Homo sapiens
  misc_feature: GYAE6OF02GUN3V.47.55.E11.1.454.CMB.1.raw
  modified_base (430)..(430): a, c, t, g, unknown or other
  misc_feature (430)..(430): n is a, c, g, or t
tcagagctcacgtacacgaccggtgctcgatttagcactcgcacgttgggttttccttgttgctcttttaaaaggtgtccagtgtgaggtgcaggtagtggagtccgggggaggcttagttcagcctggggagtccctgagactctcctgtgtagtctctggaatcagtttcacgtaccttctggatgcacgtgggtcccgaccaaactccgagggtaaggggcttgggtggtcgggtcctacgtactactacacttccgtagtagtcggagtagttaagttaaattaaagttacggtcggaccggtaccgtacgggtaggggaccggggtaccgttacgttacgaacgtctaccgtacctacggaagtaaccgaaccggtaacgacgaaagtacgttaacttacgttacgtacgtacgtaaacggtaanaaacggtaacaacgttacgaggaacggtacgtacggtacgtaacgtcggtcttacgtttacacgtttattacgtttacgttttcggttaacttcggtccgtttaccgggtttcccgggtaccgggtaccggtttaccggtacggggtacccggggaaccggtacggttaccggtcggtacggtccgttccgtcccttaccggtccgaccgttaccccaacgaaccgggcggtacccgttcgggttaccccttccccgggttaccgcgttaacccgtcccgtaccgtccggtaccgaccggtcccgtaacccgtcgtaccggtaaccgaccgtaccacccgggtcccggtaccccggtccgggttacggtcccgttacggccggtttaacggaccggttttaaacccg

SEQ ID NO: 164160 - DNA, 830 bp, Homo sapiens
  misc_feature: GYAE6OF02GMO7S.47.55.E11.1.454.CMB.1.raw
  modified_base (209)..(209): a, c, t, g, unknown or other
  misc_feature (209)..(209): n is a, c, g, or t
  modified_base (238)..(238): a, c, t, g, unknown or other
  misc_feature (238)..(238): n is a, c, g, or t
  modified_base (541)..(541): a, c, t, g, unknown or other
  misc_feature (541)..(541): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcacgcccaccctcagcgtctacgggacccccggnacgacggtccacctatctcttgtctggancagctacgaatagtacgaatgtaatatgtatactggtaccagcaacggtccccaacggaacccggaccccctaaactcctactactactaactaacaatgactcgagccggcccctcggtaccggggttccctggacccgtattttacgcgtacgggtccgttaacccgtaacgttccggtcgggtaccctacccttcgaacccgtcccccgtaacccgtcgggtacccctacgtcccggttaacggtcggggtcccggtaccccggggtccccgggaagggttacgtaccgggaccgggttnttacggttaaattttaaccgtttaacggttcgggtttagggttacgggggttttcggacggtttccggtaccggtcggttacccggttaacggttaccgttaccggttaccggttttaaccggtttaccccggtttacggggtaaccgtaccggggtttaaccgggggaaaccccggtttaaacggggttcccgttaaacccccgggtttacccggtttaacgggtaccccgggtaaccccgggtaacccccggaaacccggttaccccccaaacccccggtttaccgg

SEQ ID NO: 164161 - DNA, 620 bp, Homo sapiens
  misc_feature: GYAE6OF02HMNH3.47.55.E11.1.454.CMB.1.raw
  modified_base (300)..(300): a, c, t, g, unknown or other
  misc_feature (300)..(300): n is a, c, g, or t
  modified_base (361)..(361): a, c, t, g, unknown or other
  misc_feature (361)..(361): n is a, c, g, or t
  modified_base (386)..(386): a, c, t, g, unknown or other
  misc_feature (386)..(386): n is a, c, g, or t
tcagagctcacgtacacgaccggtgctcgatttagcactcgcacgttgggtttggggggaagaggaagactgacggtcctgccacaggtggtgctgggcacgggtgggcactcgacacaacatttgcgctcaactgtcttgctcaccatggagtctgggctgagctgggttttccttgtgctcttttaaaaggtgtccagtgtgaggtgcaggtagtggagtccgggggagcgttagttcagcctggggagtccgtgagactctcctgtgtagtctctggaatcagttcagtaccttcgngatgcatcgggccacaaactcgaggtaagggctggtgtgggtctcgagtagtacaagtccngactggacagtagttataaattagngtacggactcggtaggagggtctacgtcgtagacatcctacgagaacggacaacggacaaggatagtactagtatcgtaaggaaactaagaaactaacgtcgtagaaacggtacgtaaccgaacgttaagaccggttagtccggttaacgttattaccgttaagtttaccgtttttagacggtttaccgtacccggtttacccgggttaccggtacgggtaccgtttacccggg

SEQ ID NO: 164162 - DNA, 695 bp, Homo sapiens
  misc_feature: GYAE6OF02GER8I.47.55.E11.1.454.CMB.1.raw
  modified_base (240)..(240): a, c, t, g, unknown or other
  misc_feature (240)..(240): n is a, c, g, or t
tcagagctcacgtacacgaccggtgctcgatttagcactcgcacgttgggtttggggagcttcagctgtggtagagaagacaggattcaggacaatctccagcatggccggcttcccctctccctcctcaccctcctcactcactgtgcagggtcttgggcccagtctgtgctgactcagccaccctcagccgtcgtcgggaccccccggacgacggtcaccatctcttcgtctggaacncagcctaccaatagtacggaaatgaataatgtaactactggtaccagacaacgtcccaacgaaccggacccccaaactcctcactctaataacatcgactcacgccgcccgtcgaccgggtcccgtaggccgtacttcttcgtcggtcctaccgaagttccgtcggcccgtccgtaccaccgccccgacccgtcggacccgtatacccgcgggtcgggtcccgtcccgggacccggagggtacgtcgggaacggtctacggttattaacgtttacggtggtttacggttaggggttacgggtacgttccggacgtaccggtaccgttcgttaccgtcgttaccgtttacgttaccggttcgggtacgtccgggtaacgggtaacccgtaacgggtcccgtacccgttcggtaccgtccgtacccggacccgaaccggtacccctaacccgtaccg

SEQ ID NO: 164163 - DNA, 872 bp, Homo sapiens
  misc_feature: GYAE6OF02HNDYD.47.55.E11.1.454.CMB.1.raw
  modified_base (291)..(291): a, c, t, g, unknown or other
  misc_feature (291)..(291): n is a, c, g, or t
tcagagctcacgtacacgaccggtgctcgatttagcactcgcacgttgggtttgggggagccgcagccctgggattcccagctgtttctgcttgctgatcaggactgcacacagagagctcaccatggagtctggctgagcttgggtttccttgttgctctttaaaaggtgtccagtgtgaggtgcaggtagtggaggtcgggggaggtcgttagttcaggccgtggggacgtccctggacgactctaccgtgtgtacgtctctggtaatctagtttcgagttaccttcgnggtatcgctacggtcgggtccgacctaaaccgtccggtaagggtaacggggtcgttgggtacggttcgggtcctacgacggttataccgtaacgttcctaggacgtacggactaaggtttaacggtttaaattaaaacgttttagtaccgggtaccgggttaaccgttacccggggtaggggtaaaccgggggtcccgttaaagtttcccggtaagtaccgtaaaccggtttacccgttaacccgaaagggttaacccgaaacccggtaaaaccggggtaactaaaaggggtaaactttaaacgttaacccggttaagtttaaccgttaacggttaaacgggttaaaacttaacggaaaaccgtttaagttaccggtaaaggaaaggttaaccggtaaccggtaaaccgtaacggttaaccgggttaccttaacgttacgttaacgttcgttaaggttttttccggtttacggtttaaccggtacgttacccgggtttcccggtttaaccggggttcccgggtacgggtttaccccggttaccggggtaaccgggtccccggggtaaccggttaacccggg

SEQ ID NO: 164164 - DNA, 747 bp, Homo sapiens
  misc_feature: GYAE6OF02HP0FA.47.55.E11.1.454.CMB.1.raw
  modified_base (293)..(293): a, c, t, g, unknown or other
  misc_feature (293)..(293): n is a, c, g, or t
tcagagctcacgtacacgaccggtgctcgatttagcactcgcacgttgggttttccttgttgctcttttaaaaggtgtccagtgtgaggtgcaggtagtggagtccgggggaggcttagttcagcctggggagtccctgagactctcctgtgtagtctctggaatcagtttcagttacctctggatgcactgggtccgaccaaactccgaggtaagggctgggtgtggtctcgacgtatacgaatcctgatggcagtgttaataatatgacgactcgtgagggccgattcgancatctaccaagacgacgaacggcaagtaagtataacgtgtatacgtagtaaagtgtaaactaagtctaggtacgagtacgaacgagttacggtctggttactagtctagtttagtttcgtttacgaacgttcgtacccggtttccggtaccggtacgggttaccgtttcgggtcgggacccggtaacgggaaacccgttgggttaccaacggtccgttacgttcccgtaccgtaccgttaccccgtacccgtaaccgtaaacccgggtaccctaaccggttccccggttccccgtttacccccggtccgggttacccgttccccgttcggtaccctacccgggaacgtaccgaccgtaccccggttacggaaccggcggtacccgaaccggtaaccggcccgggtcccggttacgggccgttcccgggaccgttaccgggaccgtaaacccggg

SEQ ID NO: 164165 - DNA, 589 bp, Homo sapiens
  misc_feature: GYAE6OF02GBIC7.47.55.E11.1.454.CMB.1.raw
  modified_base (205)..(205): a, c, t, g, unknown or other
  misc_feature (205)..(205): n is a, c, g, or t
  modified_base (230)..(230): a, c, t, g, unknown or other
  misc_feature (230)..(230): n is a, c, g, or t
  modified_base (253)..(253): a, c, t, g, unknown or other
  misc_feature (253)..(253): n is a, c, g, or t
  modified_base (265)..(265): a, c, t, g, unknown or other
  misc_feature (265)..(265): n is a, c, g, or t
  modified_base (362)..(362): a, c, t, g, unknown or other
  misc_feature (362)..(362): n is a, c, g, or t
  modified_base (379)..(379): a, c, t, g, unknown or other
  misc_feature (379)..(379): n is a, c, g, or t
  modified_base (465)..(465): a, c, t, g, unknown or other
  misc_feature (465)..(465): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccggnagacgtcaccatctctgtctggaancagctcaatgtacgaatgatatntatactgtacancaacgtcccaagaaccgaccccaaactccacatctaataacaatgatcagccgcctagacgggtcctggcctattctctggcctactagtctggccncctcgacgccctaccgnggcctagtcacggtcgggccgtcccgggaccgagggatcggaggtccgtagtactttataccgttgtggttagggtcggattccgngtacgtccgtagcgtacgtcgttacgttcgtacgggacgtccggtaagggaccctaagggtacccctaaccggttaccgtagggttaccaaccgggtacccgaacggccccctaacccgtaccg

SEQ ID NO: 164166 - DNA, 715 bp, Homo sapiens
  misc_feature: GYAE6OF02JASCZ.47.55.E11.1.454.CMB.1.raw
  modified_base (568)..(568): a, c, t, g, unknown or other
  misc_feature (568)..(568): n is a, c, g, or t
  modified_base (681)..(681): a, c, t, g, unknown or other
  misc_feature (681)..(681): n is a, c, g, or t
tcagagctcacgtacacgaccggtgctcgatttagcactcgcacgttgggtttggggcccgcagccctgggattcccagctgtttctgcttgctgatcaggactgcacacagagagctcaccagtggagtctgggctgagcgttgggttttccttgttcgcttacgttttaaaaggtgtcctaggtgtgaggtgtcgaggttaggtggaggtccgggggagtcttaggttcagccgtagggacgtcccgtgacgtactctccgtgttgtacgtctctagggaattcgtacggtttcacggttaccttcgtggatgccgagtcggcccgtaccaaacgtccgtagggtaacggtctaggtgtacggtcctacgtacgtatacaatccgtacgagtagaccgtagttagttaaactaaagtttcgacggtacggtacctttaccggtagggtaccgggtaccctagtttaccaggtacctacgtaccgtaaccgaagggtaaccgaaccgaacgacgaaacgtacggttaatacggtagtaaacctttggaaacggtaaataggaaaacnccgttagaggtaaccgtagaaccgtaaccgagtaccgtaacgttactacgtaattcttacgtttacttcgtacgtaccttcgggttaacccgtccgtacgttaccgttccggngggtaacccgtacgggtaacccgttggtaacccg

SEQ ID NO: 164167 - DNA, 686 bp, Homo sapiens
  misc_feature: GYAE6OF02FFMU5.47.55.E11.1.454.CMB.1.raw
  modified_base (198)..(198): a, c, t, g, unknown or other
  misc_feature (198)..(198): n is a, c, g, or t
  modified_base (264)..(264): a, c, t, g, unknown or other
  misc_feature (264)..(264): n is a, c, g, or t
  modified_base (304)..(304): a, c, t, g, unknown or other
  misc_feature (304)..(304): n is a, c, g, or t
tcagagctcacgtacacgaccggtgctcgatttagcactcgcacgttgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccnccaaactccaggtaagggctggtgtggtctcacgtatcaatcctagatggcagtgttaataaattntgcggtactccgtgaggggccattcagctatcctccaganaccgaacggacaaagagtaatactgtaactcgtaggaaaatagaaaccaattcgtagaacggagtaccgaacgtagtacggtctagtctaatctatttggtttagttttcgattcgtaccgttcgggtaccgacgggtacctttcggacggggtacccgaacggggtaacccgtggtacgacgtccgttctccctacgacgtcccctacgaacccgaacgggtccctaacgtcccggttacccttacccccggtggaccccgtccctcgtacccgtccgaaccggaccgacccaacccggtcccgaacggacgtacccgaaccgcgggacccgggtacccgaccgggtcctaccggacccgttacgggacccgtaaacccgg

SEQ ID NO: 164168 - DNA, 589 bp, Homo sapiens
  misc_feature: GYAE6OF02GA7P0.47.55.E11.1.454.CMB.1.raw
  modified_base (528)..(528): a, c, t, g, unknown or other
  misc_feature (528)..(528): n is a, c, g, or t
  modified_base (569)..(570): a, c, t, g, unknown or other
  misc_feature (569)..(570): n is a, c, g, or t
  modified_base (572)..(572): a, c, t, g, unknown or other
  misc_feature (572)..(572): n is a, c, g, or t
  modified_base (574)..(574): a, c, t, g, unknown or other
  misc_feature (574)..(574): n is a, c, g, or t
  modified_base (578)..(589): a, c, t, g, unknown or other
  misc_feature (578)..(589): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggagtccgggggagcttagttcagccgtggggacgtccctgagactctcctgtgtagtctctggaatcagtttcacgttaccttctggatgcacgtcgggtcccaccaaaacctccgaagggtaacggggccgaacgggtaaccctggtcacgcgttcctcctcacgcctaccaccgaacgggcccagtccggtccttcccccgtggcccgcccgtcgtccgtaccgacgggtacgcccaacccgtcccggaagacgccgaacgaccggcccgggtaccctggggcctcggtcccgtagggtaccaaacggtccttaacgtttccgaacgtcgancttcgtaggacggcggtacgtggaccaaggccagtaagtgnngntnagtnnnnnnnnnnnn

SEQ ID NO: 164169 - DNA, 778 bp, Homo sapiens
  misc_feature: GYAE6OF02G23FF.47.55.E11.1.454.CMB.1.raw
  modified_base (290)..(290): a, c, t, g, unknown or other
  misc_feature (290)..(290): n is a, c, g, or t
  modified_base (747)..(747): a, c, t, g, unknown or other
  misc_feature (747)..(747): n is a, c, g, or t
  modified_base (777)..(777): a, c, t, g, unknown or other
  misc_feature (777)..(777): n is a, c, g, or t
tcagagctcacgtacacgaccggtgctcgatttagcactcgcacgtagggtcttgggcccagtctgtgctgactcagccaccctcagcgtctgggaccccgggcagacggtcaccatctcttgttctggaagcagctccaatatcggaaatgataatgtatactggtaccagcaagtcccacgaacggccccaaactcctcatctaataacaatgatcagccggccctcgacggggtccctggccgtattctcgtcggctccaagttctcggccgcctcacgcccaccgnggccatcaggtcgggtccgtcccgggcccgaggtacgtaggacggtccttaggtatttacgttacgtggttcggttaagggggtttgggacgttccggacgtaccggtacccttacgggtaccttacgggtaccttttaaccggttccggtttaacggggaccgttccgggttaccggggaaacccgttaaacgggttccccgtaacccgggttcccggttaacggggtacccgaaccggtaacccccggaaacccggtaccccctaaacccccgtaccgttcgtaaccccttacccgttccgttacccgtttccccccgtaacccttcccgttaccgtttacccggtacggtccgttaccccgttacggttacggtcccggggtccgggttaccggttaccgggtaacggaacccgggtaccgtacgtaaacggtcgaccgtcgacggtccgtacncgtacgtcgtacgtcgccgtcgtctctacnc

SEQ ID NO: 164170 - DNA, 918 bp, Homo sapiens
  misc_feature: GYAE6OF02IGGGN.47.55.E11.1.454.CMB.1.raw
  modified_base (209)..(209): a, c, t, g, unknown or other
  misc_feature (209)..(209): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttcgggccagtctgtgctgactcagcccaccctcagccgtcgtcgggacccccggnacggaccggtaccaccattccttcgtttgttaccgtagggaaacgtcaacgtcctaccaaataacgtaacgggtaaaattgaaattaaagttaggttaacttaaccgttacgggttaacccgaacgaccgtaaaacggttaccccccgaaacccgggtaaaaccccggaacccccccctaaaaaccgttcccctaacctaaccgttaaccttaacttaaaaccaaacttacggaactaccgaacggtacccccgggtaccccgttaaccggggtaaccgggggttccccgtaccgggtaacccggttaacttttacccgtcggtacgggtaccctaaccggtaaagttccgtaccgggtacccgtccctaccgaaccgtacccccaccccgttacgggaccctaaacgtcccggaacgggttccgggggaccccgttaccccggggaccccgggaacgggtaccgttaacggggtaccggttacgttaacggttaattttaaccggttaaaccggttcgggtttaacgggttacggggtttacgggaaccgttaccgaaccgtacggttacccgttacgtacggttaccgttaccgttaccggttaccgttacggggacgtacgggtaccggaacccggtaaggtccccttaaccggttaccctacgggtaccacccggacccgtaaaccggccccctaaaccggtccg

SEQ ID NO: 164171 - DNA, 694 bp, Homo sapiens
  misc_feature: GYAE6OF02II3OJ.47.55.E11.1.454.CMB.1.raw
  modified_base (214)..(214): a, c, t, g, unknown or other
  misc_feature (214)..(214): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcacgcccaccctcacgccgtcgtacggggacccccgggnacggacggtccaccatctcttgttctggaagcagcctacaatatacggaaatgaataatgtatactggtaccagcaacgtcccaacggaaccgaccccaaactccgtactactacctaataaactaatcgaactcgacggccggtccgtacgtacggggtccctaggccgtactttcgtaccgtcggacctccgtaagtcgtcggccgtccgtacgacccgcccgtaacccgtcggaccctacgtaccgtacggtccggtccgtacccgggccggaacggacgtcggacgtcgttagtaactttacgtacgttgtacgggttacgggtacggtacgtcggtacgtacggtccgacgtaccgttaggtccgttacgttccgttacggtacggtccggtccgggtaaccgtacgggttaccgtaccggttaccgtacgggtacctaccggacccggtaacgtaccccgtaacccgtacccgg

SEQ ID NO: 164172 - DNA, 837 bp, Homo sapiens
  misc_feature: GYAE6OF02HMHGP.47.55.E11.1.454.CMB.1.raw
  modified_base (164)..(164): a, c, t, g, unknown or other
  misc_feature (164)..(164): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctggctgagtctggttttctgtgctatttaaaggntcagtgtgaggtgcgtaggtagtggtacggtccgggggagtcgttaagttcgaacgtccgtgggggacgttcccgagtacgtaccttcgttacccgttaggttaggttacgttcgttaccgttagggtaaacttcgtaggttttaccgaagtttaccccgtttctagggaacgtacgtcgtaccggtccgggttacccgacccgtaaaacggtccccgtaagggttaacggggtcctttagggtcggtcggttcctacgtacgtaactcgtaacgtcctaggagttcggactagttagttaaataagttgacgttcggacgtacgtggacggggacttcttacgagtactacgtccgtaccgaaagaaccgaaccggtaaaccggtaacgtaacgtaacggttaactaccggttagtttaacgtaacgttaacggtaaaaggtaacctaaagtaacccgttaggtaaccggtaacgggttacctaaccgggttacggtaaccgttaacgtacgttacggttaacgtacgtttcgtacgttttcgggtttttaccgtttacgtaccgggttaccgttacccggggtttcccgggtaacccggttaccggggtttacccttccggggggtaacccggttaccccgggtaaccggggtaccccgtttaacccgggg

SEQ ID NO: 164173 - DNA, 741 bp, Homo sapiens
  misc_feature: GYAE6OF02FGK7T.47.55.E11.1.454.CMB.1.raw
  modified_base (179)..(179): a, c, t, g, unknown or other
  misc_feature (179)..(179): n is a, c, g, or t
  modified_base (217)..(217): a, c, t, g, unknown or other
  misc_feature (217)..(217): n is a, c, g, or t
  modified_base (249)..(249): a, c, t, g, unknown or other
  misc_feature (249)..(249): n is a, c, g, or t
tcagagctcacgtacacgaccggtgctcgatttagcactcgcacgttgggtttgggggggggaagctcagcttcagctgtggtagagaagacaggattcaggacaatctccagcatggccggcttccctctcctcctcaccctcctcactcactgtgcaggtcttgggcccagtctgtnctgactcagccacctcagtcgtctcggggacccccggnacggtacgtcaccagtctcttgttcgtaggancagtccacaatacgtacggtaaatcgaataaacgttcgttagtactacgggttaccaggtactaaccggttaccccaaccggaaaccccggtacccccctaaaacttccctaaccaacgttaactaacgtaaacctaagtacgtaactaccgaacggtcccggacccttaccggaacggggtcccctcggtacccggtatttccgtacgtcggacccttaccgaacgttcgaccggtccaccgttccgaccgcccgaccgtccgaccgtacttacggacgggtccgggtccgtacccggacggtacggagtacggtcgggtccttaagtttagttacgttacgttgttagggtacgggtttcgtacgtcgaccgttaacgtccgtagtaccgtacgttccgtttacgtcgtttaccgggactccgggtacggtaaccgttaacggtacccgttccggtaacgttcgggaccctacggtaccccgtaaacccg

SEQ ID NO: 164174 - DNA, 646 bp, Homo sapiens
  misc_feature: GYAE6OF02IHOCG.47.55.E11.1.454.CMB.1.raw
  modified_base (534)..(534): a, c, t, g, unknown or other
  misc_feature (534)..(534): n is a, c, g, or t
tcagagctcacgtacacgaccggtgctcgatttagcactcgcacgttgggtttggggggaagaggaagactgacggtcctgccacaggtggtgctgggcacggtgggcaatcgacacaacatttgcgctcaactgtcttgctcaccatggagtcgtgggctgagtcgttgggtttttccttggttgtcttacgtttttaaaaggtcgtcctagtgtgtaggtgcgtagggtgtggacggtccggggaggtacttgtcacggtcggtgggacgtccgtgacgtcctctccgtgtgtcgttctcgtggactcgtagtttcacgttacttcgtggtatcgacgtacgtcgggtcccgacctaacgtcggagggtaagggtccgtggtggttcggtctcgtagtactctacgtcgtagagtcgactaggtatttaataattgtacgcggtaaccgtcgggtagggtacgggtcctacgtcgtaaggctacgttcaaccgaggaacgacgaacgactaacgtagttactagtactacgngtaagtaacgtactaacgtatcgtaggtagcggtacgtacgtacggtcgtagtcgtctatcgttgttacgttgttacgtcgttccgtaccgtttcggccggttaggtcccgg

SEQ ID NO: 164175 - DNA, 683 bp, Homo sapiens
  misc_feature: GYAE6OF02JX4AU.47.55.E11.1.454.CMB.1.raw
  modified_base (267)..(267): a, c, t, g, unknown or other
  misc_feature (267)..(267): n is a, c, g, or t
  modified_base (291)..(291): a, c, t, g, unknown or other
  misc_feature (291)..(291): n is a, c, g, or t
  modified_base (472)..(472): a, c, t, g, unknown or other
  misc_feature (472)..(472): n is a, c, g, or t
tcagagctcacgtacacgaccggtgctcgatttagcactcgcacgttgggttttccttgttgctcttttaaaaggtgtccagtgtgaggtgcaggtagtggagtccgggggaggcttagttcagcctggggagtccctgagactctcctgtgtagtctctggaatcagtttcagtaccttctggatgcacgtcgggtccgccaaactccagggtaaggggctgggtgtgggtctcgacgtatcaatcctgatggcagtgttataatngcggactcgtgagggccgatcagntactctccagagaccgaacggcaagagttaatactggtaatcgtaggaaatagaacatcgtagagacgtcgacagtacgctgtctatctagtttgttcgttttgatcgtcgtttccggacgtcggtcgttcggtcggggtccgtacgggtacccgtggtcgtacggtccgttccgttcccncgtaacccgtccctaccgacccggtaccgggacccgtcggttccccggttacccttccccccgggtacggtccccgttcccgttccgcccgtaccggtacggtccccgtaccgtcccgtaaccggaccggtacccgaccggtaccggtacccggtccgggtaccccggttcgggcccgtccggtaccggtacccgggttaacggtaacccg

SEQ ID NO: 164176 - DNA, 670 bp, Homo sapiens
  misc_feature: GYAE6OF02H62FX.47.55.E11.1.454.CMB.1.raw
  modified_base (234)..(234): a, c, t, g, unknown or other
  misc_feature (234)..(234): n is a, c, g, or t
tcagagctcacgtacacgaccggtgctcgatttagcactcgcacgttggggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctcgggaccccggcagacggtcacatctcttgttctaggaancgagctacaatatcggaaatgataatgtaatacgtgtaccagacaactccaacggaaccgcccccaaactcccgtacacttctaataacaatgactcacggccggcctacgacggggttcctcggacccgtattctcgtcggacctaccaaggttccgtaggacccgtccctacgtaccgacccgtacccgtcgggaccctacgtcgtaacgggtcgggacccggttcccgggacccgggaacggtacggtacgacggtccgttacgtaatttaccgttcgtggttacggttaggggttacggcgtcgtcgaacgtcccgtagtacttcgtaagtttcccgtacggttcggtacgtcggtaccggggtaactaacgggttcccacccggttcgtaccggtccgtaaccgaccccgaacgaccccaacccgtacccg

SEQ ID NO: 164177 - DNA, 841 bp, Homo sapiens
  misc_feature: GYAE6OF02JYXWP.47.55.E11.1.454.CMB.1.raw
  modified_base (186)..(186): a, c, t, g, unknown or other
  misc_feature (186)..(186): n is a, c, g, or t
  modified_base (208)..(208): a, c, t, g, unknown or other
  misc_feature (208)..(208): n is a, c, g, or t
  modified_base (242)..(242): a, c, t, g, unknown or other
  misc_feature (242)..(242): n is a, c, g, or t
  modified_base (817)..(817): a, c, t, g, unknown or other
  misc_feature (817)..(817): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctnagcgtcgtcggggacccccggnacggacgtcaccattcgtcttagttcagggaacncgacgtcctacaagtacgtaacgggaattgtaataagttagtaacgttaccttagggaccaaggtaccaaccggtaccccgaaacccggaaccccggaccccctaaaactccctactaacgttacctaactaaacggtaactacgataccgacgtcccggtacccctagggtacccggggttccctaggacccttacgttttcggtaccgtacgggtacccctacccggttaagtcccggttgggggccctacccgtacgtaaccccgggtcccctaacccgggtcggtacccaacggtttacggtaacggggttcccggggtaccccgttaccccgggggtaaccccgaagggtccgttaacggggaccggttacgtttaacgtacgttttaaaccgttgggtacggtttacggggtttaacgggttgggacccgtagtcccggaacccgttaccgtggttaacccgttacggtttacccgttacgggtttccccgggtagtaccgggtacgttaaccgggtaacccggtaagtccccggtaacccgtttcggacgttacccgacggaaccccnccgggtaacccctacccggttacg

SEQ ID NO: 164178 - DNA, 798 bp, Homo sapiens
  misc_feature: GYAE6OF02FQ5CA.47.55.E11.1.454.CMB.1.raw
  modified_base (186)..(186): a, c, t, g, unknown or other
  misc_feature (186)..(186): n is a, c, g, or t
  modified_base (207)..(207): a, c, t, g, unknown or other
  misc_feature (207)..(207): n is a, c, g, or t
  modified_base (229)..(229): a, c, t, g, unknown or other
  misc_feature (229)..(229): n is a, c, g, or t
tcagagctcacgtacacgaccggtgctcgatttagcactcgcacgttgggtttggggcagcttcagctgtggtagagaagacaggattcaggacaatctccagcatggccggcttccctctcctcctcaccctcctcactcactgtgcaggtcttgggcccagtctgtgctgactcagccaccctnagcgtcgtcgggaccccgggnagacggtcacatctcttgttcnggagcagcctacaatatacggaaatgtaataagttgtattacgtggtacccagtactaaccgtcccgaaccgaacccggaccccccaaacttccctacgtaacttacgtaactaaacgtacgtacgtactccgaacggtccggtacccgttacggaaccgggggtccctaggggtaccctatttccgtcggtacgggtccctaaccgaggtttccgacggggtcccgacccgttaccgaccgacccgtaccccgtttcgggaccctaacgtccggtacgggtccggggtacccgtcccccggggtaccgggtaacgggtacgttacgggaccggttaccgtttaagggtaaccttttaaccgttacgggtttcggttagggggtttaacggtttaaggggccttaccgggtcctaacgggttccgtaaccggttctaccgggtttacccgttaccggtttcgggttaccgggacgttcgggaaccgggtaaccggttaaccgggtcccggtacgtttacccggtacggtaccgtaccccggacccgtaacccggaccccgtaaaccccg

SEQ ID NO: 164179 - DNA, 907 bp, Homo sapiens
  misc_feature: GYAE6OF02H5UG6.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccagtggagtctggcctagagtcgtttggttttccttgttcgtcttacgttttaaaaggtctccgtaaggtgtcggaggtgacgtaaggtagtgggaacgggtccggggtaggtcgttacgttcgacggtccggtggggtaccgttccgtgacgtaccttctccggttgttacgtacgtccgtcgtaaggtacgttacttacgttacgtaacgttaccgttgtacggatcgtaccgtaccggtacggtaaccccgtaacctaaccggtccggttaacgggggttacgggtccgtttggggttacggttcgggttacctacgttaaccgtagtaccttaacgtcccgttaggcggttacggattagggttaaacgttttaaagtaaacggttttcgaccgggttacccgtacggttccggggttaacgggtaaccggggtacttaaggttacctacgaccgttaccgtccgtaaccgaccggaaacggtaaccggtaaacgaagttaaacgtaacgtaccgttttaaacgtaccggttaacgttaacggtaaacggtaaacgtaacgttaaaccgttacggtaacgttaaggaaacgtttaccgggtaaaccgtacgttacggtaaccgggtttctaccgggttaaacttcgtttaacgttacgtttttaccggttacggtttaacgttcccggtttcccggttaacccggtttaccgggttacccgggttacggtttcccggttaccgggtacccgggtacccggtttaaccggcccggtttacggg

SEQ ID NO: 164180 - DNA, 834 bp, Homo sapiens
  misc_feature: GYAE6OF02JPSHM.47.55.E11.1.454.CMB.1.raw
  modified_base (131)..(131): a, c, t, g, unknown or other
  misc_feature (131)..(131): n is a, c, g, or t
  modified_base (689)..(689): a, c, t, g, unknown or other
  misc_feature (689)..(689): n is a, c, g, or t
tcagagctcacgtacacgaccggtgctcgatttagcactcgcacgttgggttgggggccgcagccctgggattcccagctgtttctgcttgctgatcaggactgcacacagagagctcaccatcggagtcngggctgagcgttggtttccttgtgtctacttttaaaggtgtccaggttgtgaggtgcgaggtagtggaggtccggggaggtcttacgttcgaggtccgtggggtacgtcccgtaggtaacgtccttccgtccttggttgtacgtcttcgtagtaactctagtttacgtacgttaccttcgtaggtagtcgtcgtacggtacggtacccgtaccgaaaccgtaccggaggggttaacggggcgttacgggtaggttcgggttccgttaccgtaacgtacttacgtaacgttccggtagacgttaccgggtaccgttaagttaggtttaaattaaacggtttgtacggtaccgtaccgtacgggtaggggtaacccgggtaccgtacgttacgacgttaccaacggttacccacggtaaagggaacccgtaacgggaaaccggtaagtaccggttagtaaacgtagttaacgttgttaacccgtaaaggtaaacctagtaaacctttagggtacgaaggtaaccgggtacctaacggtaacggttaacgtaacccgggtntttaccggaactttaacgttccggtttaaggttttcgtttaaccgggaactttcccggggttaaccgttcccggggtcgttaacccgttcgggtttacccggggcggtttaacccccggaggtttacccggtggttaaccccggg

SEQ ID NO: 164181 - DNA, 662 bp, Homo sapiens
  misc_feature: GYAE6OF02IG3D6.47.55.E11.1.454.CMB.1.raw
  modified_base (115)..(115): a, c, t, g, unknown or other
  misc_feature (115)..(115): n is a, c, g, or t
  modified_base (171)..(171): a, c, t, g, unknown or other
  misc_feature (171)..(171): n is a, c, g, or t
  modified_base (189)..(189): a, c, t, g, unknown or other
  misc_feature (189)..(189): n is a, c, g, or t
  modified_base (255)..(255): a, c, t, g, unknown or other
  misc_feature (255)..(255): n is a, c, g, or t
  modified_base (262)..(262): a, c, t, g, unknown or other
  misc_feature (262)..(262): n is a, c, g, or t
  modified_base (267)..(267): a, c, t, g, unknown or other
  misc_feature (267)..(267): n is a, c, g, or t
  modified_base (322)..(322): a, c, t, g, unknown or other
  misc_feature (322)..(322): n is a, c, g, or t
  modified_base (351)..(351): a, c, t, g, unknown or other
  misc_feature (351)..(351): n is a, c, g, or t
  modified_base (366)..(366): a, c, t, g, unknown or other
  misc_feature (366)..(366): n is a, c, g, or t
  modified_base (404)..(404): a, c, t, g, unknown or other
  misc_feature (404)..(404): n is a, c, g, or t
  modified_base (438)..(438): a, c, t, g, unknown or other
  misc_feature (438)..(438): n is a, c, g, or t
  modified_base (459)..(459): a, c, t, g, unknown or other
  misc_feature (459)..(459): n is a, c, g, or t
  modified_base (495)..(495): a, c, t, g, unknown or other
  misc_feature (495)..(495): n is a, c, g, or t
tcagagctcacgtacacgaccggtgctcgatttagcactcgcacgttgggtttgggggccgcagccctgggattcccagctgtttctgcttgctgatcaggctgcacacgagagngctcacagtggagtcgtggctgagtcgttggtttctgtgcttagtttaaagtgtcngtgtgagtcgagaggtgnggacggtccggggagtcttagttcacgtcgtagggtctccgtgacgtctctcgtgtagttgtctgngtaactnagttntacgtcttgacggattggcctacggttggccaaccaacgttcggaaggggtcggngtggttaaggtcggtcctacgtacgttanacgtaactcgtaagngttcgacgtagtactaagtaacgtcgcggtacgtccgnggttacggaggtcctatacgtgacctaggttccncgaaaggacgttaccggaaanaccgtaaagtacgtataccgtagtaatcggttaaanaacggttcaaagtccggttaagtggaaacgtcggtaacgaccggtagtacggtaccttagtacgtatttcgtatttcggggttaacttaacggtcggttcttacccggttcgggtccgttacgggttaaccttcgggggaccccgtaacggttcggacccggttcgg

SEQ ID NO: 164182 - DNA, 828 bp, Homo sapiens
  misc_feature: GYAE6OF02JDJZ3.47.55.E11.1.454.CMB.1.raw
tcagagctcacgtacacgaccggtgctcgatttagcactcgcacgttgggtttggggagccgcagccctgggattcccagctgtttctgcttgctgatcaggactgcacacagagagctcaccatggagtctgggctgagctgggttttccttgttgctacttttaaaaggtgtccagtgtgaggtgcgaggtagttggaggtccgggggaggtcttagttcagccgtggggagtccccgtgacgacttcctccttgtgtagtcctctaggtaatcgtagtttcgtaacgttaccgttcttggattgacctacgttcgggtacccgaccctaaaaccgtccggtaagggtaagggtccgttgggttcggtcgggttcctacgtaaccgttagttacctaacgttccgtagtacgttcggtacgtaaggtttagtttaaacttaaaagttttcgtaggtaccggtaaccgttccgggttaggggtaacccgggggtccgttaacgtttaccgaacgtacccgtaacgtttacccgtcggtaaacggtaaacgggtaaacccgaaaccgggtaacgaaaacgggtaaccgtttaaacgtttaccgttaaggtttaacgttaacccgtttaaggaaaacttaaggaaaacctaacggttaccgaagggtaccgtaacgggtaacgaaccggttaagtaccggtcgttaacgttacttacgttacttagtttcgggttttcgttttaccgtacggtttccggtcccgttttacgggtcccgggtaacgttccggttaccgggttccgggtacccggtaccggttaacccggg

SEQ ID NO: 164183 - DNA, 716 bp, Homo sapiens
  misc_feature: GYAE6OF02F6Y2V.47.55.E11.1.454.CMB.1.raw
tcagagctcacgtacacgaccggtgctcgatttagcactcgcacgttgggttttccttgttgctcttttaaaaggtgtccagtgtgaggtgcaggtagtggaggtccgggggaggcttagttcagcctggggacgtccctgagactctcctgtgtagtctctggaatcagtttcagttaccttctggatgcacgtgggtcccaccaaactccgagggtaagggctggtgtgggtctcacgtatacaatcctgatggctagttagttaataaagttagtcggaccggtacctaccggtgggacgggggtcctagttcgagactactcctaccgagaacgaacgaacggacaagtagtaactacgtgtactcgtaagtaaatacgaaacatggtagacgacggtacgaacgtagtacggtactgttacttagtacttagtttcgtttacgttttcggacgttcggtacccgtttacggggtccgggtaccgggttcgttcgggtcgggtaccggaacgggtacccgtggtaccgcgtcctcctcgcgccgccctaccgaccggaccggccgtaccgtccggttcccctcccggcgccccgtcctcgaccgtaccgacggaccgtacccgaccgtccggaaacgtccgacccggtaccgacccgggtcccggtccggtcgggtacccgtcggtacccggttacggaaccgttaacccgg

SEQ ID NO: 164184 - DNA, 754 bp, Homo sapiens
  misc_feature: GYAE6OF02FJKZV.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggttttccttgttgctacttttaaaaggtgtccagtgtgaggtgcaggtagtggaggtccgggggagtcttagttcagccgtggggacgtccctgacgacttctccgtgtgtacgtctcgtaggtaactcgtaggttttaccaggttacctttcgtggtaactcgaccgtcggttacgggtacccctaccctaaaacgtcccgaagggggtaacgggtccgttgggtggtcgggttctactacggtatacgaacttccgttagacgttcggaccttaaggttacttttaaaagttaaacgtttcggtacgggtaccggggttaaaccttcccggggttaaggggaccggggggttacccgtaaacgtttccggaacgttacctacgttacccgttaacggaaacggtacggaaacccggaacgtaccgaaagttacgtaacgttatagttactacgaaggtaaactacgaaactattccgaagtaacgtacgtacggacgttaacgtcgggtcttcgtaccttatacgttagttcggttagttttccgattcccggttcgttcccgggtacgtcggttacttccgggacgggaccgtacgggtaccctcgg

SEQ ID NO: 164185 - DNA, 711 bp, Homo sapiens
  misc_feature: GYAE6OF02GOTMG.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggttttccttgttgcttacttttaaaaggtcgtccagtgtgaggtgcgaggtagtggaggtccgggggaggtcttagttcagccgtggggacgtcctgacgtacttctcctgtgtacgtctcgtagaatctagtttcagttaccttagtggactgctacgtacggtacccgacctaacgtccgaaggggtaagggcgtgggttgtcgggtctacgacgttatactaacttcctaggtacgtggacgtagttaagttaacgttaaagttacgtacggccggtacgttccgggtagggacggggtcctagttaccgagacgtacttacctacggaaggaacgaaccgaaacggacgtaaaggttaagtacttacgttagttaacgtacgttaaaggtaaactacgaaacttagtacgtaggaagtaccggtacgaacgtacgttaacggcttaggttactaagtgttagtttaggtttacggtttacgtaccgtacggttcccgggttacggtccggttcgggttaaccgttccggggtaccggaccgggttaacccggtccgttacggg

SEQ ID NO: 164186 - DNA, 895 bp, Homo sapiens
  misc_feature: GYAE6OF02FSAMN.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggttttccttgttgcttcttttaagaggtgtccagtgtcaggtgcgcctggtggaggtcgggggagcgtggtccacggcctgggacgtccctgacgactctcctgtgcagcctcgtggtccttcaccttcaaattaattatcgcttagtcgctggttacgggccgtaccgacgggtccctaccgacggggacggaaacgggggtcttaagggtacgggttggggtcgggtccggttacgtacgttaaccgttccggtacccgtaaggggttcgggaaccttaacgtttccgtttacggtaaccggtttaagttacccgtaacgtaacggttaccccgttaccccggtttacggggaaccggggggtacccgttacgttttaacccgtaaccccgtaacggttacccctacccggtaaacggaaacccgtaaaccggttaaaccgtttaacccccgtaaaaccggaaaacccggttacccgggttttacgtttaaaccgttacccgttaaccggccccttaaacccggttaacccggtaacccgtaccggttacccggttaagggtaaacccggttaaacccggttaccggaaacccggtaaaccgttacccgggttaccctttaccgttaacccggtttaaccctttacccggtttaccgggttacccggtaaacgggtaacggtaaacggggttacgtttaaccgggggttacgtaacccgggtttcgttaacggttttacggttaacggg

SEQ ID NO: 164187 - DNA, 671 bp, Homo sapiens
  misc_feature: GYAE6OF02GMK7Z.47.55.E11.1.454.CMB.1.raw
  modified_base (195)..(195): a, c, t, g, unknown or other
  misc_feature (195)..(195): n is a, c, g, or t
  modified_base (230)..(230): a, c, t, g, unknown or other
  misc_feature (230)..(230): n is a, c, g, or t
  modified_base (441)..(441): a, c, t, g, unknown or other
  misc_feature (441)..(441): n is a, c, g, or t
  modified_base (523)..(523): a, c, t, g, unknown or other
  misc_feature (523)..(523): n is a, c, g, or t
tcagagctcacgtacacgaccggtgctcgatttagcactcgcacgttgggtttggggagagaagacaggattcaggacaatctccagcatggccggcttccctctcctcctcaccctcctcactcactgtgcagggtcttgggcccagtctgtgctgactcagccaccctcacgcgtccgtcggggacccccggnaggaccggtccaccatctcttgtttacgaggaacncgagctacccaaattactacgggtaaataggtacttaaagtgtaactacgtcggtaccagacaacgtcccaacgacccggaccccaaacctcactatcgtctaagaataactcgaacgccggccctacggacgggtccctagaccgtattccgtagtcggctaccgaagtcgtagaccctctaccaccgtcccttcccggtcgtacctacnccgtaggtccggggtaccttcccggggacgtacgggatgggaccgttaggtactaatttacgttactcggtcgactacggtnttaggtggactacggacacgtccgtcgtacgtcgtaacgttgttacgggttggcccgggacgggacgacgtacgcggtaccggtctaccggttgaaccgcggaaccgtacggccttccccggacccttcggtacccgtcgttaccccg

SEQ ID NO: 164188 - DNA, 714 bp, Homo sapiens
  misc_feature: GYAE6OF02F7YQP.47.55.E11.1.454.CMB.1.raw
  modified_base (191)..(191): a, c, t, g, unknown or other
  misc_feature (191)..(191): n is a, c, g, or t
tcagagctcacgtacacgaccggtgctcgatttagcactcgcacgttgggtttggggagagaagacaggattcaggacaatctccagcatggccggcttccctctcctcctcaccctcctcactcactgtgcagggtcttgggcccagtctgtgctgactcagccaccctcagcgtctcgggacccccggnaggacggtcaccatctcttgttctggaagcagctaccaatatcggaaatgaataatgtatactggtaccagcaagtcccaacgaaccgcccccaaactccacatctaataacaatgatcagccgcctgacggggtccctggcctattcctcgtcgggtctaccgaagtccgtgggcctccgtacacgtcccacccgtcggccctaagttccgacgggtcgggtcccgtcccgggacccggagggtacgtggacgggtctacgttaaatttacgttaccgttggtttaggttacgggttacgggtactccgggaccgtacggtccgtacggtaccgttacgggttccgttttaacccggttcgtttacccggggaacggttccggtaaccggggtaacccgtaaccgggttccgtaccccggttaccggtaccgggtaccgaccggaacccccgtaaacgggccccctaaacccgtccgtacggttacccaccgttcccgttacccgtcccccgttaacccccg

SEQ ID NO: 164189 - DNA, 707 bp, Homo sapiens
  misc_feature: GYAE6OF02F0OTM.47.55.E11.1.454.CMB.1.raw
  modified_base (681)..(681): a, c, t, g, unknown or other
  misc_feature (681)..(681): n is a, c, g, or t
  modified_base (688)..(688): a, c, t, g, unknown or other
  misc_feature (688)..(688): n is a, c, g, or t
  modified_base (691)..(691): a, c, t, g, unknown or other
  misc_feature (691)..(691): n is a, c, g, or t
  modified_base (693)..(693): a, c, t, g, unknown or other
  misc_feature (693)..(693): n is a, c, g, or t
  modified_base (696)..(696): a, c, t, g, unknown or other
  misc_feature (696)..(696): n is a, c, g, or t
  modified_base (704)..(706): a, c, t, g, unknown or other
  misc_feature (704)..(706): n is a, c, g, or t
tcagagctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtccacgaacgccccaaatcctcatctaataacaatgaatcagccggcctcgacggggtccctggccgattctcctggccttccaagtcgtggccgccctacacgcccacccctcggaccctagtcaggtcggtcccgtcccgggcccgaggacgtggacggccttaggtaatttacgttacgttcggttggttaaggggtttggactccggactacggccgttaggtactacggtactttacggtaccgttcggaacgtcgttacggggaaccgtaacgggtcctacccgttccgtaacggtccgtaaccggaccccgtaaacggacccctaaaccccgtacgttaccggtaccctacccgttccgtttacccggttcccccggtaccccctttcccgtacccgttaaccggttcggaaccgtccgttaccgttacgggaccgggttaccggggccgttacggggtaacctaaacccgggccgaacgtaacggttacgctacgngtaccgncgngngcncgctcgcnnnc

SEQ ID NO: 164190 - DNA, 675 bp, Homo sapiens
  misc_feature: GYAE6OF02H0C60.47.55.E11.1.454.CMB.1.raw
  modified_base (290)..(290): a, c, t, g, unknown or other
  misc_feature (290)..(290): n is a, c, g, or t
tcagagctcacgtacacgaccggtgctcgatttagcactcgcacgttgggtttgggggagcttcagctgtggtagagaagacaggattcgaggacaatctccagcatggccgcttcctctcctctcacctctcactcactgtgcgagggtcttgggccctagttctgtcgctcgactcacgccacctcgagcgtcgtcgggaccccggtgacggcgtcacactctcgtttcgttctgggaacgtcgagcctacaactgtacgaagtgactaatcgtagtacgtcgtaacngtacgacgtacccgaacggtaacccggacccctaaacgtcctactacgttcctaaactaacaagttacgactacgtaacggccgtcccgtacggaccgggtcctacggcgtacttctcgtcggctacggtaacgtccgtcgcccgtactccgaccgtccgtaccgtcgacctacgcgtcggtccggccgtaccgggcgtacggtagtcgacgcgtagtacttacgttacgtgtagggttaggtggtacgtcgacgtacgtctacgtacgttcgtacgttaccgttacgtacggtcgtaccggtaacgggtaccggtaacggtaccgtaccgggttcgtaccgttaccggaccgtacccggtaaccgtacccctaaccgtacccgg

SEQ ID NO: 164191 - DNA, 762 bp, Homo sapiens
  misc_feature: GYAE6OF02JSRJO.47.55.E11.1.454.CMB.1.raw
  modified_base (193)..(193): a, c, t, g, unknown or other
  misc_feature (193)..(193): n is a, c, g, or t
tcagagctcacgtacacgaccggtgctcgatttagcactcgcacgttgggtttggggccgcagccctggattcccagctgtttctgcttgctgatcaggactgacacacagagagctcaccagtggagtcgtgggctgtagtcgttggttttccttgttagcgttacttttaaaggtgtcctagtgtgagtgngtaggtagtggagggtccggggtagtacgttagtcgaggccgtgggtacgtcccgtagacgtacctcgtccgtgtgtagtctcgtagtaacttctagttcgagttccgttacgtggtactagcgtaccgtacgggtacccgacccgtaaaccggtccgaacgggttaacgggtccgttagggtcggttcgggttacctacggtaacgttacgtaccgtaacgttcccgttagtacggtaggacttaaggttagtttaaagttaaacttaggtacgtaccggtaccgtacgggtggaaccgggtcgtaacgttacgaacgtactacgtaaccgtcgaacggtaaccgtaaaccgaacggtaagtaaaccggtaagttaacgtaacgttcgttaacgtacgtaaacggtaaagtaaccgtaaattaacgtcggtaagtagtaaccgggtacgaacgtaggttacgtcgttaagtccgttagttacgtacggtttagtacgtagttccgttacgggttaccgaccggttcggttactcgggtaccgtacgggtaacggtacgttcggtaccg

SEQ ID NO: 164192 - DNA, 724 bp, Homo sapiens
  misc_feature: GYAE6OF02FNV5Z.47.55.E11.1.454.CMB.1.raw
  modified_base (660)..(660): a, c, t, g, unknown or other
  misc_feature (660)..(660): n is a, c, g, or t
tcagagctcacgtacacgaccggtgctcgatttagcactcgcacgttgggtttggggggaagaggaagactgacggtcctgccacaggtggtgctgggcacggtgggcactcgacacaacatttgcgctcaactgtcttgctcaccatggagtctgggctgagctgggtttccttgttgctctttaaaaggtgtccagtgtgaggtgcaggtagtggaggtccgggggagcttagttcagccgtggggacgtccctgagactctcctgtgtagtctctggaatctagtttcagttaccttcgtggatgcgtacgtcgggtccaccaaacgtccgagggtaacgggcttggtcggtcgggttctcgtacggtactactaactccgtagtacgtggaccttaggttacgtttaaagttaaaactttaggtacggtaccgggtaccgtttaccgggtacgggggtaacgggggtaccgttacgtttaccgacggaccgttaacttcccgttaaccggaacggtaacgggaaacccgtaaacggggtaaccgaaaaggttaccgtaagttaaccggttacgttaacggttaccgtaagggtaaaacgtacggtaaactaacgttacgtaaggaacggtacggtacgaacggtacgtaccgggtntacggttctatcgttagtttagttgtttcggacttcgtcccggtttcggccggtcggttaccgg

SEQ ID NO: 164193 - DNA, 703 bp, Homo sapiens
  misc_feature: GYAE6OF02I4I6P.47.55.E11.1.454.CMB.1.raw
  modified_base (316)..(316): a, c, t, g, unknown or other
  misc_feature (316)..(316): n is a, c, g, or t
  modified_base (363)..(363): a, c, t, g, unknown or other
  misc_feature (363)..(363): n is a, c, g, or t
  modified_base (513)..(513): a, c, t, g, unknown or other
  misc_feature (513)..(513): n is a, c, g, or t
  modified_base (602)..(602): a, c, t, g, unknown or other
  misc_feature (602)..(602): n is a, c, g, or t
tcagagctcacgtacacgaccggtgctcgatttagcactcgcacgttggggtttgggggcccgcagccctgggattcccagctgtttctgcttgctgatcaggactgcacacagagagctcaccagtggagtcgtgggctgagtcgttgggtttttccttgttgtcttacgtttaaaggtgtccaggtgtggtaggtgcgaggtaggtgggacggtccggggggagtcgttagttccgagtccggtggggtacgtcccgtgacgacctcgtcgtgttacggtagttctcgtagtatctagttactacgttacgttntaggtatcgtctacggtcggtacccaccgtaaacgcggaggtacggngtggtcggtgtcacgtagtctactacgtctgacgtggactaggttattaactaagtagtcggacgcgtacggtagggtacggacgtatagcgactacgtccgaacaggaacacgacggaacgtaagtaacgttctaagtatacggtttanaaacgggtaaacttaacgagttaaccgtaaggtacgtaacggtacgacgtaacgtacgaccgtttcgtaacgttacctataacggtttnttacgggtttcgttaaacgtcggtccgtttaacccgggttcgggtaaccggacgggtttccgtaaccgggtccgggtaccgtaccgggtaacccgttcggg

SEQ ID NO: 164194 - DNA, 682 bp, Homo sapiens
  misc_feature: GYAE6OF02IBDOQ.47.55.E11.1.454.CMB.1.raw
  modified_base (171)..(171): a, c, t, g, unknown or other
  misc_feature (171)..(171): n is a, c, g, or t
  modified_base (180)..(180): a, c, t, g, unknown or other
  misc_feature (180)..(180): n is a, c, g, or t
  modified_base (224)..(224): a, c, t, g, unknown or other
  misc_feature (224)..(224): n is a, c, g, or t
  modified_base (231)..(231): a, c, t, g, unknown or other
  misc_feature (231)..(231): n is a, c, g, or t
  modified_base (242)..(242): a, c, t, g, unknown or other
  misc_feature (242)..(242): n is a, c, g, or t
  modified_base (382)..(382): a, c, t, g, unknown or other
  misc_feature (382)..(382): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagcgtgggtttcctgtagctactttaaagtgtcngtgtgagtncaggtagtggagtcggggaggcttagtcagccgtgggacgtccngagcgtntccgtgtagtntcgtcagtatcagttcactccgtagtgagctctacgtcggcacctaaaccgtcgaaggtagggtcgtggtacggtgtcgtacacgttcacttacgttccaggattcgggtaactaagttacggtttaaacttaacgtttntaccgggcggtaaccgttcgggttaggaccggggtaccgtagttcgaactcgtactccgtaacgtaacggaacgtaacggtaacgaacgtaagtaacgttaacgtacgttaggttaacttacgtaaggtaacttaaggaacctagtacgagttacggtacggtaacgtaacgtacgttaccgggtatacggttattaatcgttacggtttcgtttacggttccggttaagttcccggtacgtttcccgggacggttcccgggtacggtttcggacgggaccggttacccgggtcgtacgg

SEQ ID NO: 164195 - DNA, 540 bp, Homo sapiens
  misc_feature: GYAE6OF02FXK7E.47.55.E11.1.454.CMB.1.raw
  modified_base (236)..(236): a, c, t, g, unknown or other
  misc_feature (236)..(236): n is a, c, g, or t
  modified_base (264)..(264): a, c, t, g, unknown or other
  misc_feature (264)..(264): n is a, c, g, or t
  modified_base (268)..(268): a, c, t, g, unknown or other
  misc_feature (268)..(268): n is a, c, g, or t
  modified_base (344)..(344): a, c, t, g, unknown or other
  misc_feature (344)..(344): n is a, c, g, or t
  modified_base (372)..(372): a, c, t, g, unknown or other
  misc_feature (372)..(372): n is a, c, g, or t
  modified_base (503)..(503): a, c, t, g, unknown or other
  misc_feature (503)..(503): n is a, c, g, or t
  modified_base (521)..(521): a, c, t, g, unknown or other
  misc_feature (521)..(521): n is a, c, g, or t
  modified_base (530)..(530): a, c, t, g, unknown or other
  misc_feature (530)..(530): n is a, c, g, or t
  modified_base (533)..(535): a, c, t, g, unknown or other
  misc_feature (533)..(535): n is a, c, g, or t
  modified_base (537)..(539): a, c, t, g, unknown or other
  misc_feature (537)..(539): n is a, c, g, or t
tcagagctcacgtacacgaccggtgctcgatttagcactcgcacgtagggtcttgggcccagtctgtgctgactcagccaccctcagcgtctgggaccccgggcagacggtcaccatctcttgttctggaagcagctccaatatcggaaatgataatgtatactggtaccagcaagtcccacgaacggcccccaaactcctcatctataacaatgatcagcgcctcgagggtcccnggccattcctctggctccaagtctggcncctnagccacctggccatcagtgggacctccggcccgaggactggacgctgaatttagtactgtgtaggttgggattcgnagtcctgactggtcttacgtcttcggancgtacgggacaacggtcaccgtcgtaggccagcccaagcccaaacccgactgccacgtcgttccgtaccccacccgttctcgacgttcgacgtcttacctggaaccgccgggtacttcgggactaagggcnccgttaagcgagtcaagntcgatgcgnacnnncnnnc

SEQ ID NO: 164196 - DNA, 663 bp, Homo sapiens
  misc_feature: GYAE6OF02JHAVQ.47.55.E11.1.454.CMB.1.raw
  modified_base (173)..(173): a, c, t, g, unknown or other
  misc_feature (173)..(173): n is a, c, g, or t
  modified_base (267)..(267): a, c, t, g, unknown or other
  misc_feature (267)..(267): n is a, c, g, or t
  modified_base (369)..(369): a, c, t, g, unknown or other
  misc_feature (369)..(369): n is a, c, g, or t
  modified_base (530)..(530): a, c, t, g, unknown or other
  misc_feature (530)..(530): n is a, c, g, or t
  modified_base (589)..(589): a, c, t, g, unknown or other
  misc_feature (589)..(589): n is a, c, g, or t
tcagagctcacgtacacgaccggtgctcgatttagcactcgcacgttgggtttgggggccgcagccctgggattcccagctgtttctgcttgctgatcaggactgcacacgagagagctcaccagtggagtctgggctagagcgttggtttacctgtagcttactttaaaggngtctagtgtgagtgctaggtgtcggagtcggggagtcttagtcagccgtgggacgtccagcgtactcgtaccgtggtgtatcgtgaggtaactntagttactagtaccttcgtggatcgactacgttcgggtacccctaagtaacctaccgtaagggttagggccttagggttggtacggtacctacgacgttaanccgtaccttaccgtagtaccgtccggtagtaacgttactttaaaccgttaagttacggtcggacggttacggtttaccggggacggtacgggggtacctcttaacgcgtacctagttccacgtacgaacgtacgaaccggtgaaacggtataacgtacgtntacgtgaactagacagtactgtagagactcgactcgtacgttctagtactataccgttnttacggttcgttcggtaccttcggtcggtccgccggtacgttaccgtcgggaccggcggtaccgtagtacccgg

SEQ ID NO: 164197 - DNA, 630 bp, Homo sapiens
  misc_feature: GYAE6OF02ICLJU.47.55.E11.1.454.CMB.1.raw
  modified_base (236)..(236): a, c, t, g, unknown or other
  misc_feature (236)..(236): n is a, c, g, or t
  modified_base (336)..(336): a, c, t, g, unknown or other
  misc_feature (336)..(336): n is a, c, g, or t
  modified_base (381)..(381): a, c, t, g, unknown or other
  misc_feature (381)..(381): n is a, c, g, or t
  modified_base (435)..(435): a, c, t, g, unknown or other
  misc_feature (435)..(435): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagcttgggtttttccttgttgcttacttttaaaaggtgtccagtgtgaggtgcaggtagtggagtccgggggagcttagttcagctggggatccctganactctctgtgtagtctcgtggatctagtttcagttaccttcgtgatgcacgtgggtccacaactcgaaggtaacggggctggtggtcggtctcacgtacnctaatcctgatggactagttattaataatgtcgacgacgttcggngacgggcctattcgagtcatcctacgagaagactacgacaagtagtactacgtntacgtcgtaaggtaaactacgaaactagttacgtaacgaacgtacggtaccggtaaacgtagttaccggtcttacggttacctaattaccgttagttttacggtttcgttttacggacgttcggtaccccggttttccgggaccggcggtttaacccgtttcgggaccggggtacccttacggggacccttcggg

SEQ ID NO: 164198 - DNA, 848 bp, Homo sapiens
  misc_feature: GYAE6OF02HFMKZ.47.55.E11.1.454.CMB.1.raw
  modified_base (217)..(217): a, c, t, g, unknown or other
  misc_feature (217)..(217): n is a, c, g, or t
  modified_base (238)..(238): a, c, t, g, unknown or other
  misc_feature (238)..(238): n is a, c, g, or t
tcagagctcacgtacacgaccggtgctcgatttagcactcgcacgttgggtttgggggaagaggaagactgacggtcctgccacaggtggtgctgggcacggtggcactcgacacaacatttgcgctcaactgtcttgctcaccatggagtcgtggctgagtcgttgggttttccttgttcgtacttacgttttaaaggtcgtcgagtgtgaggtgngaggtagtggacggtcggggngtcgttagtcacggtccgtgggtacgtccgtggacgtacttccgtccgttggttacggttacgttccttacgtacggtaacttcgttaaaggtttcccgtaaacgtttcccggttttactgggttaactaccgtaccgtaccggttaccggggtacccctaaaaccccgtaaacccggttccgggtaaaacggggttaacggggttcggttaacgggtcggtttacgggttcccttaaccggtaacgttacgtaaccgttaacgttcccgtaaggtcgtaccggttaacgttactttaagttaaaacgtttaaagttcggtaccgggtaccggttaccgttacgggttacgggtaaccggggtaccttacgttaaccgtacgtaccgttaactcccggtaacgtacggaaacgaacggtaccgggaaatacggttaacttacgtaaagtcggtaagtaccggttaaggaaacgttaacgacctagttaacggaggtaacgttaacgagtaacggttacgaccgttcggtacttcgtacgttagttacgttacgtttcggtaacgttcgttccggttcccgggttacggtccccgggttaacggttccggg

SEQ ID NO: 164199 - DNA, 968 bp, Homo sapiens
  misc_feature: GYAE6OF02HK975.47.55.E11.1.454.CMB.1.raw
  modified_base (66)..(66): a, c, t, g, unknown or other
  misc_feature (66)..(66): n is a, c, g, or t
  modified_base (242)..(242): a, c, t, g, unknown or other
  misc_feature (242)..(242): n is a, c, g, or t
  modified_base (298)..(298): a, c, t, g, unknown or other
  misc_feature (298)..(298): n is a, c, g, or t
tcagagctcacgtacacgaccggtgctcgatttagcactcgcacgttgggtttggggggggggaanctcagcttcagctgtggtagagaagacaggattcaggacaatctaccagcatggccgcttcctctcctcctcaccctcctcactcactggtgcgagggtcttcgggcccagtctgtgctgactcgaacgccctaccctcgacgtccgttccggtaccgggggacccccccgggtanaacgggaccggttcccaaccgtacttccttccgttaccgtttacgtacggggaacnccgtacgtccgtacctaaaggttacctacgggtaaacttagaattaacgtaggttaacttaccgtacggtaaaccgagtaacccgtaaaccgttaacccccggaaacccggtaacccccggttaacccccccgtaaacctttccctaaccttaaccgttaactaaactttaaaaccaaacggtttaagtaaacctaccgaccgggttaccccggtaccccggttaacgggtacccgggggttccccgtaggggttacccccgttagttttccccggtagttacccggtacctaaaccccggttaggtcccggttacgggccctaacccgtacgaccgtacccccgtacggtaccggtaccgtactccggtacggggtccggaccccggtcccgggacggttaaggtacggtacggtagggtcccttataaccttttacgttcgttaacgggttgggttaccggggtttagggaccttaccgggcgttaaacccggttctaaccgggtttaccttcggggttacccgttttacccggggttttacggttaacccgggggtagtttacccgggttaaccggggtaaacccgtttaccgggttaacccggttcccgggtttaacccggttacggggttaacccccgaaccggtaccccgggtaaacccccggg

SEQ ID NO: 164200 - DNA, 771 bp, Homo sapiens
  misc_feature: GYAE6OF02FJLFZ.47.55.E11.1.454.CMB.1.raw
  modified_base (218)..(218): a, c, t, g, unknown or other
  misc_feature (218)..(218): n is a, c, g, or t
  modified_base (221)..(221): a, c, t, g, unknown or other
  misc_feature (221)..(221): n is a, c, g, or t
  modified_base (297)..(297): a, c, t, g, unknown or other
  misc_feature (297)..(297): n is a, c, g, or t
  modified_base (589)..(589): a, c, t, g, unknown or other
  misc_feature (589)..(589): n is a, c, g, or t
tcagagctcacgtacacgaccggtgctcgatttagcactcgcacgttgggtttgggggaagaggaagactgacggtcctgccacaggtggtgctgggcacggtgggcactcgacacaacatttgcgctcaactgtcttgctcaccatggatctgggctgagcttgggtttttccttgttgcttacttttaaaggtgtccagtgtgaggtgcaggtagnggnggtccggggagtcttagttcagtccggtggggtatcccgtgacgtctcctccgttgtgttatctcgtaggtatcgngtttctacgttaccttcgtggatcgacgtacgtcggtcccaccgtaaaccgtcggtaacgggttaacgggtcgttacggggttcggttacggggtacccttcggtaaccgttacgttcctaaacgttccgtacggtattcgggagttaacggtttaacgtttaaattaaaacgtttaagtcgggtaccggtccggtttacgggtcgggtaacggggtaccgtacgttacgacgtactacgtcccgtacgaacggaacgtaacgtaacggagaacgttaagttataaccgttntaaggtttacaaacggttaaattaaccgaacgttaaacgttcgtacgtaacgacggtaaccgtaacgtacgttccgtacggttcgttaccgttaactacggtttagttttaccgttaacggttttcggaacgtttccggttaacccgggttcccgggttaccgggttcggtttaccccgggg

SEQ ID NO: 164201 - DNA, 826 bp, Homo sapiens
  misc_feature: GYAE6OF02GD15F.47.55.E11.1.454.CMB.1.raw
tcagagctcacgtacacgaccggtgctcgatttagcactcgcacgttggggtttgggggccgcagccctgggattcccagctgtttctgcttgctgatcaggactgcacacagagagctcaccagtggagtctgggctgagtcgttgggtttttccttgttgtcttactttttaaaaggtgtccagtgtgaggtgcgtaggtagtgggaggtccgggggaggtctttaagttcgagtccgtgggggacgtccctgagaccttccgtccttggtagttacgttcttcgtaggtaattccgtagttttacgacgtttaccctttcgtaggtatgcctacggtcgggtcccgacctaaaacgtccggtaaggggtaacgggtccgttgggttagggtcgggttctaccgtagtactacgtaacttccgtgtagtcggtactaagttacgtttaaattaaaagtttgtacggtaccggttaacgtaccgggttacgggtacgggggacccgttacgttaccgaacgtaccgtaattcccgtaaccggtaagaaaccggaaccggtaaaccgggaacgtaaaggtagttaaaccgttaagtaatttacggtacgtttaaacgaaagttacgaaaactaacgttcgtaaggtaaggtacggtaccgaaacgtacgttaacggtcgtttacggttaacttacgttacgtttaggtttttaccggtttcggtaccggtttccggttacccgtttaccggggttcccgggttacgggttaccggtttaccgggccggggttacccggaaccggggtttacccgccgggttaaccg

SEQ ID NO: 164202 - DNA, 749 bp, Homo sapiens
  misc_feature: GYAE6OF02GGDK6.47.55.E11.1.454.CMB.1.raw
tcagagctcacgtacacgaccggtgctcgatttagcactcgcacgttgggtttgggggccgcagccctgggattcccagctgtttctgcttgctgactcaggactgcacacagacgagctcaccagtggagtccgtgggctagagcgttcgggttttccttgttgcttacgttttaaaaggtgtccagtgtggtaggttgcgaggtagtcggaggttcccgggggagtcttaggttccagtccgtggggtacctcccgtgacgaccttctccgtgtcgttaacgtctcgtggtaactctaagtttcacggttaccttcgtacggatcggtacaccggttcgggtcccgtaccaaaaccgttcggaacggggttaaggtccgtggggtcggtcgggtacttacgtaacgtacgtccgtattcgtacgtaagtcggactacgttagttaactaaagttacgtcggacgtaccgtcggtacggcgggtaccttagtcgaagtccctagtacccgtaccgaacgtaacggaaccgaacgggtaacaagggttaaactacgtaacgtttggtaactacgttaagggaaattacggaacgtaaccgtgtacggtacgtacggtacgttacgaacgttcgtcgttacgtaacgttacgtcgttagtttccgtttacggactttccgtcccggttccggttcccggtaggttccctgggttacccgggacctaaccggggttacctagggttacccg

SEQ ID NO: 164203 - DNA, 825 bp, Homo sapiens
  misc_feature: GYAE6OF02IKFIS.47.55.E11.1.454.CMB.1.raw
tcagagctcacgtacacgaccggtgctcgatttagcactcgcacgttgggtttggggaccgcagccctgggattcccagctgtttctgcttgctgatcaggactgcacacagagagctcaccagtggagtcgtggctgagtcgttgggttttccttgttgtcttacgttttaaaaggtgtaccgagtggtgtaggtgacgaggtagtgggacgggtccgggggagtcgtttagttcgagtccggtggggacgtccgtagacgtactccgtcgtgtgtacgtcttcgtacggtaactacgttacgttcgtacgttaccgttacgtggtagtcgtcgtacgtcggtacccgaacccgtaaaccgtaggtaacccccccccccccccgggtaagggtcgttcggtcggtcggtcgtacgtacgtaacgttacgtaacgtacgtacgtacgtacggtacgtaacgttacgtttaagttaaagttaacggttacggtaacggtaaccggttaccggtacgggtaccggggtaccggtaacgtaccgtaacgtaccgtacgtaccgtaccgtaacggtaacggtaacgaacggaacgtaaggtaacgtacgttaacgttacgttaacgttacgtaacggtaaagtaaacgtaaacgtaacgtacgtaaaggtacggtaacgtaccggtaacgtaacgtacgtacgttacgttacttaagttacgttaccgtttacgtttacgttacgttacgttccggttccggttaccggtaccggttaccggttaccgggtaccgggtaccggtaccgggtaccggttacggtaaccgg

SEQ ID NO: 164204 - DNA, 583 bp, Homo sapiens
  misc_feature: GYAE6OF02FOBDF.47.55.E11.1.454.CMB.1.raw
  modified_base (338)..(338): a, c, t, g, unknown or other
  misc_feature (338)..(338): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggtttccttgttgctctttaaaaggtgtccagtgtgaggtgcaggtagtggagtccgggggagcttagttcagcctgggggatccctgagactctcctgtgtagtctctggaatcagtttcagtaccttctggatgcactgggtccgccaaactccgaaggtaaggggctggtggtggtctcacgtatcaatcctnatggctagtgttaataaattagtgcggactccggtggacggggccgattacgagcatcctaccagacgacgaacggacaaggagtagtactgtactacgtagaaatgaaactatacgtagaagtacgtacgaacgtacgtacggctagtacgttactcgttagttagtacggttttcgacgttcggtcccgttcgggttaccgtcggggtaccttcggtcgggtaccggacgggtacccgtcggg

SEQ ID NO: 164205 - DNA, 790 bp, Homo sapiens
  misc_feature: GYAE6OF02GF8SH.47.55.E11.1.454.CMB.1.raw
  modified_base (214)..(214): a, c, t, g, unknown or other
  misc_feature (214)..(214): n is a, c, g, or t
tcagagctcacgtacacgaccggtgctcgatttagcactcgcacgttgggtttggggagcttcagctgtggtagagaagacaggattcaggacaatctccagcatggccggcttccctctcctctccaccctcctcactcactgtgcagggtcttcgggcccagtctgtcgctgactcacgcccacctgacgtcgtccgtcggggacccccggnaggtaccggccacccgtattccttcgttacgttcgtagggaacgcctacggtaccttaacccgaaagttacgtaacggtaaaacgttagtaaacgttaatttacgttaacgttaacgtaccggttaaccgaacgtaaccggtaaaccggttaccccccgaaacccgggaaacccccggtaacccccctaaacccttcccgtacctaacttaccttaaagtaaacctagttacgtactaccgacgggtacccgtacccgtccggtaccggggtccctacggccgttacttcctcggtaccgtctaccgtaacgtcgtaccgccgtcctaccgccgtcccgtaccgtccgcctacgtcggaccggttccggtcccggtcccggaaccgggtagtacggcgggtcgtacgtagtttacttacggttccgttaggtagggtttacggtcgggtacttccgacgtcgtcggtacttacggttcgttaccgttacgttcggttacggacggtaggtaccggtaccgtacggttcccgtaccgttacggtaccgcgaaccgtaccaccggtaccctacgtccg

SEQ ID NO: 164206 - DNA, 669 bp, Homo sapiens
  misc_feature: GYAE6OF02FJYMT.47.55.E11.1.454.CMB.1.raw
  modified_base (204)..(204): a, c, t, g, unknown or other
  misc_feature (204)..(204): n is a, c, g, or t
  modified_base (217)..(217): a, c, t, g, unknown or other
  misc_feature (217)..(217): n is a, c, g, or t
  modified_base (361)..(361): a, c, t, g, unknown or other
  misc_feature (361)..(361): n is a, c, g, or t
tcagagctcacgtacacgaccggtgctcgatttagcactcgcacgttgggtttggggagctgtggtagagaagacaggattcaggacaatctccagcatggccggcttccctctcctcctcaccctcctcactcactgtgcagggtcttgggcccagtctgtgctgactcagcccaccctcagtcgtcgtcgggacccccgggnaggacggtcaccntctcttgttctggaagcagcctccaatatacggaaatgaataatgtatacgtggtaccagcacgtccccaaccgaaccggcccccctaaactccctcactctaataacaatgactcgacggccgtccctcggacggggttcccncggaccgtacttccgtcgtcggccttaccgaacgtcgtcggccgtcctcgacgtcccctccgtcgccatcgaggtcgggtccgtcccggtacggaggcgttggacgtcgtagtactttaacgttacgtcggtacgcgtagcgttagggtagggtactacggtaacgccgtacccgttcggtccgttcgggtcgtttaggtttcgggtttccgggtacgggtcggggaaaccgggtccgtaacggccggtacggttaccccgttcggtacggtacccggaccgacccggtggtccccggttacccccgg

SEQ ID NO: 164207 - DNA, 748 bp, Homo sapiens
  misc_feature: GYAE6OF02FP9UY.47.55.E11.1.454.CMB.1.raw
  modified_base (492)..(492): a, c, t, g, unknown or other
  misc_feature (492)..(492): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagcgttggttttccttgttgctttacttttaaaggtcgtcctagttgtggaggtgacgagggtagtgggtacgggtccgggggtaggtcgtttagtcgagtccggtaggggtactcccgtgacgtactcgtctggttcgtgtctcgtggtaatcgtacgtttcacgttacttcgtggtatcgcgtcggttccggtccgaccctaaactccggaagggtaacggggtccgttgggtacgggttcggtctacggtacgttacgttaccgaacttccgtgacgtggtcgtagttactttaattaagtttacgtcggtaccggttacgtccggttaggggacgggtccgtaaacgtccngtaccgtcgttactccggaacgaacgtaacgaacggaaccgtaagttaccgtaattacggttattacacggttaaacgaagttaacgaaacttacgtaggtacgaaggttaccgtacgaccgttaacgggtcgtaccgtttaggtaacccttacgttacttggttttacgttacggttttcggtaccgttccgggttaacggttcccggttacggtcggttacggttcgggacccgttacggaccggttggtaacg

SEQ ID NO: 164208 - DNA, 849 bp, Homo sapiens
  misc_feature: GYAE6OF02JPSSG.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccagtggagtccgtggctgagtcgttcgggttttccttgtgcttacgtttaaaggtcgtcgagtgtgaggtgcgtaggtagtggacggtccgggggagtcgttagttaccgacgtcggtacggggtacgttcccgtaggtacgtaccgttccgtaccgttgttacggtacgttcgtcgtaggtaacttcgttacggtttaccgtacgtttacccgttggttacgggtacttaccggacgtttaacccgggttccggggtaaccccgttaacccgtaaaccggttaccgggtaacggggtttaccgggggtacggttcggggtttaacgggttccggttccgttaccgtaaccggttacgttaccgtacgttaccgtaggtccgttggacgttaacggttagtttaacgtaacgtttacgtcggtaccggttaccggttcgggtagggaccgggtaacttcgtacgtacgtaccgtcgtaccgtacggtaacgacggtaaaccgtacggaaacgtaggtaccggtatacggttataacgttaacggtaacgtaaaggtacccgtaagtacggttaacgtgggtaaccggttacgaaacgttccggtaacgttagtcccgtttaagttacctacgtttacgttacggttcgtttaacgttcggcgttaccggttccggtacggtaccggttcgttacgtccggttaccgggaagttacccggtagtaccgg

SEQ ID NO: 164209 - DNA, 845 bp, Homo sapiens
  misc_feature: GYAE6OF02GOHUA.47.55.E11.1.454.CMB.1.raw
  modified_base (214)..(214): a, c, t, g, unknown or other
  misc_feature (214)..(214): n is a, c, g, or t
tcagagctcacgtacacgaccggtgctcgatttagcactcgcacgttgggtttggggagcttcagctgtggtagagaagacaggattcaggacaatctccagcatggccgcttccctctcctcctcaccctcctcactcactgtgcagggtcttgggcccagtctgtgctgactcacgcccaccctcacgccgtcgtaccggggacccccgggntacggaccggtccaccattccttctttgttccgtagggaacgcacgtccttaccaaattacgtacggaaattgaattaaagtagttaactaccgttacggtaacccaggtacctaaacggtacccccgaaccggaaaccccgggacccccctaaaaccgttccctacaactacctaataaaccaatcgatacgacggtccggccctacgtacggggtccctcggccgtactttccgtacgtcggtcctaccgtaacgttccgttcggacccgtcccgtaccgaccgtacccctacccgtccggaccctacgttaccggacggtccggggtacccggttccccgggacccgggaacgggtacggtacgggtaggtccgttaggttacgtttaacgtttaccgtggtttcgggttaagggtttcggggaacttccgggacttcccggtaccgtacgttaccgttacggttaccgtttacccggttttaccgggttaccggttaccggttaccggtaacccgggggttaacccgtaaaccgggtttccccgaacccgggtttaccggttaacccggtaccggtaaccccggttaacccccgaacccgggtaacccctaacccccgttaacccgg

SEQ ID NO: 164210 - DNA, 682 bp, Homo sapiens
  misc_feature: GYAE6OF02IIWOQ.47.55.E11.1.454.CMB.1.raw
  modified_base (367)..(367): a, c, t, g, unknown or other
  misc_feature (367)..(367): n is a, c, g, or t
  modified_base (369)..(369): a, c, t, g, unknown or other
  misc_feature (369)..(369): n is a, c, g, or t
  modified_base (611)..(611): a, c, t, g, unknown or other
  misc_feature (611)..(611): n is a, c, g, or t
tcagagctcacgtacacgaccggtgctcgatttagcactcgcacgttggggtttgggggccgcagccctgggattcccagctgtttctgcttgctgatcaggactgcacacagagagctcaccatggagtctgggctgagcttgggttttccttgttgcttacgttttaaaaaggtgtcctagtgtgaggtgcgtaggtaggtggacggtcgggggagtcgttagttcaggcctgggggacgtcccgtgacgactcgtccttggtgtagtctcgtaggaatcgtagtttctacgttaccttgaggtatgacgacgtcgggtacccaacaacgtcgtagggtaagggtcgtaggtgtggtctcagtananaactcgtgtatggtctaggttagtttaaagtaattagtcggtcggacgttccgtagggacgggtcctagtcgtacgacgtacttctaccgaaggaacgaaaccgtaaggacaaagtacgtattaacgtaggttagtaccgaaggtaaacttacgaaacctaaagtctaagggtaagtacgtaaccggaacgtaacgttacgggtactcgtaacctagttaccgttattggtttacgtttacncgttacgtcccggtttacggtcggtacgttaaccggtttcggacggggtaaccgtaccggggacccttggg

SEQ ID NO: 164211 - DNA, 769 bp, Homo sapiens
  misc_feature: GYAE6OF02IOX68.47.55.E11.1.454.CMB.1.raw
  modified_base (212)..(212): a, c, t, g, unknown or other
  misc_feature (212)..(212): n is a, c, g, or t
  modified_base (246)..(246): a, c, t, g, unknown or other
  misc_feature (246)..(246): n is a, c, g, or t
  modified_base (351)..(351): a, c, t, g, unknown or other
  misc_feature (351)..(351): n is a, c, g, or t
tcagagctcacgtacacgaccggtgctcgatttagcactcgcacgttgggtttgggggagctgtggtagagaagacaggattcaggacaatctccagcatggccggcttccctctccctcctcaccctcctcactcactgtgcgagggtcttcgggacccaggtctgtcgctgctcacgcccacctcagccggttcgtccggggaccccggnacggaccgtcaccatcgttcttgttcgtaggacncacgtctaccaatagtacgaatgaatagtagtactactacggtacagaccgtaccgtaccccgaacggaacccgaccccctaaaactccctactaactacctaanaaactaagtacgtactaccgacggtaccccggtccccgttcgggtaaccccggggttccgtacggtaccgttagttccgtcgtcccgggtacctacccgtaaggttccgccggtaccgtaccgttaccgacccgtaccccaacccggtcgggaacccttacgtaccggggtaccgggttccggggtacccgggtaccccgggtaaccgggaacgggttacgacggggtacgtaccggttagttacgtttaagtttaccgtggtttagggttacgggttagggaccgttgaccgtaccggtacctacgtaccgtcgttccgtttaccgttacgtagggtacgccggtacggaccgtcgtacccgtcgttacgacgtccgaaccgaaccgtaccgaccctaccgtacgtcgtacctaccg

SEQ ID NO: 164212 - DNA, 725 bp, Homo sapiens
  misc_feature: GYAE6OF02JWQCQ.47.55.E11.1.454.CMB.1.raw
  modified_base (177)..(177): a, c, t, g, unknown or other
  misc_feature (177)..(177): n is a, c, g, or t
  modified_base (223)..(223): a, c, t, g, unknown or other
  misc_feature (223)..(223): n is a, c, g, or t
  modified_base (374)..(374): a, c, t, g, unknown or other
  misc_feature (374)..(374): n is a, c, g, or t
  modified_base (518)..(518): a, c, t, g, unknown or other
  misc_feature (518)..(518): n is a, c, g, or t
tcagagctcacgtacacgaccggtgctcgatttagcactcgcacgttgggtttggggagcttcagctgtggtagagaagacaggattcaggacaatctccagcatggccggcttcccctctcctcctccaccctcctcactcactgtgcgtagggtctcgggcccagtctggtcgtntcgacctcaacgcccaccctcagtcgtccggtcggggacccccggnacggacgtcaccattctcttgtctaggaagtcacgtctaccaattagaccggaaattgaataagtgtactacgttacggaaccagctaacgtcccaaccggaacccggtacccctaaacctcctacattacctaacgaactagtcataccncggcccggttaccctaggaccggggtaccctcggtacccacgtttctaccgtcggtacctacgaacgttcgtcggtaccgtccttaacgcccgtacctaccgtaccgtccgacgttcgacgggtcgtacccgtccggacccggngaaccgtagcggtcgttaacgtacttacgttatacggttagggttacgggtgtacggtcccgtacgtacgtccgttaacggtcgtacctccggtttaacgttcggttacccggtaggttaccggacgggttaacctaccgggtacccgtaccgttaccgttaccggaccgttaaccggccccgtaaaccggcccaaccggttacccg

SEQ ID NO: 164213 - DNA, 804 bp, Homo sapiens
  misc_feature: GYAE6OF02JJO9U.47.55.E11.1.454.CMB.1.raw
  modified_base (196)..(196): a, c, t, g, unknown or other
  misc_feature (196)..(196): n is a, c, g, or t
  modified_base (210)..(210): a, c, t, g, unknown or other
  misc_feature (210)..(210): n is a, c, g, or t
tcagagctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagcccacctcagccgttacncggggacccccggnacggtaccggtccaaccattccgttcttgttcgtagggaacgccgacgccttacccaagttcgtaccggtaaattggaattagtacgttaagttaccgtacgggttaaccaggacctaaccgttcccaaccggtaaacccggccccctaaaacgtccgtacaactctaactaacaagtgaactcgaacggtccggtccctaccggtacggggttaccctcggtacccgttacgtttcccgtcgtcggtacctaccgtaaccgtcggtacggtccgcccgtacgaccgtacccgtaccgtccgccgtacgtcggtacggtaccgggtcccttacccgggggacccgtagggtaccgtacggtaacggcttaacggttaaccgtttacgttacgttacggtagggtttagggtacgggtaactccgggaccgtaggttacccgtaaccggtccgttacggttacccgttcggtttaccgtcccggtaagggtcccggtaaccgggtaaaccggttacggtaccccgtaacccggttttacgaacccgggttaccgaacccggacccgtaacccgggtaacccctaccccggtaccg

SEQ ID NO: 164214 - DNA, 921 bp, Homo sapiens
  misc_feature: GYAE6OF02H7HRV.47.55.E11.1.454.CMB.1.raw
tcagagctcacgtacacgaccggtgctcgatttagcactcgcacgttgggtttggggccgcagccctgggattcccagctgtttctgctgctgatcaggactgcacacagagacggctcaccagtggagtccgtggctgagtcgttcgggttttccttgttcgtctttacgttttaaaacggtgtacctagtgttggaggtcgactaggtagtggtagggtccgggggaggtactttagttcgtacggtccggttggggacgttcccgtagacgtacttccgtccgtgttacgtcgtactcgtaggtaactacgtacgtttcgtacgttaccgttaccgtaggtaatcgtaccgtacgttcgggtaccctaccgaaaccgttaccggtaagggttaacggggtcgttagggttacggtcggtacctacgtacggttaactacgttaccgtacgttaggtacgtacggtcgtaaacgttagttaaactttaacgttagtcgtacggtaccgtcgtacggacgggtcgtaacgtcgtacgtacgttactaccgtacgtaacgaacgtaaccgaaacggaacgtaaaccggtaaatttaaccgtacgttaaacgttacgttaacggtaacgttaaaacgttaacgtaaaacccgtaacgttacgtttaaacgggtaaacgttaccggaaacccgggtttaacgaacggttttaacccgggttacgtttaccggtttaaaccgtttttaaagttcccggtttttaaccgtttttagggtttaacccggtttcggtttaaacccgggtttcccgggttaacccgggtttacccgggtaaccgggtttttcccggttaacgggggttacccgggtacccccggggtttaaacccgggtttacccgggtttaccggtttaaccccggg

SEQ ID NO: 164215 - DNA, 877 bp, Homo sapiens
  misc_feature: GYAE6OF02IL0FC.47.55.E11.1.454.CMB.1.raw
  modified_base (215)..(215): a, c, t, g, unknown or other
  misc_feature (215)..(215): n is a, c, g, or t
  modified_base (259)..(259): a, c, t, g, unknown or other
  misc_feature (259)..(259): n is a, c, g, or t
tcagagctcacgtacacgaccggtgctcgatttagcactcgcacgttggggtttggggcagcttcagctgtggtagagaagacaggattcaggacaatctccagcagtcggccggtcttcctctcctcctcaccctctcactcactgtgcgaggtcgtcggaccagtctgtcgctagtactcacgtccacctgacgcgtcggtcgggacccgganacggcggtaccacgtacttcgtcgtttcggtacgtacggtaacnccgacggtacctaacctaactacggtaacggtaaatacgtaacgtaacgttagttacgtaacgttacggtaaccgtaacgaccgtaacgtaaccccggtaaccggaaccccggaaccccttaacttacccgtactaacgttaccgtaaactaacgaaacgtttacggactaccggtaaccgtccggggttaacccgtaccggggttaaccgggtcccggttaacggggttcccgttaacgtttccgtccggtttaaccgtccgttaaccgggtaaccggtttcgggtaccggtacccgttacccgacgttacccgtacccgtaccggttaccggtacctacggttaccgggtacggggtacccggtaccgggttccgggaacccgggtacggttacggacgggttacggttacgttagttaacgtttacgttaacgggtcggtttaaggggttacggtttacgggaacgtcgacggtttaccgtcgtaccgttacgtacggttacgttacgggttcgtaccgggtacgtccgggttaaacggaccgtttaaccgggtaccgtaccgtttaaccggcggtttacccgacccggtaaccggaccggttaaccctaaccgg

SEQ ID NO: 164216 - DNA, 781 bp, Homo sapiens
  misc_feature: GYAE6OF02FG8T4.47.55.E11.1.454.CMB.1.raw
tcagagctcacgtacacgaccggtgctcgatttagcactcgcacgttgggtttggggcagcttcagctgtggtagagaagacaggattcaggacaatctccagcatcggccgtcttccctctcctcctcaccctctcactcactgtgcagggttctcgggcccagtctgtcgctgacctcgacgcccaccctcgacgtccgtcgtccggggacccccggcacggaccgtccaccatccttcgttcgtccgtaggaactccacgtcctaccaatcgtacgtaatgactagtctactacgtcgtaaccagaccacgtcccaccggaacccgaccctaactcctactactaccgtaactaaccagtacgtaactccgaacgggtcccgtcccgtacgggtacccggggtcccttcgggtccttacgttccgtccggtacgtccctaaccgtaacgtcggtaccggtaccgcccgttacgacccgtaccccaccgtacgccgttacgttccgggacgggttcccgggacccgtacccgggtacccggtaggtaccgtgggtacgcttaacgttacgttaacttaccggtaggttaccggtaggggttcggtaccctacggaccgtaacggtttccgaaccgttaccggttcgttaacccggtttaccgtttcggaaccgggtaccgtaaccgggtacccggaaaccggttccggttaccccgtacccggttaccgaaccggttaacccgaccggttacccccgaaccggtaacccccgtaacccg

SEQ ID NO: 164217 - DNA, 697 bp, Homo sapiens
  misc_feature: GYAE6OF02F4LYJ.47.55.E11.1.454.CMB.1.raw
  modified_base (251)..(251): a, c, t, g, unknown or other
  misc_feature (251)..(251): n is a, c, g, or t
  modified_base (372)..(372): a, c, t, g, unknown or other
  misc_feature (372)..(372): n is a, c, g, or t
  modified_base (551)..(551): a, c, t, g, unknown or other
  misc_feature (551)..(551): n is a, c, g, or t
tcagagctcacgtacacgaccggtgctcgatttagcactcgcacgttgggttggggccgcagccctggattcccagctgttctgcttgctgatcaggactgcacacagagagctcaccatggagtctggctgagtcttgggttttccttgttgacttacgttttaaaaggtcgttccgagtgtaggacggtgcgagggtagtggacgtccggagggagtcttagttccacgaccgtggggacttaccccgngacgacgtctccgtggtagtcgtcttgtaggaatccgtagtttcacgttaccttgtcgatgactcggtcggtcccaactaacgtcgaggtaacgggcgtggtggtggtaccacgtacgtancctaacgtccgtagtctgtaccgtagttagttaacgtaaaattcgtgggtaaccgcttaccggggtaggaacggggtcctaacgtttccgaagtcctaagtcccgtacgaacgacggtaaccgaaacgtacgaagtacgttaactcgttacacgttacgtaacggaaatcgtaaaccgntacgtacggaacgtccgtacggaacgttaccgtacggtctagttaacgttctacgttacgttggtttacggttaccggtactcccggttcgtcccgtacggggtcccggttaccgttacgggtccgggtaccggtaccgtacccgg

SEQ ID NO: 164218 - DNA, 773 bp, Homo sapiens
  misc_feature: GYAE6OF02FET46.47.55.E11.1.454.CMB.1.raw
  modified_base (87)..(87): a, c, t, g, unknown or other
  misc_feature (87)..(87): n is a, c, g, or t
  modified_base (289)..(289): a, c, t, g, unknown or other
  misc_feature (289)..(289): n is a, c, g, or t
tcagagctcacgtacacgaccggtgctcgatttagcactcgcacgttgggtttgggggccgcagccctgggattcccagctgtttcngcttgctgatcaggactgcacacagagagctcaccatggagtcgtgggactgacgtcgttcggtttcgtgtacgtcttacgtttaaaaggtcgtacctagtgtcggtaggtcgacgtaggtaggtcggtacggtccggggtagtcttaacgtcgacgccggtagggactccgtagacgtctctacgtgtgttacgtctacgngtaactcgtaacgtttcgaacgttcctacgtcggtactcgtacgtaccggtccggtaccaacccggtaaacgtcggtaacgggtagggtccttaggtacgttcggtacctaccgtacgttactacgtaccttacggtataacggtccgtagtacgtttaagttaactaacggttggaccggtaccggtcgtacgggtacgggtacggctttacgctaacgtcctacgttaccgagtaacgaacgtaccggtaagtacgtaacgttataccgttacgtcgtaacgtacggtaacctaagaaccgttacgtacggttacgaaccgggtaatacccgggtaagttacccgtagttaccgggtcttacggtactagggttacgtttcgtacggttacgtttaccgacggttacccggttaccgggttaccgtaccggggtttcgaacccggttgggacccggtaacccggtcggtttcccgaaccggg

SEQ ID NO: 164219 - DNA, 652 bp, Homo sapiens
  misc_feature: GYAE6OF02F3H8V.47.55.E11.1.454.CMB.1.raw
  modified_base (278)..(278): a, c, t, g, unknown or other
  misc_feature (278)..(278): n is a, c, g, or t
  modified_base (306)..(306): a, c, t, g, unknown or other
  misc_feature (306)..(306): n is a, c, g, or t
  modified_base (479)..(479): a, c, t, g, unknown or other
  misc_feature (479)..(479): n is a, c, g, or t
  modified_base (539)..(539): a, c, t, g, unknown or other
  misc_feature (539)..(539): n is a, c, g, or t
tcagagctcacgtacacgaccggtgctcgatttagcactcgcacgttgggtttggggagccgcagccctgggattcccagctgtttctgcttgctgatcaggactgcacacagacgacgctcaccatggagtcgtgggctagagtcgttgggttttccttgttgtccttacttttaaaggtgtcctagtgtgtacggtgcgtaggtagtggacggtccggggagtcttagtcgacggtcggtggggacgtcccgtgacgtctctcgtgtcgtagtctntggaacttgtacttcagtccttgtagtncgctacggtcggacctaccaacgtcggagggtacggcgtgggtgtcggtacctgtacgtactcgtaccttgtagctcgagtagttagtttaacttaaagttgcggtaccgtacgtcgggacgggtccggaacgttctcgaacgtctacgtccacgaagtacgacgacggtaanaggtacgtattcggtataccgttagaacggtaatacgaaacttgtacgagaagtcggtanacgttacgtacgtccttagtaccttgtgttacgtttggttacgttacgtgttccccgttcggtacccgtcggggtcttacgggtccggggtaccgtacggtacccggttccgg

SEQ ID NO: 164220 - DNA, 814 bp, Homo sapiens
  misc_feature: GYAE6OF02H0IBU.47.55.E11.1.454.CMB.1.raw
  modified_base (184)..(184): a, c, t, g, unknown or other
  misc_feature (184)..(184): n is a, c, g, or t
tcagagctcacgtacacgaccggtgctcgatttagcactcgcacgttgggttttccttgttgctcttttaaaaggtgtccagtgtgaggtgcaggtagtggagtccgggggagcttagttcagcctggggagtccctgagactctcctggtgtagtctcgtggaactcagtttcagttaccttntggatgacacgtcgggtcccaccaaactccgaggtaatgggcgtaggtggtggtctcgacgtatcaactccgtgatcggacgtagttagttaataaacgttgtacggtcggaccgtacggtagggacggggaccgtagttacgacgctacgtcctaaccgaagacgaaccgaacggaccaaaggtacgtaactacgtacgttaagtaacgttaaggaaaagtacgtaaactaacgtcgtaaggtaacggaacggtacgtaaacggtaacgtaccggtcgtttacgtaacttaagttaccgttagtttcggttacggttttacgtacttcggttcccgtttaccgggtccgggtccggttaaccggttccgggtaccggggtacccggaaccgggttacccggttacggtcgtaaccggtcccgttccgttacccgcgtaacccgtacccgtacccggacccggtaacggaccccgtacgtcccgggttacccctcccggtaccgtcccaccccgtacaacccggtacgaccgtacccgttaccggtccgggttaacgggcccgtaaccggaccgggtcccgggaccgtccgggtccgtcccgtaccggtacggtacccggaacggtaccc

SEQ ID NO: 164221 - DNA, 692 bp, Homo sapiens
  misc_feature: GYAE6OF02JIO7Y.47.55.E11.1.454.CMB.1.raw
  modified_base (235)..(235): a, c, t, g, unknown or other
  misc_feature (235)..(235): n is a, c, g, or t
  modified_base (250)..(250): a, c, t, g, unknown or other
  misc_feature (250)..(250): n is a, c, g, or t
  modified_base (268)..(268): a, c, t, g, unknown or other
  misc_feature (268)..(268): n is a, c, g, or t
  modified_base (273)..(273): a, c, t, g, unknown or other
  misc_feature (273)..(273): n is a, c, g, or t
  modified_base (328)..(328): a, c, t, g, unknown or other
  misc_feature (328)..(328): n is a, c, g, or t
  modified_base (356)..(356): a, c, t, g, unknown or other
  misc_feature (356)..(356): n is a, c, g, or t
  modified_base (544)..(544): a, c, t, g, unknown or other
  misc_feature (544)..(544): n is a, c, g, or t
  modified_base (550)..(550): a, c, t, g, unknown or other
  misc_feature (550)..(550): n is a, c, g, or t
tcagagctcacgtacacgaccggtgctcgatttagcactcgcacgttgggtttggggagcttcagctgtggtagagaagacaggattcaggacaatctcagcatggccggcttccctctcctcctcacctctcactcactgtgcagggtcttgggcccagtcttgtgctgactcacgccctacctcgacggtctcgtcgggaccccggtacggacgtcacatcttcgttgttcgngagcagtctacatanacgaatgatatgtatcgngtacngcaacgtcccacgaccgaccccaactccgtacatacgtaacaaacacgtcgtacncgagccggtcctacggtcgggttacccngggtacccgtacttcgcgttaccgtactacgacggttcgtacggtacctcgtcgaacctcccgtaccgtgaccctcgtaccgtacgggtacggtacccgtcccggggtaccgtaacggtacgtacgggacgtaccggtatttaacgttacgtttaactgggttacgggtagttcgggtctcgggtacnccggtnttaaccgggcgttcgttaccgttacgttaccgggtcggtacgacggttaacgggtacccgtaaacgggttcctacccggttaaccggttcggaccggtttaacccgaacccggtaccccgtaacccgtaccccgttaccggg

SEQ ID NO: 164222 - DNA, 797 bp, Homo sapiens
  misc_feature: GYAE6OF02FT9NY.47.55.E11.1.454.CMB.1.raw
tcagagctcacgtacacgaccggtgctcgatttagcactcgcacgttgggtttggggggaagaggaagactgacggtcctgccacaggtggtgctgggcacggtgggcactcgacacaacatttgcgcctcaactgtcttgctcaccatggagtctgggctgagctgggttttccttgttgcttacttttaaaggtgtcagtgtgaggtgcaggtagtgggagtccggggggagtcgttagttcaggccgtggggacggttaccctggacgacttccttccgtggtagttcgtacttcgtggtaactcgtacgtttcgacgttacccttagttggactggcgtacgtcgggtcccgacctaaaccgtccgtaagggtaacgggggcgtttcggggtacgggttcgggtttccgtacgtaaccggttacgtacctaaacgttcccttggacgttacgggccgttaggtttaagggttttaaattaaaaatttaagttcgggtaccggtaaccggtttccggtacggggaacggggtaccgtaggtttaaccaacgggtctaacgtccgtttaccgaagggaaccgaaaccgtaacgggaaccgtaaacggttaacggtacttaacgttacggtaaccgttaagttaaacggggaactttagaaaacccgtagtttacgaggttaaacgtaggtacgaaaccgtacggttagaccgttacgtacttagtcgttagttacggttttcgtttacgtacgttccggttacccgttccgggtaccggttacccgggttacggg

SEQ ID NO: 164223 - DNA, 814 bp, Homo sapiens
  misc_feature: GYAE6OF02HMV64.47.55.E11.1.454.CMB.1.raw
  modified_base (206)..(206): a, c, t, g, unknown or other
  misc_feature (206)..(206): n is a, c, g, or t
  modified_base (407)..(407): a, c, t, g, unknown or other
  misc_feature (407)..(407): n is a, c, g, or t
tcagagctcacgtacacgaccggtgctcgatttagcactcgcacgttgggtttggggagagaagacaggattcaggacaatctccagcatggccggcttccctctcctcctcaccctcctcactcactcgtgcagggtcttcggcccagtctgtgtcctggactcgacgccctaccctcgacgtcgtccgtccggggacccccggnacggtaccggtccaccgtatcttcgttacgttcgtaggaagtccacgcctaccaataagtaccggaaattgtaacttaagtgttaactacggttacgtaaccgaggtaccgtaacgtacccaaggaccccgtaccccaaacttccgtacgtactacgtaactaagaaactgaacgtcgacgtccgccgtaggaccgggtcncgtacgtacttcgcgtcgtactacgagtcgtacggcctcgactcgccctacgtcgactcaggtcgtaccgggccgtacccgggccgacgggtacgaggtacgttacggtacgttaacttaaccggttagtacgggttacgggtttaacgggttacgggtacgttaccgggacgtaccggtacccggtcgtaaccgttaaccggttccgtttaaccgggtcgggtttaaccgacggggtttccggaaccgggttaaccgttaaccggggtacctacccccgggtttacgttacccgggtaaaccgttacccggaacccgtaacccgggttaaccccaaacccggttccgttaacccggttacccgttaacccgtttcggttacccccggttaccccgttaacccccgg

SEQ ID NO: 164224 - DNA, 866 bp, Homo sapiens
  misc_feature: GYAE6OF02JUS70.47.55.E11.1.454.CMB.1.raw
  modified_base (142)..(142): a, c, t, g, unknown or other
  misc_feature (142)..(142): n is a, c, g, or t
tcagagctcacgtacacgaccggtgctcgatttagcactcgcacgttgggtttgggggccgcagccctgggattcccagctgtttctgcttgctgatcaggactgcacacagagagcctcaccagtggagtcgtgggctagngtcgttgggttttccttgttcgtctttacgtttttaaaaggtgtaccgtaggtgttgaggtgacgtaggtagtcgggtaggtaccgggggtacgtcgtttacgttaccgacggccggttaggggtaccggttccccgtaggtacgtacgttccgttcccgtaggttgttaacgttccgttccgtacggtaagttcgttaacgtttaccgtacgttaccgttcgttaggtacttacggacctacgggttccgggttaccccgaaacccgtaaaccggttacccggtaagggggttaaccgggtaccgttgggtacgggttccggttaccgttaccgtacggttaactaccgtaacgtcgtacgtagtaccggacgtaacgttagtttaagtaaatttggaacggtcgtaacccggttcggacgggttacggggaaccgttactacgaacggttcgaacttcccgtacgaacgtacggaaaccggtaacgtaacgaacgttaacggtaacgtaacgtttgaacgtttacgtaaacgtaacgtaacgaaccgtaaagttccgaaggtaacgtaccggtaaccgtaccgtaacgttcggtaactttcgtacttacggttactttacgtttcgtaaccggtaacgttccggttccgttacccgggttaccggtacgtttaccgggtaccggtaccgggtaacccgaaccggttccggttaggtaacccg

SEQ ID NO: 164225 - DNA, 785 bp, Homo sapiens
  misc_feature: GYAE6OF02FQCE6.47.55.E11.1.454.CMB.1.raw
  modified_base (194)..(194): a, c, t, g, unknown or other
  misc_feature (194)..(194): n is a, c, g, or t
  modified_base (686)..(686): a, c, t, g, unknown or other
  misc_feature (686)..(686): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagttcgtgggactgagtcgttcgggttttcctagtgtcttacgtttaaaggtcgtcagtgtgaggtgntaggtagtggacggttcgggggagtctttagtcacgtcggtgggtacgtcccgtagacgtcctctctaggtgtacgtctacgtaggtacttcgtacgtttacgaacggttttaccttggtacggtactcggtaaccgtcggttaccgggttacccgaaacccgtaaaccggtcccgggtaaagggggtaagggttccgtgggggttacgttcgggttaccgtcgtaaacggttactcggtaacttccggtagtaggttggtaacgttagttaacgtttattaacgttacgggtctccgggttccgtcggggagtttaccgggcttacgttaacgccgttcgtaactcggtaaccgtagaacgaccggtaacgtaacgtaagtaaggtacctaaggttcgttacgtaaggacgtttaaacacgtaacgtagttacgtaacgggtaagccgtagggtaactcgggtaacgtcttaggttaactcgtttacgttntaccggtttggttcgtaccgttcgggttccgtacggtttccgggtaccggttacgggttcgggtacccgggtaaccggttaccggtacggttacccggg

SEQ ID NO: 164226 - DNA, 798 bp, Homo sapiens
  misc_feature: GYAE6OF02J0CVD.47.55.E11.1.454.CMB.1.raw
  modified_base (179)..(179): a, c, t, g, unknown or other
  misc_feature (179)..(179): n is a, c, g, or t
tcagagctcacgtacacgaccggtgctcgatttagcactcgcacgttggggtttggggagcttcagctgtggtagagaagacaggattcaggacatctccagcatggcccgcttcccctctccctcctccaccctcctcactccactgtgctacgggtcttcgggccccagtctgtcgntcgacctcagccccaccgtctagctccgtcgggacccccggacgtacgtcactctcttcgttcgtcgacggacgcgtactacctacgtaatacgaacgtaatagtaataagtcgttaactacgtaccggtacctacgaacgtaaccggtaccccgaacccggaaccccgtaacccctaaaccgtcccctacttaaccgtaactaaacgtaaactacgtaactaccgtaccgaccggtcccggttaccgtacccgggtaccgggttacccgcggtaccgtactttccgtccggtccgtaccaaccggttcgtacgtccgccgtacccacggacccgtccccgtacggtaccgtacctaccgtaccggtaacgggttcccggcccgggtacccgggtaaccggtacggtacgtacggtcgtaactaggttttaacttacgtacggtttacgggtttgggttaacgggttcgaccgttacgaccggttactccgttacgggttacctaccggtttacgtacccgttcggtacgtaccgtcgggtaacgtaccggttcccggttaaccggtccgttaccggttcggaaccgaccccggtacctaaccggtcccctaccctacg

SEQ ID NO: 164227 - DNA, 774 bp, Homo sapiens
  misc_feature: GYAE6OF02F0PTV.47.55.E11.1.454.CMB.1.raw
  modified_base (239)..(239): a, c, t, g, unknown or other
  misc_feature (239)..(239): n is a, c, g, or t
  modified_base (529)..(529): a, c, t, g, unknown or other
  misc_feature (529)..(529): n is a, c, g, or t
  modified_base (537)..(537): a, c, t, g, unknown or other
  misc_feature (537)..(537): n is a, c, g, or t
  modified_base (642)..(642): a, c, t, g, unknown or other
  misc_feature (642)..(642): n is a, c, g, or t
tcagagctcacgtacacgaccggtgctcgatttagcactcgcacgtttggggtttgggggagctgtaggtagagaagacaggattcaggacaatctccagcatggccggcttccctctcctcctcaccctcctcactcactgtcgcgtagggtcttcgggccctagttctgtgctagtaccttacgacgccccaaccctcgacggtccggttccggtacccggggacccccccgggtanaacgggtacccggttacccaacccgttacttcccgttttcgtttggttccgtaagggaaaggtccctacggtacccttaacgaaaacttaccgtaaccgggtaaatggtaattaacgttagttaacctacggtacggtaacctacgtaaccgaaccgtaacccgaaccggaaccccgtaccccctaacctcctacgtactacgtaactaaccgagtacgacgtcgacgtccgtccgtcgggtaccggtccgtacgtacgtcttcgtgaccgtactacgtagtcgacgccncgtcgacncccgtacgtcgactatcgtcggtaccggcgtaccggtacggagtactacggtacgtcgtattcgtttaacgtcgttggttaggttcggtaagtccgacgtaccgngttcgtacgtacgttcggtacgtttacgtacggtcgtaccgtcggtaacggtccgtacggtcccggtaccgttacggtaccgtaccgaccgtaacccggaacccgtcccaccgtccgttactacctcccggg

SEQ ID NO: 164228 - DNA, 715 bp, Homo sapiens
  misc_feature: GYAE6OF02IYHDB.47.55.E11.1.454.CMB.1.raw
  modified_base (115)..(115): a, c, t, g, unknown or other
  misc_feature (115)..(115): n is a, c, g, or t
  modified_base (118)..(118): a, c, t, g, unknown or other
  misc_feature (118)..(118): n is a, c, g, or t
  modified_base (139)..(139): a, c, t, g, unknown or other
  misc_feature (139)..(139): n is a, c, g, or t
  modified_base (403)..(403): a, c, t, g, unknown or other
  misc_feature (403)..(403): n is a, c, g, or t
tcagagctcacgtacacgaccggtgctcgatttagcactcgcacgttgggtttgggagccgcagccctgggattcccagctgtttctgcttgctgatcaggactgcacacagagngcncacatggagtcgtgggctggngtcgttcggtttcctgtcgcttactttaaaggtcgtacctgtgtaggaggtgcgtaggtaggtaggtcggtaccggggagtcttaggtcgacgtcggtgggactcctgacggtctccgtcgtgtagtgtactcgtgtactacgtagttcgacgttaccgttgtaggtatctacgtacggttccggtcccgaaccgaacttaccgggaacggtacggcgttacggtcgtggtacctcgtacgtctacgtaacgtctagtcgtcgntacggtatacgtaatcgtacggacgtccgtacgggtacgtacgtagttacaacgtcagtcgtacgacgacgtaacgacgtagacgtactacgtacgtcgtagtacgtagaacgtacgtaacgtaacgttgacggttagacgtaacgtacggtacgaccgtttagacggttactaacgtttcgttacgtttcggttaccggtttcgtaaccggtttacggttacccggtttcgggtaacccggtttacccgggttaacgggtttcccgggaaacccggttccggggtttaaacccgggtccccgttaaccggg

SEQ ID NO: 164229 - DNA, 787 bp, Homo sapiens
  misc_feature: GYAE6OF02FZCJB.47.55.E11.1.454.CMB.1.raw
  modified_base (615)..(615): a, c, t, g, unknown or other
  misc_feature (615)..(615): n is a, c, g, or t
tcagagctcacgtacacgaccggtgctcgatttagcactcgcacgttggggtttgggggccgcagccctgggattcccagctgtttctgcttgctgatcaggactgcacacagagagctcaccatggagtcgtgggctgagtcgttcgggttttcttgttgcttacgttttaaaaggtcgtccgaggtgtggtacgggtgacgtaagggttaggtgggacgggtaccggggggtagtccgtttaaggttccacggcccggttagggggtacttcccgtaggacgttacctcgttccgttggttaggtacgttccgttcgtaggtaacttcgtaacgtttacgaacgttaccttcggtggtacttcggacgttaccggtccgggtacccaaccctaaacggtccgggtaaggggtacgggtcgttggggttcggtacggtacctacgtagtactacaacgtcgtagagtcggataggttagttaattagtaggtcgaccggtacgtcggtagggacgggtacctataccggatctacgctacggaagtaacgaccgtagagaagttaacgtacgtacgttagtaataacggtaagttaaacgtacgaaacttacgngtaacggtacgaccggttacgaaccggtaccgtacgtcgtaacgttccttaagtcgttttacttgggttttaccggttgtaccggtttccgttaaccccggttggggtaccccggtagggtttacccgggttcgggtaacccggggacccgttaacccgggttccggtacgg

SEQ ID NO: 164230 - DNA, 924 bp, Homo sapiens
  misc_feature: GYAE6OF02H1PKC.47.55.E11.1.454.CMB.1.raw
tcagagctcacgtacacgaccggtgctcgatttagcactcgcacgttgggtttgggggccgcagccctgggattcccaactgtttctgcttgctgatcaggactgcacacagagagctacaccatggagtctgggctgagtcgttcggggtttttccttgttgtacgttacgtttttaaaaggtcgtacctaggttggtaggtaggtgacgtagggtaggtgggacgggtccggggggaggtcgttacggttcgacggtccggtggggtacgttcccgtagagtaccttcgttccgttaggtgtacggtctacgtaggtaacttacgtagtttaccgacgtttacccttacgtaggacttcgaccgtacggttacccggggttacccaaccccgttaaaaccgtcccgggttaaagggggttaaccggggggtccgttggggttacggggttccggtacccgttacggttaaccggttattaaccccggtaacgttcccgttaagggacgtcgggtacgttaacgtttaagtttaaagtttaaaacgttacggtaccgggtaccggtaccgtttccgggtaacggggtaaccggggttacccttaagttaccggtacccgtaccgtttaaccgtacgtaaacccgggagtaaccgggtaacggaaacggtaacgtaaacgtaagttacgtacgtttagttactaacgggtaagtaacgttaaacgaaacgttagtaccgtaagggtaacgtaccgggtacgaacgtacggttaccgtacgttcgtacttaacgttacgtttaacgtttcgttttaggtttaccgtacggtttacccggttccggttaccgggttcccggtacgggttttaccggttacccggggtacgggtacccgggtaaccgggttaccgggttccgtacgg

SEQ ID NO: 164231 - DNA, 727 bp, Homo sapiens
  misc_feature: GYAE6OF02HJ660.47.55.E11.1.454.CMB.1.raw
  modified_base (507)..(507): a, c, t, g, unknown or other
  misc_feature (507)..(507): n is a, c, g, or t
  modified_base (627)..(627): a, c, t, g, unknown or other
  misc_feature (627)..(627): n is a, c, g, or t
  modified_base (643)..(643): a, c, t, g, unknown or other
  misc_feature (643)..(643): n is a, c, g, or t
tcagagctcacgtacacgaccggtgctcgatttagcactcgcacgttgggtttggggcccgcagccctgggattcccagctgtttctgcttgctgatcaggactgcacacagagagctcaccagtggagtcgtggctgagtcgttcggttttccttgttgctttacgttttaaaggtgtaccaggttgtggaggttgcgtaggtaggtgggagggtccgggggagtcgttaggttcgagtccggtagggtacgttcccgtgacgaccttccttcgttgtacgttcgtcgtcgtaggaacttaccgtggtttactaccggttaccttcgtaggtactcggcgtaccggttcggtacccgtacccaaacggtccggtaaggggtaacgggtcgttgggtggtcggtcctacgtccttaagtacctaacgttcgtgtcgtgaccgtgttaagttaacgtaagttactaggtccgtacgtcggtaggaccgggtactacgtcgactaccgngttaccgagtacggaaacgtacgaaccgagtaaagttacgtaagtccgtataaccgtaggtaaagaagtaccaaagtcgtcaggacgtaacgtcgaagccgttagctaagttctacgttntaccgttttgtccgtnttacccggtcccgttaccgggcggttaccggtttcgtacccgggttacccgggaacccgttacgggtacccttgggtaaccccg

SEQ ID NO: 164232 - DNA, 751 bp, Homo sapiens
  misc_feature: GYAE6OF02F991B.47.55.E11.1.454.CMB.1.raw
  modified_base (176)..(176): a, c, t, g, unknown or other
  misc_feature (176)..(176): n is a, c, g, or t
  modified_base (223)..(223): a, c, t, g, unknown or other
  misc_feature (223)..(223): n is a, c, g, or t
  modified_base (615)..(615): a, c, t, g, unknown or other
  misc_feature (615)..(615): n is a, c, g, or t
tcagagctcacgtacacgaccggtgctcgatttagcactcgcacggttgggtttggggagcttcagctgtggtagagaagacaggattcaggacaatctcagcatggccgcttccctctcctcctcaccctcctcactcactgtcgcgtagggttcgtcgggccctagtctgtcgntcgactcacgccctaccctagacggtcgtcggtccggggaccccggngaacggtacggaccaccgtattccttcgtttgtacgtacgggaagtccacggtcctaccgtaaatacgaacggtaatcgtaaattagtattaacgtcgtacggtaacagtaccgaaccgtaccccaaacggacccggtaacccctaacgtcctaacgtacttactaactaaacagtcgacgtcaccgggtacctaccgtcggtaaccggtcccgtaagtccgtacgtttcctacggtacctccgtaaactcggtcgaccgtccgtaccgtaccaccgtacccgcgtaaccggtcctcgaacgggttacgtccgggtacccgtccgggaacggtggtacgtacggacgggttactacgttattacgttaccgtggttaacggtgggttacggntaccgacgccgttacgcgttaagccgttttaacgcttcgggtacggacgtcggggtaacgtaacccgtacgggttacccctacggtagggtccgttaaccacgggtacccctaaccgtcccccgtaaccgttccgg

SEQ ID NO: 164233 - DNA, 897 bp, Homo sapiens
  misc_feature: GYAE6OF02HNYF5.47.55.E11.1.454.CMB.1.raw
  modified_base (197)..(197): a, c, t, g, unknown or other
  misc_feature (197)..(197): n is a, c, g, or t
tcagagctcacgtacacgaccggtgctcgatttagcactcgcacgttgggtttgggggccgcagccctgggattcccagctgtttctgcttgcctgatcaggactgcacacagagagcctcaccagtggagttcgtgggctagagtcgtttcgggttttccttgttgtcttacgttttaaaggtcgtctagtggtgnggtgcgtaggtaggtaggtcgggtccgggggagtcgttacggtcgcggtccggtaggggtacttcccgtaggacgtacgtccttcgtagttcgtcgtctcgttagtagttcgtaacgtttactacgttaccgttcgagtacgtacgtccgtacggtcggttacccgaaccgtaaccgttccgggtaagggttaacgggggtcttaggggttcggttcggttaccgtaaccgttacgttaacgtaccgttaaccgtccgtacggttaggtacggtacgtttagggttaaactttaaaggttaaacgttttaggtccgggtaaccggttacggttaaccggggtacggggtaaccggggtacgttaacgttcgtaacccggacgttaccgttaccgtaaccggaacggtaccggaaacccggtaaacggtaacggaaaacggtacgtttaaaccgttaacgtttaggttaacggttaaaccggaaaggttaaaccgttaaacgtaaaagtaccgttaacggttaaagggtacccggttaaacggaccggtaaaccggtacgttaccgttaaccgtagttacttacgttagtttcgttttacggttcgttaagttcccgttaccgggttcccggtttaacccgggtccggtttacccggcgggttaccgggtaccgggtaaccggttcccggtacggttacgg

SEQ ID NO: 164234 - DNA, 774 bp, Homo sapiens
  misc_feature: GYAE6OF02GKEVJ.47.55.E11.1.454.CMB.1.raw
tcagagctcacgtacacgaccggtgctcgatttagcactcgcacgttgggtttgggggccgcagccctgggattcccagctgtttctgcttgctgatcaggactgcacacagagagctcaccatggagtctgggctgagcgtggtttccttgttgcgttatttaaaggtgtccagtgtgaggtagcgagtaggtggaggtccgggggagtctttaggttcacgtccggtggggactccctggacgacgttccgtccgttgtgtaacgttctcgtggtaatcgttacgtttctaagtacctttcgtaggagtcgactacggtccgggtacccgaacctaaaacgtccgtaaggggtaacgggtcgtcgggttggtgggtcctacgtagtactacgtaacgtcctagacgtgaacgtagttagttaattaacgtagtcggacggtacttcggagggccggggtacttataccgaacgcgtactcgtaacggagacaaccggaacggataaacggtagtaacttacggtagtttacgtacgtaaggttaaaactacgtaaactaacgggttctaacgggtaagggtaaacccgtaggtaaaccggtacgtttaacgggaccgtttacgaacgttaaacgtttcctttaaccgggttttttcttaccgggttaaggttacccgggttaccgtttcccgggggacccgggttacccgtttcgggtttacccggggaccgggttaaaccgggtaccccggtacggtttaaccggtaccgg

SEQ ID NO: 164235 - DNA, 849 bp, Homo sapiens
  misc_feature: GYAE6OF02FGBHN.47.55.E11.1.454.CMB.1.raw
  modified_base (209)..(209): a, c, t, g, unknown or other
  misc_feature (209)..(209): n is a, c, g, or t
tcagagctcacgtacacgaccggtgctcgatttagcactcgcacgttgggtttggggagcttcagctgtggtagagaagacaggattcaggacaatctccagcatggccggcttccctctccctcctcaccctcctcactcactgtgcaggtcttggcccagtctgtgctgctcagccacccctcgagtcgtctcggggacccccgggnaggtaccggtcaccgtatctctttacgttccaggtaagcaagtccgtaccctaaatctacgggtaaaactggaaattaactggtaataccgttagggtacccaggtctaaacggtccccaaccggtaaccgggacccccctaaaacgttccctactacgttaccctaaagtaaactaacgtaggaaacttccggaacgtccccgggtaccccccgttagtaaaccccgggggggttcccccgttcgggtaccccggttaacctttccgtcccggttagggtcccctaaccccgtaaggttcccgtcgggggtaccctcccgttaaccaccgtccccgtaaccccggtgacccgtactacgtacgggtcggggacctcccggggtaccccggaggacgttaggacgtcggtacgttagtttaaccgttacttcgggtttcggaacggggttttacgggacggttctaacgggcgttaccgggttagccgtttacgtccgtttaaaccggttccgttaccgggggactaccgggtttaaccggggaaccgtaaccggggttcccgttaaccccggtttccgaaccggggtttaccgttaaccggacccccggtttaaaccgggaccctaaacccccgtacgg

SEQ ID NO: 164236 - DNA, 781 bp, Homo sapiens
  misc_feature: GYAE6OF02FKQLO.47.55.E11.1.454.CMB.1.raw
tcagagctcacgtacacgaccggtgctcgatttagcactcgcacgttgggtttgggggagagaagacaggattcaggacaatctccagcatggccggcttccctctcctcctcaccctcctcactcactgtgcagggtcttcggcccagtctgtgctcgactcacgcccaccctcagccgtcgtcgggacccccgggcacgacggtcaccatccttcttcgttacgtggtaacgcaggctaccaattagtacggaaatgaattaagtagtatacgtaggtaccacgacaacgtacccaacggaacccgacccccaaaccgtcctacaactctaactaactaatagactcacgtccggtccgtccgaccgggtcccgtgtacccgtacttccgtcgtcgcctaccgtacgtcggtcggccgtcctcccgtaccgccctacccgttcgccccttaacggtcccgtacgggtccgggacccgtcccgggaccggacggtacgtacgggcgtaccgttacgtacgtttaggttaccgttgggttagggttagggtttacgggtacgttaccggtcgtccggttaccttcggtaccgtttaccggttcgtttaaccggttccggttaccggtaccgggttacgtccgggaacgttaaccggttccggtacccggttaaccgtacggaacccggtaaccgaacccggttaaccggaacccctaacccggttaccgtcccttaaacccggttcccttaaccccttcccggttacccccgttacccccg

SEQ ID NO: 164237 - DNA, 878 bp, Homo sapiens
  misc_feature: GYAE6OF02I9I9Z.47.55.E11.1.454.CMB.1.raw
  modified_base (236)..(236): a, c, t, g, unknown or other
  misc_feature (236)..(236): n is a, c, g, or t
tcagagctcacgtacacgaccggtgctcgatttagcactcgcacgttggggtttggggagcttcagctgtggtagagaagacaggattcaggacaatctccagcagtcggccggtcttccctctcctcctccaccctcctcacctcactgtcgccgagggttcgtacgggccctagtctggtcgctgacctcgacgccctaacccgtcacggtcgtccgtccggggaccccggganacggacgtccaccatccttcttgtacgtaggacgcacgcctaccaagtacggtacgaagtagtaatagtagtaactacttggaaaccctaggaccaaaggtccccaaacggaaccggtaccccccaaaatcccgtaaccaacttccgtaactaacgtaactacgaacttaccaacggtacccgggtacccctacgaacgggggttaccccttacggggaccccgtaactttcccgtaccggtacggtacccgttacccgaaacggttcccttaacggggtcccgtacccgttacggtaaaccgccccgtaaacccgttccgggaccctaacgttaccgaaccggtacgggtaccggtacccggggaccggaacgggtaaccggtacgggtaacgggtaccttacgggtaacgttttaaacgtttaaccgttagggttaacggttaacgggtttacggggtaacgttacccgggtaccgtaacggtacccggttacgtaccgttaccggtacctttaaccggttcgttaccgggtatacccgggtaggaacccgttaacgggtacctaacccgggttacgttaacccgggtacccgtaaccggtaaccccgtaaaccggtaccccgtaaaccccggtaaccgg

SEQ ID NO: 164238 - DNA, 726 bp, Homo sapiens
  misc_feature: GYAE6OF02HOHN1.47.55.E11.1.454.CMB.1.raw
  modified_base (214)..(214): a, c, t, g, unknown or other
  misc_feature (214)..(214): n is a, c, g, or t
  modified_base (286)..(286): a, c, t, g, unknown or other
  misc_feature (286)..(286): n is a, c, g, or t
tcagagctcacgtacacgaccggtgctcgatttagcactcgcacgttgggtttggggagcttcagctgtggtagagaagactaggattcaggacaatctaccagcatggccgcttccctctcctctcaccctcctcactcactgtgctagggtcttgggccctaggtctggtgctgactcacgccaccctcacgcgtccgtccgggaccccggnacgacggtccacactccttacgttcgttcgaggaactcacgtcctacaatacgtacggaatcgtaataagtntaatacgtggtaccagacctaacgtcccgaaccggtaacccgaacccctaaccttccgactacgtacctaactaaactactacgtactacgacggtaccggtaccctacgggtcccgggttaccgtaccggtccgttacttccgttacgtcggtacctacccgaacggttcgtacggtcccgtccacgtaccctcccgttaaccgcgaccttacgtcggacgggtccggtcccggtcccgggtacggacgtacggtggaacggtcgttaacgtatttacgtacgtgggtaggttcgggtaggtacgtcgacgtacgtccgtacgttcgtacgttacgttccgtcgtacggtacgtcggtaacggtaaccgtaccgggtcccgttaccgtacggtacggttcccggaaccggtacccgttaaaccgccctaacccgtacgg

SEQ ID NO: 164239 - DNA, 835 bp, Homo sapiens
  misc_feature: GYAE6OF02F4VD1.47.55.E11.1.454.CMB.1.raw
tcagagctcacgtacacgaccggtgctcgatttagcactcgcacgttgggttttccttgttgctctttaaaaggtgtccagtgtgaggtgcaggtagtggaggtccgggggaggcttagttcagcctggggagtccctgagactctcctggtgtagtctctggaatctagtttcagttaccttctggatgcacgtgggtcccgaccaaactccgagggtaacggggctgggtggtcgggtcctcgacgttactactaactcccgtagtagtcggtctaggttacgttaaagtaaattacgtcgggccggtaccgtccgtagggacgggggtaccgggttaccacctacgttccaccgtaagaacgactaatttaccgagggtacgtccaaccggtcttagttaacgtaccttaaacgaaaacgtacgaaaactaccggtaccgtaggtaacggacggaaccgggaacggaaccgaaccgggtaccgttaacttagttttccgtagggttacgaaacggtaacgttacttaaggtacctaacggtaccggttacccgtacccccgtcgtaccgtacccgtttacctttccgtttaccgttacgtttacccggggtaccgggggtaccggtaacgggtaccttcccggtacggttcccgtaccccgttacctacccgaaccgtcccgtacccttacccggacccgtacccggacccgtccgttcccggttccccgtcccggtccggtcccgtcccgtcgtccggtacccgaggtaccgtacccgacccgtcggtaaccgccgtacgaccggtcggaccccggtcccggtagtcccgg

SEQ ID NO: 164240 - DNA, 749 bp, Homo sapiens
  misc_feature: GYAE6OF02IHD3B.47.55.E11.1.454.CMB.1.raw
tcagagctcacgtacacgaccggtgctcgatttagcactcgcacgttgggtttggggggaagaggaagactgacggtcctgccacaggtggtgctgggcacgggtgggcactcgacacaacatttgcgctcaactgtcttgctcaccatggagtctgggctgagctgggttttccttgttgcttacttttaaaaggtgtacctaggtgtgtaggtgcgagggttaggtggagggtaccggggggaggtctttagttcacggtccgttggggacgtacccgtgagactcctccgttagtgtacgtctactggaatctagtttcacgttaccttcgtggtatcgacctacggttcgggtcccacctaacctaccggtaagggtaacggggtcgtgggtcgggttcgggtactccgtacgtatactaacgtcctagtagttcggtacgtaagtttagttaaattaaattgtacggtaccggtaccgttcgggttgggaaccgggtccgtaattccgaacgtctacgtaccgtacgaaggtaaccgaaccggaaacgggtaactaaacggttacgtaacttaaccggtagtaaccgttacgtaaaaggtaacttacggaaacttaattcggtaacgaggtaacggtacgtaacgtacggtaccgttacgtcgttaagtactttgttacgttttagttcggtttaccgacgtttccgtaaccgggtttccgggtcccggttacggttacccggg

SEQ ID NO: 164241 - DNA, 190 bp, Homo sapiens
  misc_feature: GYAE6OF02JFI4C.47.55.E11.1.454.CMB.1.raw
  modified_base (179)..(190): a, c, t, g, unknown or other
  misc_feature (179)..(190): n is a, c, g, or t
tcagagctcacgtacacgaccggtgctcgatttagcactcgcacgttgggtttggggggaagaggaagactgacggccctgctccaggagcacctccgagagcacagcggccctgggctgcctggtcaaggactacttcctacggtgagctctgacggcgggctggacaggcgcatagnnnnnnnnnnnn

SEQ ID NO: 164242 - DNA, 710 bp, Homo sapiens
  misc_feature: GYAE6OF02IEWZ0.47.55.E11.1.454.CMB.1.raw
  modified_base (290)..(290): a, c, t, g, unknown or other
  misc_feature (290)..(290): n is a, c, g, or t
tcagagctcacgtacacgaccggtgctcgatttagcactcgcacgttgggtttgggggccgcagccctgggattcccagctgtttctgcttgctgatcaggactgcacacagagagctcaccatggagtctgggctgagctgggttttccttgttgctcttttaaaaggtgtccagtgtgaggtgcaggtagtggaggtccgggggaggtcttagttcaggccgtgggggactccctgacgactcctctgtgtagtctcgtggaattccgtagtttcagttacctttcgnggtattcgcacgttgggtcccaccaaacgtccgaggggtaacggggtcttgggtggttggggtccttacgaccggttatacctaatccgttagagttcggactagttagtttaaataaattagtcggacggtacgtccgggttaggaacggggtccgttattacgacgtactactttcgacgtaggaacggaactaacgggacaaaggtagtatacgttgtacgttacgtagggtaaaactacgaaactagtacgtaggtaaggtacgtaccggtaacgtaacgtacggtcttaggtaccttagttaccgttagttttcggtttcggttttcgaacgtttcggttccccggtttccggtccgggttacgggttccggtttaccgggtccggggtaccgtacccggggtaaccgttcgggg

SEQ ID NO: 164243 - DNA, 865 bp, Homo sapiens
  misc_feature: GYAE6OF02JWCB9.47.55.E11.1.454.CMB.1.raw
  modified_base (91)..(91): a, c, t, g, unknown or other
  misc_feature (91)..(91): n is a, c, g, or t
  modified_base (147)..(147): a, c, t, g, unknown or other
  misc_feature (147)..(147): n is a, c, g, or t
  modified_base (282)..(282): a, c, t, g, unknown or other
  misc_feature (282)..(282): n is a, c, g, or t
tcagagctcacgtacacgaccggtgctcgatttagcactcgcacgttgggttttccttgttgctcttttaaaaggtgtccagtgtgaggtncaggtagtggagtccgggggaggcttagttcagcctggggatcccgtgagtacctntcctgtgtagtctctggaatctagtttcagtaccttctggatgcactcgggtccgaccaactccgtaggtagggtctaggtgtaggtctcgacgtatcaattccgtagatcggactagttagttaactaaagttncggacggcctaccggtggaccggggtccttagttccaacggtctactcgtacgagtaaacgaccgtaacggaacaaggtaacgtacttaacgtacgtttagtaccggtaagggtaaaactacgaaaacgttacgttaccgaagggtaagtaccggttaccgggaaaccttaaggtaacgttcgttacgttacctaaacgtccgttaagttttcgggtttattttacccgggatttccggtttaccgttaccggtcggttaacggtacccggtttcggtaacggcccggtaacgggtaccgttaggtccgttacggtccgttacccgttccgtacgtacccgtcccgtaacccgggtaccgtaaccggggtaccctacgggtttaccccgtcccccggtttcccccggcggttaccccggtccccttaggttacccccggtacgggtaaccgttaccccgggtaccccttaaccggacccgggtttaaccgacggttaaaccccgcccggttacgggtaccccggttcccgggtaaccgggttcccgtaaccggggtttcccgtaacggttacccggtaaccgg

SEQ ID NO: 164244 - DNA, 637 bp, Homo sapiens
  misc_feature: GYAE6OF01AMXI2.43.23.C01.1.454.CMB.1.raw
tcagtgtgagtagtcacgaccggtgctcgatttagtacacgtgattagggagttggggtctggcgccaggggtcccttccaatatcagcaccatggcctggactcctctcttctgttcctcctcacttgctgcccagggtccagttctcagactgtggtgactcaggagccctcactgactgtgtccccaggagggacagtcactctcacctgtgcgttggtggctggaccagtcaccagtgcttaccatccaaactggttccagtcagaagcctggacaaggccccacggcactcgattacgtggtgcgactaacaacacgtcctacgacccctacgtccggtttcacggctccctcgtcggggacaagctgcctgacactcgtcgagtcgtagcgacgcgtgacggtacgacggtctagtacgtacttaacgtcgtccttaggctacgacgttagtaagtcggggtcggaccggtccggttaggggttcgggttaccggggccgggtacgggtacccgtaaggtcgtacggtaccggtccgttggggtaccacggaccctaacggggcctaacccggtcccccgttacggtaccctacccgtttacttcccggttcccccgtacccgttaccccg

SEQ ID NO: 164245 - DNA, 571 bp, Homo sapiens
  misc_feature: GYAE6OF01EX9O3.43.23.C01.1.454.CMB.1.raw
  modified_base (425)..(425): a, c, t, g, unknown or other
  misc_feature (425)..(425): n is a, c, g, or t
  modified_base (494)..(494): a, c, t, g, unknown or other
  misc_feature (494)..(494): n is a, c, g, or t
tcagtgtgagtagtcacgaccggtgctcgatttagtacacgtgattagggagttggggtctggcgccaggggtcccttccaatatcagcaccatggcctggactcctctctttctgttcctcctcacttgctgcccagggtccagttctcagactgtggtgactcaggagccctcactgactgtgtccccaggagggcgagtcactctcacctgtgcgtttggtggctggaccagtcaccagtgcttaccatccaaactggttccagcacgaagcctggacaaggcccacggcactgatttatgggtgcgactaacaaacactcctaggacccctgcccggttttcaggctccctccgtcggggcaaagctcgccctgacacgtgtccaggtgtgcagcctggacggacgaggctgactattacngcctgctcatatactgggtggcgcggtgggtgttcgggcgggtacgggacaaggcgtggaccgttccgngggttcgacggtcccgaagggtcctacggtccccccgtacggtccctacttccgttcgttcccccgacccttccccg

SEQ ID NO: 164246 - DNA, 538 bp, Homo sapiens
  misc_feature: GYAE6OF01EB48X.43.23.C01.1.454.CMB.1.raw
  modified_base (313)..(313): a, c, t, g, unknown or other
  misc_feature (313)..(313): n is a, c, g, or t
  modified_base (327)..(327): a, c, t, g, unknown or other
  misc_feature (327)..(327): n is a, c, g, or t
  modified_base (375)..(375): a, c, t, g, unknown or other
  misc_feature (375)..(375): n is a, c, g, or t
tcagtgtgagtagtcacgaccggtgctcgatttagtacacgtgattagggattggggaaagcatcatccaacaaccacatcccttctctacagaagcctctgagaggaaagttcttcaccatggactggacctggagggtcttctgcttgctggctgtagctccaggtaaaggccaactggttccaggactgaggaagggtattttttccagtttagaggactgtctatttttctactgtgtcctctccgcaggtgctcactcccaggtgcagttggtccagtctggggctgaggtgaagagcctggggcctnagtgaaggtttccngcaaggcatctggatactccttcacgacctactacattcactgggtcncgacacggcccctggacagggtacttggagtggagtgggaatatcactccgtagtagtggtgccacaactacgcacagaacgttccgaggcagacgtcaccagcggaccgggacacgtccacgaccgacggtctacgagtcggacgcgtagagcagccgtacg

SEQ ID NO: 164247 - DNA, 667 bp, Homo sapiens
  misc_feature: GYAE6OF01DM31W.43.23.C01.1.454.CMB.1.raw
  modified_base (222)..(222): a, c, t, g, unknown or other
  misc_feature (222)..(222): n is a, c, g, or t
tcagtgtgagtagtcacgaccggtgctcgatttagtacacgtgattagggagttggggtctggcgccaggggtcccttccaatatcagcaccatggcctggactcctctctttctgttcctcctcacttgctgcccagggtccagttctcagactgtggtgactcaggagccctcactgactgtgtcccaggaggacagtcactctcacctgtgcgtttggnggctggaccagtcaccagtgacttaccatccaaactggttaccagcagaacgcctaggacaacggccccgacggcacgtcgtatttagtgggtgacgactaaacaaacacgtcctacggacccctcggtcccggtttcgacggtcctccctccgtacggggtacaaacggctcgaccctgtaaccgacgtacggtcgtaaggtcgtgacgacgccgtaggacggacggacggcgtagaacgttaagttacgtacgtacctggctactaatagtacgttgggtcgggtcggtacggttgggggtacggtttaccggggacgggtacggggtaaccaacggtccgtacggtaccgtccggtagggtaccgacggtacccgaacgggtccgtaccgtcccccgttacgggtacctacgttacccttccgttaccccctcccgtacccg

SEQ ID NO: 164248 - DNA, 562 bp, Homo sapiens
  misc_feature: GYAE6OF01AZ5NQ.43.23.C01.1.454.CMB.1.raw
  modified_base (270)..(270): a, c, t, g, unknown or other
  misc_feature (270)..(270): n is a, c, g, or t
tcagtgtgagtagtcacgaccggtgctcgatttagtacacgtgattagggattggggaaagcatcatccaacaaccacatcccttctctacagaagcctctgagaggaaagttcttcaccatggactggacctggagggtcttctgcttgctggctgtagctccaggtaaagggccaactggttccaggactgaggaagggtattttttccagtttagaggactgtctattttctactgtgtcctctccgcaggtgctcactcccaggtncagttggtccagtcgtggggctggaggtgaagagccgtggggcctcgaggtgtaacggtttcctgcgaaggcatcgtaggacttaccgtccttcacgtacctactacattcacgtgggtgccgacgacggcccctaggaccagggtacttgaggtggagtagggaatatcactcctagtagtggtcgaccaacaactacgacacgagaagttccgaggacagacgcacagcggaccgggacaccgcccgacgaccacggtctacgacgtggacgtacgtgagcgcgccgtag

SEQ ID NO: 164249 - DNA, 633 bp, Homo sapiens
  misc_feature: GYAE6OF01DJOBR.43.23.C01.1.454.CMB.1.raw
  modified_base (222)..(222): a, c, t, g, unknown or other
  misc_feature (222)..(222): n is a, c, g, or t
  modified_base (440)..(440): a, c, t, g, unknown or other
  misc_feature (440)..(440): n is a, c, g, or t
tcagtgtgagtagtcacgaccggtgctcgatttagtacacgtgattagggattggggtctggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggnggctggaccagtcaccagtgcttaccatccaaactggttccagcagaagcctggacaaggccccacggcactgatttatggtgcgaactaaacaaacactcctcggacccctgtcccggtttcaggcctcccgtccgtcgggggacaaacgtctcgccctgacctactcgtcgacggtgtcgcagccgtaggacgggacgaggctagacttagttacngccttgctcattatagtggtcggcgcggttgggtcggttcggggacgggaacgggtaccgaaggtccgtacggacccgtccggttacgggtccgaaccggaccccgaaacggggttccctcccgggtcccccccgttacgggttccctaacccgtttccgtacccgtttcccccccgtaaccccgtttccccc

SEQ ID NO: 164250 - DNA, 549 bp, Homo sapiens
  misc_feature: GYAE6OF01C4566.43.23.C01.1.454.CMB.1.raw
  modified_base (327)..(327): a, c, t, g, unknown or other
  misc_feature (327)..(327): n is a, c, g, or t
  modified_base (373)..(373): a, c, t, g, unknown or other
  misc_feature (373)..(373): n is a, c, g, or t
  modified_base (540)..(540): a, c, t, g, unknown or other
  misc_feature (540)..(540): n is a, c, g, or t
tcagtgtgagtagtcacgaccggtgctcgatttagtacacgtgattagggattggggaaagcatcatccaacaaccacatcccttctctacagaagcctctgagaggaaagttcttcaccatggactggacctggagggtcttctgcttgctggctgtagctccaggtaaaggccaactggttccaggactgaggaagggtattttttccagtttagaggactgtcattttctactgtgtcctctccgcaggtgctcactcccaggtgcagttggtccagtcgtggggctgaggtgaagagccgtggggcctgagtgaaggtttccngcaggcatctgatactcctcacgacctactacattcacgttgggcncgacacgggcccctggacagggtcttggagtggagtagggaatatcatccgtagtagtggtcgaccacaactacgacacgacgaacgttccgagggcagacgtacaccagtacggaccgggacaccgtccaccgaccgacggtactacgagtggacgtctaggagcngtccgtacg

SEQ ID NO: 164251 - DNA, 595 bp, Homo sapiens
  misc_feature: GYAE6OF01CEVAF.43.23.C01.1.454.CMB.1.raw
  modified_base (586)..(586): a, c, t, g, unknown or other
  misc_feature (586)..(586): n is a, c, g, or t
tcagtgtgagtagtcacgaccggtgctcgatttagtacacgtgattagggattggggaaagcatcatccaacaaccacatcccttctctacagaagcctctgagaggaaagttcttcaccatggactggacctggagggtcttctgcttgctggctgtagctccaggtaaaggccaactggttccaggactgaggaagggtattttttccagtttagaggactgtctattttctactgtgtcctctccgcaggtgcctcactcccaggtgcagttggtccagtcgtggggctggaggtgaagagccgtggggcctcgaggtgaaggtttcctgacgaaggcagtcgtggactacctccttacacgtacctactacacttcgacgtgggtcgcgacgtacggccccctagggaccgagggtaccttggaggtggtagtagggtaatatcactacccgtagtagtggtcgaccacaaactcgacaacgagaacgtaccgaggacagtacgtccacgtagtacggaccgggacaccggtaccaccggaccgtaccggtactaacgacgtacggacgtcgtacggagacngtccgtacg

SEQ ID NO: 164252 - DNA, 652 bp, Homo sapiens
  misc_feature: GYAE6OF01C8HPW.43.23.C01.1.454.CMB.1.raw
  modified_base (302)..(302): a, c, t, g, unknown or other
  misc_feature (302)..(302): n is a, c, g, or t
  modified_base (319)..(319): a, c, t, g, unknown or other
  misc_feature (319)..(319): n is a, c, g, or t
  modified_base (342)..(342): a, c, t, g, unknown or other
  misc_feature (342)..(342): n is a, c, g, or t
  modified_base (383)..(383): a, c, t, g, unknown or other
  misc_feature (383)..(383): n is a, c, g, or t
tcagtgtgagtagtcacgaccggtgctcgatttagtacacgtgattagggtagttgggggtctggcgccaggggtcccttcccaatatcagcaccatggcctggactcctctctttctgttcctcctcacttgctgccagggtccagttctcagactgtggtgactcaggagccctcactgactgtcgtccccaggagggacagtcactctcacctgtgctttggtgctggaccagtcaccagtgcttacatccaaactggtccagcagaagcctggacaacggcccacggcactgatttangtgcgaactaacaaacnctctcggacccctgcccggtttnaggctcccgtccgtcggggacaaaggctcgtccctgaaccnctgtcaggtgtgctacgccgtggacgggacgagggtctacggtaacttaacgttacctcgtccgtcgtcctactaagttagttaaggttcgggttcgggtccggtacgggttggggttcgggttcggggcgggaacgggtaacccgaaggtccgttacggtacccggttccggtcgggttaccgaccggacccgaaacggtcccgtcccggcccccgttccgggtaccctaccgttcccgttcccgttcccccggtccccttaaccccg

SEQ ID NO: 164253 - DNA, 658 bp, Homo sapiens
  misc_feature: GYAE6OF01DLDCR.43.23.C01.1.454.CMB.1.raw
  modified_base (395)..(395): a, c, t, g, unknown or other
  misc_feature (395)..(395): n is a, c, g, or t
tcagtgtgagtagtcacgaccggtgctcgatttagtacacgtgattagggattgggggaaagcatcatccaacaaccacatcccttctctacagaagcctctgagaggaaagttcttcaccatggactggacctggagggtcttctgcttgctggctgtagctccaggtaaagggccaactggttccaggactgaggaagggtattttttccagtttagaggactgtctattttctactgtgtcctctccgcaggtgctcacctcccaggtgctagttcggtccaggtcgtggggctggaggtagaagaaggccgtgggggcctgagtgtaacggtttcctgcgaaggcatcgtaggactactccttcacgtacctactacattcacgtgggtcncgacgacggcccgtaggacgagggtactggaggtggtagtagggaaattaatccgtaacttacccgttaggttacggtggtaccgacccgaaactaaaccgtacgacaacgtaacggtaaccgttaccggaagggaccgtaaggtaccgttaccaaccgtaggtaccgggaacccgggggacacccggtacccgaaccggtaacccgtaaccggtaccgtaaccgtaagtcgggaacgtcgtaggacgccgacgtccgtaacg

SEQ ID NO: 164254 - DNA, 722 bp, Homo sapiens
  misc_feature: GYAE6OF01DKPZO.43.23.C01.1.454.CMB.1.raw
  modified_base (695)..(695): a, c, t, g, unknown or other
  misc_feature (695)..(695): n is a, c, g, or t
tcagtgtgagtagtcacgaccggtgctcgatttagtacacgtgattagggattgggggaaagcatcatccaacaaccacatcccttctctacagaagcctctgagaggaaagttcttcaccatggactggacctgggagggtcttctgcttgctggctgtagctccgaagggtaaacgggccaacgtcggttccaggactggaggaagggtattttttccagttagaggtactgtactattttctacttgtcgttcctcgtccgcgtaggttcgcctacctaccgtccccgagggtcgccgtaggttcggtacccgtaggttccggtgggggctagggagggtaggaaaggacggtcccggtagggggtcctacggtaggttacggtaacggttttcccgaggacgaagggtcctaacgttcgtaggtaaccttacctcccgttacgtaacccggtaacctaacgtactacgttaccgacggttcgggtcgaccgtaccgaccgggtacccgtagggacgtagggtacttgggaacggtaggtacgtagggtaaattaacgtactacgtaccgttaggtacggtcggtacgaaccaactaaccgtacgcgaacgtaacgtaccgtacggaggactaaggacgccaaccgacgtaccgggaccgggaccaccggtaccaccggtaccgaccggtanacgaggcgagtcgacgagcagcctacg

SEQ ID NO: 164255 - DNA, 578 bp, Homo sapiens
  misc_feature: GYAE6OF01DS5UP.43.23.C01.1.454.CMB.1.raw
  modified_base (543)..(543): a, c, t, g, unknown or other
  misc_feature (543)..(543): n is a, c, g, or t
tcagtgtgagtagtcacgaccggtgctcgatttagtacacgtgattagggattggggtctggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtgctggaccagtcaccagtgcttacatccaaaactggttccagcagaagcctaggacaacggccccacggcactgatttatggtgcgactaacaaacactccgtcggacccctgcccggttttcaggcctcccgtccgtcggggacaaacgctcgccctgacacgtgtacgaggtgtcgcgagcctgacgggacgaggctagactacttactcgcgtgctcatatagtggtgcgtcgtgggtgtcggcgggagggaccaggctacggaccgtccgtagggtccgcggtacccgacggtcctccggcccccgttccggtaccnccgttccttcccggttccccgcccccgttaccccg

SEQ ID NO: 164256 - DNA, 337 bp, Homo sapiens
  misc_feature: GYAE6OF01EDCQW.43.23.C01.1.454.CMB.1.raw
  modified_base (323)..(337): a, c, t, g, unknown or other
  misc_feature (323)..(337): n is a, c, g, or t
tcagtgtgagtagtcacgaccggtgctcgatttagtacacgtgattagggattggggctggcgccaggggtcccttccaatatcagcaccatggcctggactcctctctttctgttcctcctcacttgctgcccagggtccaattctcagactgtggtgagggaggagccctcactgactgtgtccccaggagggacagtcactctcacctgtacttccaacactggagctgtcaccaatggtcagccaagctcgcccctggtcactctcgttcccgcctcctcactactcacactgagcgggtctggacaaggcgcagtagnnnnnnnnnnnnnnn

SEQ ID NO: 164257 - DNA, 739 bp, Homo sapiens
  misc_feature: GYAE6OF01ENSNW.43.23.C01.1.454.CMB.1.raw
tcagtgtgagtagtcacgaccggtgctcgatttagtacacgtgattaggggagttgggggaaagcatcatccaacaaccacatcccttctctacagaagcctctgagaggaagttcttcaccatggactggacctgggagggtcttctgcttgctggctgtagctccgagggtaagggccaactggttccaggactggagggtaagggtactttttccaggtttaggaggtactgtctattttctactgttcgtcctcgtccgcgtaggtgcctacaccgtcccgagggtcgctaggttcggtccaggtccgtaggggctagggaagggtacgaacggtaacgccggtcgggggtccttggtaacggttggtaacggttttcccaggaccggtaaagggtcctagtcgtacggtacttacctccttaccgaccgtacctaacgtactagttccacggttcgggacgaccgaacgccggtaccccgtgggaaccgacgggtacttggacggtagggaagtacgggtaaattacgtacctacgttaccgtaaggtacgttacggtaccgacctaaacgtaaccgtacggaacaaccggtaacgtaaccggttccggaaggaccgtaacggtacgttaccgaaccgtaggtaccgggaaccgggtaccgacccggtaccgaccggtacccgtacggtacgtacgacggtaggaaccgtcgtacgacgccgagccgttaacgg

SEQ ID NO: 164258 - DNA, 595 bp, Homo sapiens
  misc_feature: GYAE6OF01D5OCZ.43.23.C01.1.454.CMB.1.raw
  modified_base (202)..(202): a, c, t, g, unknown or other
  misc_feature (202)..(202): n is a, c, g, or t
  modified_base (328)..(328): a, c, t, g, unknown or other
  misc_feature (328)..(328): n is a, c, g, or t
  modified_base (378)..(378): a, c, t, g, unknown or other
  misc_feature (378)..(378): n is a, c, g, or t
tcagtgtgagtagtcacgaccggtgctcgatttagtacacgtgattagggattggggaaagcatcatccaacaaccacatcccttctctacagaagcctctgagaggaaagttcttcaccatggactggacctggagggtcttctgcttgctggctgtagctccaggtaaaggccaactggttccaggactgaggaagggtnttttttccgagtttagaggactgtctattttctactgtgtcctctccgcaggtgctcactccaggtgcagttggtccagtcgtggggctggaggtgaagagccgtggggcctgagtgaggtttccngcagcatcgtggatctcctacacgtacctactactattcgacgtgggtcncgacgacggcccctgggacagggtcttggagtggagtgggaatatcactccgtaggtgtggtcgacctaacaacctcgacaactacggtaacgttccgaagggacaggacgtaccaacgtacgtcgggaacccggggactacccggtaccgaacccggtaacccgtaccggtacctaacgacgtaggacgtccgtaggaccgccgaggcccgtacgg

SEQ ID NO: 164259 - DNA, 650 bp, Homo sapiens
  misc_feature: GYAE6OF01CNG92.43.23.C01.1.454.CMB.1.raw
tcagtgtgagtagtcacgaccggtgctcgatttagtacacgtgattagggattggggaaagcatcatccaacaaccacatcccttctctacagaagcctctgagaggaaagttcttcaccatggactggacctggagggtcttctgcttgctggctgtagctccaggtaaagggccaactggttccaggactgaggaagggtatttttccagtttagaggactgtctattttctactgtcgtcctctccgcaggtgctcacctcccgaggtgcgtagttcggtccgtaggtcgtggggcgtggaggtaggaaggaacggccgtcggggccgtcgaggtggtaacggtttccgtggacgaacggcgtagtcgtggtatacctccttccacgtacctactactacttcacgtggtcgcgaaaaaaaccgcggccccgtacggacgacgggtacgtggtaggtggtagtagggtaaagtaacgtactacgtaccgtaggtagtacggtacgaccaaccgaactaccgacaacgaacgtaacgtaccggacggacgacgacgtacaccgacgtacggaccgggaccgaccgtacccgaccgacccgaccggtaccgtacgtacgtacggacgtcgacggagaccgcgccgtacg

SEQ ID NO: 164260 - DNA, 611 bp, Homo sapiens
  misc_feature: GYAE6OF01AY5CG.43.23.C01.1.454.CMB.1.raw
tcagtgtgagtagtcacgaccggtgctcgatttagtacacgtgattagggattggggtctggcgccaggggtcccttccaatatcagcaccatggcctggactcctctctttctgttcctcctcacttgctgcccagggtccagttctcagactgtggtgactcaggagccctcactgactgtgtccccaggaggacagtcactctcacctgtgctttggtgctggaccagtcaccagtgcttaccatccaaactggttccagcagaagcctggacaaggccccacggcactgatttatggtgcgactaacaaacactcctgacccctgccggttttcaggtcctcccgtcgtccgggggacaaacgcgtcgcccttgacctacgtgtcgaggtgtgcagcccgtagagggacgaggctgacttattacgtgacctgctcatatagtcgggtgcggaggtcgggttaggttcgggaccgggagggtacccgaagccgttacggacccggttcgtcggggtaccacgggccccgtaaacggtcccgtcccggtaccccccttcgggtaccctaccgtttaccgtcccggtttcccccggtccccttccccgg

SEQ ID NO: 164261 - DNA, 660 bp, Homo sapiens
  misc_feature: GYAE6OF01D6C6I.43.23.C01.1.454.CMB.1.raw
  modified_base (207)..(207): a, c, t, g, unknown or other
  misc_feature (207)..(207): n is a, c, g, or t
  modified_base (327)..(327): a, c, t, g, unknown or other
  misc_feature (327)..(327): n is a, c, g, or t
tcagtgtgagtagtcacgaccggtgctcgatttagtacacgtgattagggattggggtctggcgccaggggtcccttccaatatcagcaccatggcctggactcctctctttctgttcctcctcacttgctgcccagggtccagttctcagactgtggtgactcaggagccctcactgactgtgtccccaggagggacagtcactcncacctgtgctttggtggctggaccagtcaccagtgcttaccagtccaaaactggttccagcagaagcctggacaaacggccccacggcactgactttatggtgcgactaacaaacactcncggaccctgtccggtttcagcctcctccgtcgggggacaaacgctcgccctcgactacgtcgtcgtagtcgtacgcgacgtccgtgggaacgggacggaggtacgtacgtaacttaacgtttacgcgttccgtcggtacctactacgttaattcggttgggtcggtcgggttcggggttcgggttacgggttccggggtacggggacgggtaaccgtaacggtccggtaccggtacccggtccggttcgggtaccgtaccgacccggacggtccgtccccgtccccgtacggtaccctaccgttccgttccccgttcccctccccttaccccg

SEQ ID NO: 164262 - DNA, 331 bp, Homo sapiens
  misc_feature: GYAE6OF01EIH6D.43.23.C01.1.454.CMB.1.raw
  modified_base (285)..(285): a, c, t, g, unknown or other
  misc_feature (285)..(285): n is a, c, g, or t
  modified_base (292)..(292): a, c, t, g, unknown or other
  misc_feature (292)..(292): n is a, c, g, or t
  modified_base (320)..(320): a, c, t, g, unknown or other
  misc_feature (320)..(320): n is a, c, g, or t
  modified_base (327)..(331): a, c, t, g, unknown or other
  misc_feature (327)..(331): n is a, c, g, or t
tcagtgtgagtagtcacgaccggtgctcgatttagtacacgtgattagggattggggtggcgccaggggtcccttccaatatcagcaccatggcctggactcctctctttctgttcctcctcacttgctgcccagggtccaattctcagactgtggtgagggaggagccctcactgactgtgtccccaggagggacagtcactctcacctgtacttccaacactggagctgtcaccaatggtcagccaaggctcgcccctcggtcactctgttccccgccctccncactacncactactgagccgggactggcaagggcncgatagnnnnn

SEQ ID NO: 164263 - DNA, 965 bp, Homo sapiens
  misc_feature: GYAE6OF01BSII3.43.23.C01.1.454.CMB.1.raw
  modified_base (201)..(201): a, c, t, g, unknown or other
  misc_feature (201)..(201): n is a, c, g, or t
tcagtgtgagtagtcacgaccggtgctcgatttagtacacgtgattagggattggggaaagcatcatccaacaaccacatcccttctctacagaagcctctgagaggaaagttcttcaccatggactggacctggagggtcttctgcttgctggctgtagctccaggtaaaggccaactggttccaggactgaggaaggtntttttccagtttagaggactgtctattttctacttgtcgtcctctccgcaggtgctcacctcccgaggtcgctaggttcggtccagtcgtggggctggaggtggaagacgccgtggggcctacgagttacggtacggtttccaggaccgaaggcagttcgtaggtacttacctccttacgaaccgtaccttaactactacgttcacgtgggtcgcgtacgaccgggtccccgtagggaaccggtaacggggtaccgtttagggtaacgggttacggggtaacgggtttaacggggtaaaacgttaaacgttaacccgtaaccgtttaaccccggtttaaggggtttaacgggtttaccgggttaaccgggtaaacccccgtaaaacccgtaaaacccgttaacccgggtaaccctaaaccgggtaaaccggtaaaccggttttaaccccgggaaccggggtaacccggtaaacgggttaacccgttaaccccggaaccccggttaacgggtaaaccccgggggtaaaccccccggggggttaaacccccggtaaacccccggggtttaaccccccggtaaaacccccgggggtaaaccccccggttaaaccccgggggtttaaacccccgttaaaacccggggttaaacccgggtttaacccggggggtaaaacccgggtttacccgggttaaacccggggtaaacccgggtaaacccccgggttaaacccgggggttaaaccccccccgttaaacccgggggg

SEQ ID NO: 164264 - DNA, 741 bp, Homo sapiens
  misc_feature: GYAE6OF01BV0R5.43.23.C01.1.454.CMB.1.raw
  modified_base (259)..(259): a, c, t, g, unknown or other
  misc_feature (259)..(259): n is a, c, g, or t
  modified_base (343)..(343): a, c, t, g, unknown or other
  misc_feature (343)..(343): n is a, c, g, or t
tcagtgtgagtagtcacgaccggtgctcgatttagtacacgtgattagggattggggaaagcatcatccaacaaccacatcccttctctacagaagcctctgagaggaaagttcttcaccatggactggacctggagggtcttctgcttgctggctgtagctccgaggtaaagggccaactggttccaggactggaggaagggtatttttccagtttagaggactgtctattttctactgtcgttcctctccgcaggtnctcacctccaggtgcgtaggttcggtccctaggtcgtggggctggaggtgaagacgccgtgggcctcgaggtgtacggtttccngcgaggctagtcgtgacttacctccttacaccgtacctactactactttacacggttgggtacgccgtaacgaccgggtccccgtagggaccgtaggggtacgttagggaggttagggtaacgtaggggtaaacttaacgtaccgtaacgtttaccccggttaaggtttacgggttggtaacccgaacccgtaaaccgtaaacccgtaccgtaaccgaacgtaacggtaaccggttaccgggaagggaccgtaacggacgtaccgaaccgtacggtaccgggaacccggggtaaccgtaccggtaccccgtaacccgggtaacccgtaccgggtaacctaaccggtaacggttacgggacgttacggtacggaacgtcccggtaacgtcccgtaacgg

SEQ ID NO: 164265 - DNA, 818 bp, Homo sapiens
  misc_feature: GYAE6OF01B8E4J.43.23.C01.1.454.CMB.1.raw
  modified_base (228)..(228): a, c, t, g, unknown or other
  misc_feature (228)..(228): n is a, c, g, or t
tcagtgtgagtagtcacgaccggtgctcgatttagtacacgtgattagggattggggtctggcgccaggggtcccttccaatatcagcaccatggcctggactcctctctttctgttcctcctcacttgctgcccagggtccagttctcagactgtggtgactcaggacgccctcactgactgtcgtccccgagggagggacagtcactctcacctgtgtcgtttggnggcgtggaccagtccaccagtcgccttaccataccaaaacgtcggttaccagacaggaacgcctaggaaccgaacggcccccgacggccacgtgtactttagtgggtagacgaactaaaacctaaacaccttacccgtccggtacccccgttcggtcccccggttttaccgacggtccccgttcccgtcccgggtaccgggggactaaaaccgtccgtaccggccccgtacggaacctccgttacggtccgtaacgggtgtacggacgtcggcccgtagggaacgggacggtaacggccgttaacggtaacctttaacgttaccgtcgtcccttaggtaccctacgtaattaacgttaagggttcgggtacgggtccggggttcgggttacgggggtttcgggttaccgggggacgggtaacggggaacccggtaacggcccggttaccggtaaccccggttcgggtaacgggttcccggaccgggtaccccggaaccgggttacccgttcccccggggtaccccccgttcgggttaccccgtacccgtttccccggttccccgttccccccggtacccccttacccccg

SEQ ID NO: 164266 - DNA, 578 bp, Homo sapiens
  misc_feature: GYAE6OF01ARAVU.43.23.C01.1.454.CMB.1.raw
  modified_base (256)..(256): a, c, t, g, unknown or other
  misc_feature (256)..(256): n is a, c, g, or t
  modified_base (332)..(332): a, c, t, g, unknown or other
  misc_feature (332)..(332): n is a, c, g, or t
  modified_base (369)..(369): a, c, t, g, unknown or other
  misc_feature (369)..(369): n is a, c, g, or t
  modified_base (381)..(381): a, c, t, g, unknown or other
  misc_feature (381)..(381): n is a, c, g, or t
  modified_base (453)..(453): a, c, t, g, unknown or other
  misc_feature (453)..(453): n is a, c, g, or t
tcagtgtgagtagtcacgaccggtgctcgatttagtacacgtgattagggattgggggaaagcatcatccaacaaccacatcccttctctacagaagcctctgagaggaaagttcttcaccatggactggacctggagggtcttctgcttgctggctgtagctccaggtaaaggccaactggttccaggactggaggaagggtattttttccagtttagaggactgtcattttctactgtgtcctctccgcaggtnctcactccaggtgcagttggtccagtcgtggggctggaggtgaagaacgccgtggggcctcgagtgaaggtttccngcaaggcatctggatactccttcaacgacctactacnttcacgtgggtncgacaggcccctgggaccagggacttggagtggagtagggaatatcgatcccgtagtacgtggtgacccaanaacgtacgcaacgaagtaacgttccgaacgggcaggacgtacaaccgagtacggaaccggggccaccggtacccgacgacccgacggtcctacgacgtcggacgcgtgaacgcacggtcctacgg

SEQ ID NO: 164267 - DNA, 610 bp, Homo sapiens
  misc_feature: GYAE6OF01DZF3H.43.23.C01.1.454.CMB.1.raw
  modified_base (201)..(201): a, c, t, g, unknown or other
  misc_feature (201)..(201): n is a, c, g, or t
  modified_base (268)..(268): a, c, t, g, unknown or other
  misc_feature (268)..(268): n is a, c, g, or t
  modified_base (328)..(328): a, c, t, g, unknown or other
  misc_feature (328)..(328): n is a, c, g, or t
  modified_base (381)..(381): a, c, t, g, unknown or other
  misc_feature (381)..(381): n is a, c, g, or t
tcagtgtgagtagtcacgaccggtgctcgatttagtacacgtgattagggattggggaaagcatcatccaacaaccacatcccttctctacagaagcctctgagaggaaagttcttcaccatggactggacctggagggtcttctgcttgctggctgtagctccaggtaaaggccaatggttccaggactgaggaagggtnttttttccagtttagaggactgtctattttcactgtgtcctctccgcaggtgctcactcccgaggtnctagttcggtccagtcgtggggctggaggtgaagacgcctggggcctgagtgagtttccngcaggcatcgtgatctcctacacgacctactacattcacgttgggtcgcgacncggcccctggactagggtctggagtggagtgggaaatatcactcctagttagtggtcgaccaacaaccgtacgacacgtaagtaacgttaccggagggacgagacgtaccaaccgtagtaccgggaacccgggaaccgtacccggtacccgaacccggtacccgtaacgggttccctaaacgacgggtcgggaacgtaccgttacgggacgcgtaaccgcccgtaacgg

SEQ ID NO: 164268 - DNA, 847 bp, Homo sapiens
  misc_feature: GYAE6OF01ASK8L.43.23.C01.1.454.CMB.1.raw
  modified_base (202)..(202): a, c, t, g, unknown or other
  misc_feature (202)..(202): n is a, c, g, or t
  modified_base (257)..(257): a, c, t, g, unknown or other
  misc_feature (257)..(257): n is a, c, g, or t
tcagtgtgagtagtcacgaccggtgctcgatttagtacacgtgattagggattggggaaagcatcatccaacaaccacatcccttctctacagaagcctctgagaggaaagttcttcaccatggactggacctggagggtcttctgcttgctggctgtagctccgaggtaaggccaactggttccaggactgaggtaaggtntttttccagtttagaggactgtctattttctacttgtgtcctctccgcgtaggtnctcactcccgaggtgctagttcgtcagtcgtgggctgaggtgaagacgccgtgggcctgacggtaggtaacggtttccgagacgaaggtctacgtacgtggaacttacccgttccttcgaacccggtaacccttaacgtaactacgtttccgaaccggttgggaccgaccggtaaccgtaccggggtcccccgtaaggggaaccgtaacggggttaccggttacgggtaagggttacgggtaacgggttaacgggtaaacgttaaacgttaccgtaaccgttacccggtttaaacgggttacgggttacgggttaccgtaacccgtaaaccgtaaacccgtaaccggtaaccgtaaaccgggtaaacggttaaaccggttaacccgggaacgggtaccgtaacgggtaaccgttaaccccgaaccggtaacggttaacccggggtaaacccggggtaacccggtaaccccggtaacccggtaaaccccgggtaaccccggtaacccggttaacccgtaaccgggtaccggttaacgggtaaccggacccggttaacggaccggtacccggtaaccggttccgtaaccggg

SEQ ID NO: 164269 - DNA, 714 bp, Homo sapiens
  misc_feature: GYAE6OF01DHYFJ.43.23.C01.1.454.CMB.1.raw
  modified_base (205)..(205): a, c, t, g, unknown or other
  misc_feature (205)..(205): n is a, c, g, or t
  modified_base (253)..(253): a, c, t, g, unknown or other
  misc_feature (253)..(253): n is a, c, g, or t
tcagtgtgagtagtcacgaccggtgctcgatttagtacacgtgattagggattggggaaagcatcatccaacaaccacatcccttctctacagaagcctctgagaggaaagttcttcaccatggactggacctggagggtcttctgcttgctggctgtagctccaggtaaagggccaacgtggttccaggactggaggaagggtntttttccagtttagaggactgtctattttctactgttgtcctctccgngaggtgctccactcccgaggtcgctaggttcggtccaggtcgtggggctagaggtagaaggacgccgtggggcctagacggttaggtaacggtttccctggaccgaaggctagtccgtaggtacttaccgttcccttcgtaaccgtaccctaacttaacctactttcaacggttcgggtacgacggtaccgacccgggtccccgtagggaccggtaggggtacgtttacgggaggttagggaacggttaagggtaaacttaaagttaccgtaacgtttacccgtaaggttacgggtacggtaccgacccaaacgtaacctaccgaaccaacgtaacgtaaccggttaccgaagggacgtaacgacggtacaaccgtaggtaccgggaacccgggtccaacccggtacccaacgaacccgtacggtacacgacgtggacgtcgtacggacgacgcgcgtacg

SEQ ID NO: 164270 - DNA, 330 bp, Homo sapiens
  misc_feature: GYAE6OF01EQA59.43.23.C01.1.454.CMB.1.raw
  modified_base (322)..(330): a, c, t, g, unknown or other
  misc_feature (322)..(330): n is a, c, g, or t
tcagtgtgagtagtcacgaccggtgctcgatttagtacacgtgattagggattggggtggcgccaggggtcccttccaatatcagcaccatggcctggactcctctctttctgttcctcctcacttgctgcccagggtccaattctcagactgtggtgagggaggagccctcactgactgtgtccccaggagggacagtcactctcacctgtacttccaacactggagctgtcaccaatggtcagccaaggctcgcccctcggcactctcgttcccaccctcctcactactcacactgaggcggctggcaaggcgacatagnnnnnnnnn

SEQ ID NO: 164271 - DNA, 712 bp, Homo sapiens
  misc_feature: GYAE6OF01D186K.43.23.C01.1.454.CMB.1.raw
  modified_base (275)..(275): a, c, t, g, unknown or other
  misc_feature (275)..(275): n is a, c, g, or t
  modified_base (698)..(698): a, c, t, g, unknown or other
  misc_feature (698)..(698): n is a, c, g, or t
tcagtgtgagtagtcacgaccggtgctcgatttagtacacgtgattagggattggggaaagcatcatccaacaaccacatcccttctctacagaagcctctgagaggaaagttcttcaccatggactggacctgggagggttcttctgcttgctggctgtagctccgaaggtaaagggccaacgtggttccaggctggaggtaagggttatttttccagttagaggactgtctattttctagtgtcgtcctctccgcagtgctcactccgaggtnctggttgtccagtcgtggggctggaggtagaagacggtccgtggggtcctgtaggtcggtaacggtttcctgacgaggtcattacgtggtaccttaccgttcccgtaccgaccgtaccttactactacgttccacggtgggtccggacgtacccggtaccgggtacccccgtagggaaccggtaacggggttcctttagggaacgttaggggtaacggtagggtaaacttaactaccgtaaccttaccgggttagttacgggtcggttaccgaccctaaactaacccgtacgtaccaacgtacggtaacgtaccgagggtcctaaggtaccgtaccaacggacgtaacgggaacccgggaacctaccggacccgtaaccggaccgtaccggtctaacgtacgggtacgaacggtctaaggacncgtcgtccggtacg

SEQ ID NO: 164272 - DNA, 755 bp, Homo sapiens
  misc_feature: GYAE6OF01C5Q1B.43.23.C01.1.454.CMB.1.raw
tcagtgtgagtagtcacgaccggtgctcgatttagtacacgtgattagggattggggaaagcatcatccaacaaccacatcccttctctacagaagcctctgagaggaaagttcttcaccatggactggacctggagggtcttctgcttgctggctgtagctccaggtaagggccaactggttccaggactgaggaaggtatttttccagtttagaggactgtctattttctactgtcgtcctctccgcaggtgctcacctcccgaggtcgcgagtttcggccaggtctggggctgaggtgaagagccgtggggcctcgagtggtaacggtttccctgacaaggcagtcgtggactacctccttacacgtaccttactactactttcgacgttgggtcgccggtaccgacgggcccccgttaggaaccgaggggtacgtttaggacggtgggaagttacggggaaattaacgtcctaagttacccggttaaggtacgggttcggtacggtacccaacgtaaaccgttaccgaccaacgtaacggtaaccgtttacccgggaacgggtaccgtaacggtaccgtaccgaacccgtacggttaccggggaaccccgggggtaaccgtacccggttaacccgaaccccggtaaaccccggttaaacccggggttaccccgttaaaccggtaacgggttaacggggaacccgtaccgggttaacggacccgtaacccgaccgggttccccgtaaaccgg

SEQ ID NO: 164273 - DNA, 657 bp, Homo sapiens
  misc_feature: GYAE6OF01DOGY2.43.23.C01.1.454.CMB.1.raw
  modified_base (259)..(259): a, c, t, g, unknown or other
  misc_feature (259)..(259): n is a, c, g, or t
  modified_base (396)..(396): a, c, t, g, unknown or other
  misc_feature (396)..(396): n is a, c, g, or t
  modified_base (404)..(404): a, c, t, g, unknown or other
  misc_feature (404)..(404): n is a, c, g, or t
tcagtgtgagtagtcacgaccggtgctcgatttagtacacgtgattagggattgggggaaagcatcatccaacaaccacatcccttctctacagaagcctctgagaggaaagttcttcaccatggactggacctggaggtcttctgcttgcttggttgtagctccgaggtaaaggccaactggttccaggactgaaggaagggtattttttccgagtttagaggactgtctattttcactgtcgtcctctccgcaggtnctcacctccgaggtgactggttcgtccagtcgtgggctggagtgaagacgccgtgggcctgagtgtaacggtttccagcaggctatcgtaggacttacctccttacgacgtacctaactactacttcgacgtgggtnaccgtacnccggtccctaggacgtagggtactggaggtagagtagggaatactcgtactaccgttaagtacggttcgggtcacccgtaaacaaaccgtacgactacgaacgtacggttaccgagggactagggtactaccgaaccgtaggtaccgggaaccgggacctaaccggtaccccgaacggtaaccccgtaccggtaactaccgtaacggtaggaccgtcgttacggaaccgtccgtaaccgtccgtcgtaaaccg

SEQ ID NO: 164274 - DNA, 872 bp, Homo sapiens
  misc_feature: GYAE6OF01CU6E5.43.23.C01.1.454.CMB.1.raw
  modified_base (178)..(178): a, c, t, g, unknown or other
  misc_feature (178)..(178): n is a, c, g, or t
tcagtgtgagtagtcacgaccggtgctcgatttagtacacgtgattagggattggggtctggcgccaggggtcccttccaatatcagcaccatggcctggactcctctctttctgttcctcctcacttgctcgcccagggtccagttctcagactggtggtgactcgaggacgccctnactgactgtcgtcccgagggacggacagtcactcctcaccgttggtcgtcgtttgggtcggtacgtacggacctacgtaccaaccgtagttcgaccttaacctacttacccgtaaacgttcgggttaccaagtacaaggtaaccgtccgtacggaaccgaaccggcccccgaggactaccgtgtagtttacgtcggtacgacgtaaacctaaacaaacctcgtacccggtaccgccccgttacgtccccggtttacgaccggtcccttcccggtacgggtccggggaaacctaacggtccgtaccgtcccgtacgaacgtacgtcgtacggtggtccgtacggacctacggaccgtcgggaacggtaccggtaacggtccttaaggtacctttaaccggtactcccggtcgttacggtaccttaagaaggtttacggttagggtccggggggttacgttccggggttaacggggggttcggggtttacccgggtacggggggaaccgggtaaacccgggtaaccgtaacggggtcccgttacccgggggtaccccggttaccgggtaccggggttaacccggacccggtaaccccggggttgtttacccccgtcccccggggttaaaccccggtttcggaaccccctttccggttaaccccgttccccgttaccccccgttccgtttaaccccg

SEQ ID NO: 164275 - DNA, 864 bp, Homo sapiens
  misc_feature: GYAE6OF01BHF1F.43.23.C01.1.454.CMB.1.raw
  modified_base (227)..(227): a, c, t, g, unknown or other
  misc_feature (227)..(227): n is a, c, g, or t
tcagtgtgagtagtcacgaccggtgctcgatttagtacacgtgattagggattggggtctggcgccaggggtcccttcaatatcagcaccatggcctggactcctctctttctgttcctcctcacttgctgcccagggtccagttctcagctgtggtcgactcgaggacgccctcactgactgtcgtcccgagggaggacagtcactctcactggtcgtcgtttggnggcgtggaccagtcaccgagtcgtaccttaaccgactaccgtaaacgttcggttaccgagacaaggacgccgtaggaaccgaacggccccgacggactacgtagttaactttagtcgggtacgaacgtaactaaaccaaactaccgtccgtaccgaccccgttcggttccccgggtttacaccggtccgttacccgttccgggtacggggtaacgtaaccgtccgttaccggacccttacggacctacggtttcggacggtacgggtcggtccggacggtaccggtaccggttacgggaacgggacgggacgggtaccgttacggttaacttaacggtttacggcccgttaccgtcgtacccgttagttaacgtttaggttagggttacggggtacgggtccgggtttacgggggttcgggggttacgggggtttacccgggggaaccggggtaaacggggtaaccccggtagggttacccgggtacccggttaccggggttcccgggttaccggggtaccgtacccgggtaaccgggtaacccggtcccgttaacccccggggtccccggtttacccggtcccggttacccttaccccggtttcccccggttaccccccggttcccgttaaccccg

SEQ ID NO: 164276 - DNA, 897 bp, Homo sapiens
  misc_feature: GYAE6OF01B96UF.43.23.C01.1.454.CMB.1.raw
  modified_base (630)..(630): a, c, t, g, unknown or other
  misc_feature (630)..(630): n is a, c, g, or t
tcagtgtgagtagtcacgaccggtgctcgatttagtacacgtgattagggagttgggggtctggcgccgacgggggtcccttccaatatcagcaccatggcctggacctcctctctttctcgttcctctcacttgctcgcccgagggtcctagttctacagaccgtggtaggtcgactcggacggacgcccctacaccgtgacgtcggtcccggacccggaaggggacgggacctacggtacctaacctcctacctaccgttgttcggttcggttttggggcggtaccggtacggaacccgtacgtaccgaacggtacgttacgtacccttaaaccgtaacctaaccgtaaaccggttcggtaccgaacggtacaaacgggtaaaccggcccggtaacgggaaccggaaaccccggcccccggtaaggtacctaacggttacgtagttttaacggtcggtaacggaaccctaaacctaaaaccgtaaacctaccccgtaccgggtaaccccggttccccgttacgggttacccggtttccggaccggtttcccctacccgggtaccgggtacggggaacctaacgtccgtccgtaaccgacgtacgtccgtagggtcggtacggtccggngtaccgacggtaccggaggacgggacggacggtataacgtactacggttacgcgtactcgaccttatagtacggtacggtggggtcggtacgggtcggggttcgggtacggggtacggggacggtaaccgggacgtacgtacccgggtacggttaccggtaccggggtacgaccgggtacccgtaccgggtaaccgtcccggttaccccggttacccccggcggtttcccacccggtttcccgtccccgtcccccgttcctaccccg

SEQ ID NO: 164277 - DNA, 946 bp, Homo sapiens
  misc_feature: GYAE6OF01BVEBX.43.23.C01.1.454.CMB.1.raw
tcagtgtgagtagtcacgaccggtgctcgatttagtacacgtgattagggattgggggaaagcatcatccaacaaccacatcccttctctacagaagcctctgagaggaaagttcttcaccatggactggacctgggagggtcttctgcttgctggctgtagctccgaggtaaagggccaacgtggttaccaggactggaagggtaagggttacttttttccgaggtttaggacggacttgtactatttttctactgtcgttccctccgtccgcgagggtgcctaccaccgtccccgagggtcgccgtaggtttcggtaccctaaggttcggtcgggggtcttgggtaagggtaggaaaggaaccggtcccgggttaccgggggggtaccccttacgggtaacgggtttacgggttaaaccgggtttttcccgtacgggaaccggtaaaccgggtcctaacgtttccggttacgggttaaacctttaccccgttttccccggtttaacccgaacccggttaaccccttaaccttaacccgtaaccgttttaccggaacggtttcggggttaccgacccggtaacccggtacccgggtaccccgtaggggaaccgtaacgggggttacttagggtacgggtaggtaacggtaaggttaaattacgtaccgtaaccgttacccgttaagggttacgggttacgggtaccgaaccccgtaaacgtaaacccgtaccgaacccgtaaccggtaaacggttaacggttacccggaaacggggaccgtaacggggtaacccgttaccgaacccggttacgggtaccccggggaacccggggtaacccgaccccgggtaaccccgaaacccgggtaaccccgtaaccggggtttacccaacggacgggttaacggacggtccgttaagggaccgccggtaccgtcccgtaagg

SEQ ID NO: 164278 - DNA, 827 bp, Homo sapiens
  misc_feature: GYAE6OF01EVJPM.43.23.C01.1.454.CMB.1.raw
tcagtgtgagtagtcacgaccggtgctcgatttagtacacgtgattagggagttgggggaaagcatcatccaacaaccacatcccttctctacagaagcctctgagaggaaagttcttcaccatggactggacctgggaggtcttctgtcttgctgctgtagctccgaggtaaaggcaacgtggttaccaggactggaggtaggtactttttcgagtttagaggtactgtactagttttactacgtgttcgttccttcctccggacgtacggtcgcctactaccgtccgaggtcgacgttaggttacggccgtaaggtccggtaggggtactggtaaggtacgaaacggaacggtccggtcgggggtacctacggtaacgggttacggttaaacggttttccgaggtaccgtaacgggtacctacggttacgtaacgggttaaccttaaccgtttacccgttacgaaacccggttaacccttaactacgttaacgtttaccggaccggtttagggggttaccgacggtaaaccgggacccgggtaaccccggtaggggtaaaccgtaaggggttaaccgtttagggtaacgggttacgggtaacgtaacggggtaaacttaacgtaccgtaacgttaccgttaaggttacgggttcggtacgtaacctaaaccgtaacctaaccggtactaacgtaacggtaccgttacggacggacgtacgtacgttaccacgacgtaccgggtaccggaaccgtaccggaacccgacggtaaccgtacggtaactacggtacgtacggacggtcacggtagacgtacgcgtaacg

SEQ ID NO: 164279 - DNA, 788 bp, Homo sapiens
  misc_feature: GYAE6OF01B7KGR.43.23.C01.1.454.CMB.1.raw
tcagtgtgagtagtcacgaccggtgctcgatttagtacacgtgattagggattggggaaagcatcatccaacaaccacatcccttctctacagaagcctctgagaggaaagttcttcaccatggactggacctgggaggtcttctgcttgctggctgtagctccgagggtaaacgggccaactgggttccaggactggaagggtaagggttattttttccgaggtttacggaggtacttgtctattttctacttgtcgttcctctccgcgaggtcgctccacgtcccgaggtcgccgtagttcggtacctaggtcgtggggcgttaggaggtagaaaggtacggtcccggtacgggggcccttaggtaggttacggtaaacggtttcccgtagggaccgtaaagggtcctagttacggttaggaccttaccttcttaccgaaccgtacctaacgtactcgttacgacgtcgggtacgaccggacgtaccgggtcccccggtaggaccggtacgggttaacgtggaaggttagggtaggtaagggtaaacttaagtaccgtacttacccggttaggtacgggttacggaccgtaaccgtaaccgtaaaccgtaaccgtacgaaaccgtaacggtaaaccggttaccgggaacgggaaccttaacgggaaccgttacccgaacgtaacgggtaaccggaaccgggtaccgaccgtaacccgaaccggtacccgtaacggtaccgtacggaacgtacggacgtacggacggacgaccgtcgaccggttacg

SEQ ID NO: 164280 - DNA, 722 bp, Homo sapiens
  misc_feature: GYAE6OF01DWU5F.43.23.C01.1.454.CMB.1.raw
  modified_base (265)..(265): a, c, t, g, unknown or other
  misc_feature (265)..(265): n is a, c, g, or t
tcagtgtgagtagtcacgaccggtgctcgatttagtacacgtgattagggattgggggaaagcatcatccaacaaccacatcccttctctacagaagcctctgagaggaaagttcttcaccatggactggacctgggaggtcttctgcttgctggctgtagctcgaaggtaaggccaacgtcggtccaggactggaaggtaagggttatttttccgaggtttaggaggtacttggtactagttttctactgtcgtcctcgtccgngtacggtcaccgtctacctccgaggttcacgttaggttcggtaccaggtcggtggggtacgtggtaggtagaaacggacggtccggttcggggtacctacggtaggttcggtaaacgggttttcccgagacggtaacggtcctagtacggttacgtaaacttcccttaccgttaccgaacgttacccgttaataaccctaagtttccggaacggttcgggtacgaccgaacgtccggtccccgtagggacgtacgggtacttagggagtacggtagtaggtaatacacgtacgtccgtaagtggtacgtacgaacctaacggaactacgacgtactaggtaactcgacggatagaccgtcgacgtaggtaccgggaccggtacgaccgttacccgacgtaaccggtactaccgtacaggacggtacctacggtacggacaccggtcgtcggtaaccg

SEQ ID NO: 164281 - DNA, 692 bp, Homo sapiens
  misc_feature: GYAE6OF01CGJQV.43.23.C01.1.454.CMB.1.raw
  modified_base (565)..(565): a, c, t, g, unknown or other
  misc_feature (565)..(565): n is a, c, g, or t
  modified_base (683)..(683): a, c, t, g, unknown or other
  misc_feature (683)..(683): n is a, c, g, or t
tcagtgtgagtagtcacgaccggtgctcgatttagtacacgtgattagggattgggggaaagcatcatccaacaaccacatcccttctctacagaagcctctgagaggaaagttcttcaccatggactggacctgggagggtcttctgcttgctggctgtagctccgaggtaaagggccaacgtcggttaccaggactggaagggtaaggttattttttaccgagtttaggaggtactgttctagttttctacgtgttcgtcctctccgacgtggtctccgtactaccgtcccgaggtcggcgttaggttcggtacccgtaggtcgtggggtcgtgggaggtaggaaacggtacgcccggtcggggtacctacgaggttacggttaacggtttccgtacggtacgaacggtctacgtccgtaggtcttacccgtcctaccaccgtaacctacgtactcttacctacggtcggtcgaccgacggaccggacccgtaggaacggtgggtacgtgaggtggaagtagaatacgctacgtacgtagtacgtcgtacactaacgtaaccncgtactacgaacgcgtaaccgacgtacgtacaacgtccaacgtacgaccggaaccggaccgtaccggaaccgaccgtacccgacggtactacgcgtacgaacgttcgacggaggaccncggtcgtac

SEQ ID NO: 164282 - DNA, 769 bp, Homo sapiens
  misc_feature: GYAE6OF01AZ22F.43.23.C01.1.454.CMB.1.raw
  modified_base (271)..(271): a, c, t, g, unknown or other
  misc_feature (271)..(271): n is a, c, g, or t
  modified_base (312)..(312): a, c, t, g, unknown or other
  misc_feature (312)..(312): n is a, c, g, or t
tcagtgtgagtagtcacgaccggtgctcgatttagtacacgtgattagggattggggaaagcatcatccaacaaccacatcccttctctacagaagcctctgagaggaaagttcttcaccatggactggacctggagggtcttctgcttgctggctgtagctaccgaggtaaagggccaactggttccaggactggagggtaagggtattttttccgagtttagaggtactgtctatttttcgtactggtgtccctctcccgcgtaggtcncctcacctccgaggtgctaggttcggtccaggtcgtggggntcggaggttgaacgacgcggtcggggcctacgaggtagtaacggtttcctaggacgaacggtcagtcgtaggtaccttcctaccgttcaacccgtactactactattaccgacggtcgggcgtacccggaccgtaccggtaccccggtagggtacccggtaacgggttaccgttagggtacgggtagggaaggttaagggttaaacttaaccgttacgtaaccgttaccggttaaggttcgggttaggtacccgaaacccgaaaccctaaccggtaacgaacccgtaacggaaacgggttaaaccggttaccggaaagggtacccgtaagggaacccgtaccgttaacccggacggtaccgggaacccggggtacctaacccggtccccgaaacccgggttaccgacccggttacgtacgaagggttcggagtcggtacggagtccgcgtcgtacgg

SEQ ID NO: 164283 - DNA, 815 bp, Homo sapiens
  misc_feature: GYAE6OF01AJTWX.43.23.C01.1.454.CMB.1.raw
tcagtgtgagtagtcacgaccggtgctcgatttagtacacgtgattagggagttggggaaagcatcatccaacaaccacatcccttctctacagaagcctctgagaggtaacgtttccttcaccatcggactggaccctggagggtcttctggcttagctggtactgtacgcctcgtaaggtaaacggccaactcggttccgaggtactggaaggtaaggttactttttaccgagtttacgacggtactgtcctattttcgtacgtgttctcctcgtaccgctacggtcgcctacctaccgtccgtaggtcgtacgtacggtttcggaccctaggttccggtaggggtcttaggtaacggtgaacggtaccgtcggtccgggtaccgtacgaggtacgttaacggtttccgacgtaacgacggtctagttcacgggtacttaccgttccgtaccaaccggttcccaaattacgtaccgtttcgacggtttcgggaccggtaacccgtaccgtcccggtacccggtcgggtaaaccggtcgggttacgtacggtaggtacggtacggtaacggttaagtacgttaaccgtcgtttaaacccgtagggttacggttacggttaacgtaccccctaaagttaaacccgtccgttaacgaacccgtaaggtaacccgttacggaaccggtagacggtttaacccgaacggtcctaacgggcccgggtaacggggttaccccaccgggtaacccaacccgggtacctacggaccttacgacgttcggaccgtgtaccgaattcccgacgtcccgttaacg

SEQ ID NO: 164284 - DNA, 768 bp, Homo sapiens
  misc_feature: GYAE6OF01BVUVL.43.23.C01.1.454.CMB.1.raw
  modified_base (682)..(682): a, c, t, g, unknown or other
  misc_feature (682)..(682): n is a, c, g, or t
tcagtgtgagtagtcacgaccggtgctcgatttagtacacgtgattagggattggggaaagcatcatccaacaaccacatcccttctctacagaagcctctgagaggaagttcttcaccatggactggacctggaggtcttctgcttgctggctgtagctcgagggtaaacgggccaacgttggttccgaggtacgtggaagggtaacgggttatttttttccgaaggtttaggaggtacttgtacttatttttctacgttcgttcgtcctcctaccgcgtagggttcgtctacgtacctcccgtaggtcgtcttaaggttttcgggacccgtaggttcggtggggtcttggggaagggttcggaaaggtacgggacccggttggggggtaccccttaggtacgggttacgggttaacgggttttcccgaggtaccggtaaacgggctaacggttcgttacggtaccttaaccttcccttacggaacccggtaaccccttaactaacgtaccgtttaccgaacgggtttcggggtccggtaccgggtaaccgcccggggttacccccgtagggtaaccgtacgggttaccgttaggacggttggtacgtagggtaaactacgtactacgtacctaggtacgtacgtgacccaactaacgtcgacaacgagtacgtcgacggnaggacacacgagaccggacgggacctaccggtaccgacggacccgtagtacagtacggtacgacgtctacggaagccgcgcgtacg

SEQ ID NO: 164285 - DNA, 808 bp, Homo sapiens
  misc_feature: GYAE6OF01ASAWB.43.23.C01.1.454.CMB.1.raw
tcagtgtgagtagtcacgaccggtgctcgatttagtacacgtgattagggattggggtctggcgccaggggtcccttccaatatcagcaccatggcctggactcctctctttctgttcctcctcacttgctcgcccgagggtccagttctcagactgtggtgactcgaggacgccctcactcgacttggtcgtccccgagggagggactagtcacgtctcaccgtgtgtcgttgggtcgtcgtcggaccacgtccacgtagtcgtacctaccactacctaacgttcggtaccagtacgaaggaacgtccgtacggaaccgaaccggcccgacggactacgtagtacgtttaggtcggtcgacgaacctaaaccgaaccgtacctccggtacccggtccccgttaccggttcccggtttccgtacggtccccgttacccggtcccgggtaacggggtaacctaaccggtccgtacccgtacccgtaacgtaccttaccgtacggtaccggtacggtacggtcgtacggtccgttacggacgggtaccgggaaggtcggttaccgtacgggtacttaccggttacgtccggtcctacgttaacttacggtaactttacgggttaaggtccggggtacgggtccgggttcggggttacgggttcgggtaccggggtacgggtaacgacggtacgtcccggtacgggtccgttccgggtcggtaccggtaccctacgggtacggtccccgtacccggtcccggtacgttccgtacccgttccggtttccccaccccgttccttaaaccccgg

SEQ ID NO: 164286 - DNA, 581 bp, Homo sapiens
  misc_feature: GYAE6OF01DTJR4.43.23.C01.1.454.CMB.1.raw
  modified_base (255)..(255): a, c, t, g, unknown or other
  misc_feature (255)..(255): n is a, c, g, or t
  modified_base (272)..(272): a, c, t, g, unknown or other
  misc_feature (272)..(272): n is a, c, g, or t
  modified_base (333)..(333): a, c, t, g, unknown or other
  misc_feature (333)..(333): n is a, c, g, or t
  modified_base (372)..(372): a, c, t, g, unknown or other
  misc_feature (372)..(372): n is a, c, g, or t
  modified_base (384)..(384): a, c, t, g, unknown or other
  misc_feature (384)..(384): n is a, c, g, or t
  modified_base (418)..(418): a, c, t, g, unknown or other
  misc_feature (418)..(418): n is a, c, g, or t
  modified_base (468)..(468): a, c, t, g, unknown or other
  misc_feature (468)..(468): n is a, c, g, or t
  modified_base (472)..(472): a, c, t, g, unknown or other
  misc_feature (472)..(472): n is a, c, g, or t
  modified_base (575)..(575): a, c, t, g, unknown or other
  misc_feature (575)..(575): n is a, c, g, or t
tcagtgtgagtagtcacgaccggtgctcgatttagtacacgtgattagggattgggggaaagcatcatcccaacaaccacatcccttctctacagaagcctctgagaggaaagttcttcaccatggactggacctggagggttcttctgcttgctggctgtagctccaggtaaggccaacgtgttccaggactgaggtaggtatttttccagtttagagactgtctattttctactgtcgtcctctccgcaggtnctcacctcccgaggtcncagttcggtccagtcgtgggctaggaggtagaagacgcgtgggcctgagtgtacgtttccngacagctagtctgactcctcctacacgtacctactactnttcacgtggacncgaccgcggccccgtaggacgtacggtcgttagnggtacggagtaggtaatactcacgtacctagtaggtgacgacacgtaacncganacgacgtaagtccgagacgtgacttacacgtagaccgggaaccggcgtaccgaccgacccgtaccgaaccggttacaacgagtacgggactcgacgacgcgcncgtacg

SEQ ID NO: 164287 - DNA, 534 bp, Homo sapiens
  misc_feature: GYAE6OF02GP7T1.43.23.C01.1.454.CMB.1.raw
tcagtgtgagtagtcacgaccggtgctcgatttagtacacgtgattagggattggggtctggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcgggggcaaagctgccctgacactgtcaggtgtgcagcctgaggacgaggctgactattactgcctgctcatatatggtgcgcgtgggtgttcgggcggagggaccaaggctgaccgtctgggtcaggcccaaggcctacggccccctcggtccacgtcctcggttccccgcccttcccg

SEQ ID NO: 164288 - DNA, 539 bp, Homo sapiens
  misc_feature: GYAE6OF02I378J.43.23.C01.1.454.CMB.1.raw
  modified_base (325)..(325): a, c, t, g, unknown or other
  misc_feature (325)..(325): n is a, c, g, or t
  modified_base (372)..(372): a, c, t, g, unknown or other
  misc_feature (372)..(372): n is a, c, g, or t
  modified_base (377)..(377): a, c, t, g, unknown or other
  misc_feature (377)..(377): n is a, c, g, or t
tcagtgtgagtagtcacgaccggtgctcgatttagtacacgtgattagggattggggaaagcatcatccaacaaccacatcccttctctacagaagcctctgagaggaaagttcttcaccatggactggacctggagggtcttctgcttgctggctgtagctccaggtaaagggccaactggttccaggactgaggaagggattttttccagtttagaggactgtcattttctactgtgtcctctccgcaggtgctcactcccaggtgcagttggtccagtctggggctgaggtgaagagcctggggcctcagtgaaggtttccngcaaggcatctggatactcctcacgacctactacattcacgtgggtncgacncggcccctggacagggacttgagtggagtgggaataatcactccctagtagtggtgaccacaaactacgacacagaacgttccgagggcagagtccaccagtcggaccgggacacgtccaccggaccgacggtctacagtggacgctaggagacacgcctcg

SEQ ID NO: 164289 - DNA, 550 bp, Homo sapiens
  misc_feature: GYAE6OF02GQID5.43.23.C01.1.454.CMB.1.raw
  modified_base (326)..(326): a, c, t, g, unknown or other
  misc_feature (326)..(326): n is a, c, g, or t
tcagtgtgagtagtcacgaccggtgctcgatttagtacacgtgattagggattggggaaagcatcatccaacaaccacatcccttctctacagaagcctctgagaggaaagttcttcaccatggactggacctggagggtcttctgcttgctggctgtagctccaggtaaagggccaactggttccaggactgaggaagggattttttccagtttagaggactgtcattttctactgtgtcctctccgcaggtgctcactcccaggtgcagttggtccagtctggggctgaggtgaagagcctggggcctcgagtgaaggtttccngcaaggcatcgtggactactccttacacgacctactacattcacgtggtgcgacacggcccctaggaccgagggtacttggagtggagtagggaataatcactcctagtagtggtacgaccaacaaactacgacacgagaacgtcgaggcagacgtcacagtacggaccgggacacgccaacgaccgaccgtctacgagtacgacgtcgtgacgcgacgctacg

SEQ ID NO: 164290 - DNA, 710 bp, Homo sapiens
  misc_feature: GYAE6OF02HKAP2.43.23.C01.1.454.CMB.1.raw
  modified_base (326)..(326): a, c, t, g, unknown or other
  misc_feature (326)..(326): n is a, c, g, or t
tcagtgtgagtagtcacgaccggtgctcgatttagtacacgtgattagggattggggaaagcatcatccaacaaccacatcccttctctacagaagcctctgagaggaaagttcttcaccatggactggacctggagggtcttctgcttgctggctgtagctccaggtaaagggccaactggttccaggactgaggaagggtatttttccagtttagaggactgtcattttctactgtgtcctctccgcaggtgctcacctcccaggtgcagttggtccagtctggggctgaggtgaagagcctggggcctcagtgaaggtttccngcaaggcagtctggatacctccttcacgtacctactacatttccacgtgggtcgccgacgacgggccccctagggaaccgtaggggtacgttaggacggttgggaacggttaggggtaaacttaaagtaccgtaacgttacccggtaaggttacgggttcgggttacgaccctaaaccgtaaaaccgttaaccgacctaacgtaacggtaaacggtttacccgaacggggtactaacggaacggtaccgaaacccgtaacggttaccgggaacccgggggtaaccacccgggttaccccgaaccggtaaccccgtaaccgggtaccgtaaccgtaacggtacgggtaacggtccgtaggaacggaccgtacggtacccgtacgg

SEQ ID NO: 164291 - DNA, 565 bp, Homo sapiens
  misc_feature: GYAE6OF02G4XSR.43.23.C01.1.454.CMB.1.raw
  modified_base (314)..(314): a, c, t, g, unknown or other
  misc_feature (314)..(314): n is a, c, g, or t
  modified_base (328)..(328): a, c, t, g, unknown or other
  misc_feature (328)..(328): n is a, c, g, or t
  modified_base (378)..(378): a, c, t, g, unknown or other
  misc_feature (378)..(378): n is a, c, g, or t
  modified_base (383)..(383): a, c, t, g, unknown or other
  misc_feature (383)..(383): n is a, c, g, or t
tcagtgtgagtagtcacgaccggtgctcgatttagtacacgtgattagggattggggaaagcatcatccaacaaccacatcccttctctacagaagcctctgagaggaaagttcttcaccatggactggacctggagggtcttctgcttgctggctgtagctccaggtaaaggccaactggttccaggactgaggaagggattttttccagtttagaggactgtctattttctactgtgtcctctccgcaggtgctcactcccaggtgcagttggtccaggtctggggctggaggtgaagagccgtggggcctnagtgaaggtttccngcaagcatcgtggactacctcctcacgacctactacattcacgtgggtcncgacncggcccctggaccagggtacttgaggtggagtagggaatagtcactcctagtagtgcgaccacaactcgacacgaagacgtccgaggacaggacgtccaaccgagtacggacccgggacaccgtacccgaccggaccgtaccggtactaacgacgtacggacgcgtcggacgcgacgctacg

SEQ ID NO: 164292 - DNA, 587 bp, Homo sapiens
  misc_feature: GYAE6OF02FZ3W1.43.23.C01.1.454.CMB.1.raw
  modified_base (257)..(257): a, c, t, g, unknown or other
  misc_feature (257)..(257): n is a, c, g, or t
  modified_base (330)..(330): a, c, t, g, unknown or other
  misc_feature (330)..(330): n is a, c, g, or t
  modified_base (384)..(384): a, c, t, g, unknown or other
  misc_feature (384)..(384): n is a, c, g, or t
tcagtgtgagtagtcacgaccggtgctcgatttagtacacgtgattagggattggggaaagcatcatccaacaaccacatcccttctctacagaagcctctgagagggaagttcgtcaaccgatggactggacctggagggtcttctgcttgctggctgtagctccaggtaaagggccaactggttccaggactgaggaagggtattttttccagtttagaggactgtcattttctactgtgtcctctccgcaggtnctcactcccaggtgcagttggtccagtctggggctgaggtgaagagccgtggggcctcgagtgaaggtttccngacaaggcatcgtggatacctccttcaccgtacctactacattcacgtgggtcncgtacgcggtccccgtggaccagggtactggaggtggagtagggaataatctactacccgtagtagtggtcgaccaacgaaacctacgacacgaacgtaacgttaccgagggacagacgtccactagtacggaccgggacaccgtacccgaccggaacccgacggtacctaacgagtcggacgcgtacggacgcacgcctacg

SEQ ID NO: 164293 - DNA, 793 bp, Homo sapiens
  misc_feature: GYAE6OF02ICJM8.43.23.C01.1.454.CMB.1.raw
  modified_base (224)..(224): a, c, t, g, unknown or other
  misc_feature (224)..(224): n is a, c, g, or t
tcagtgtgagtagtcacgaccggtgctcgatttagtacacgtgattagggattggggtctggcgccaggggtcccttccaatatcagcaccatggcctggactcctctctttctgttcctcctcacttgctgcccagggtccagttctcagactgtggtgactcgaggagccctcactgactgtgtcccgaggagggacaggtcacgtctcactgtgctttggnggctggacagtcacgagtcgcttaccataccaaacttcggttccagacagaagccgtggacgaacggccccacggccactagtactttagtggtagcgaactaaacgaaacgtactccgtacggaccccttacggtcccggttttcacgggtctaccccgtccgtccgggggactaaacggccgtacgcccgttacgaaccgtaccgtcggtaccgagggttacgtcgtaccgaacggtccgttaggaaccgggtaacggaacgggtacgtacggtaacgttaaacgtttaccggtaccgtacccgttacggttccttacgtaaacgttacttaaggtacgggtcgggtaccgggttccggggttagggggttaccggggtttaccgggggaccgggggttaagggaacccggtaaaagggtccgtttaccgggaacccgggttccgggttacggggtacccggaacggtaaccccgggaacgggtaccgttacccggtccccccggttacgggtcccgtaacccggtttccgttacccggtttacccccgtacccccgtttaccccgg

SEQ ID NO: 164294 - DNA, 551 bp, Homo sapiens
  misc_feature: GYAE6OF02HG66V.43.23.C01.1.454.CMB.1.raw
  modified_base (328)..(328): a, c, t, g, unknown or other
  misc_feature (328)..(328): n is a, c, g, or t
  modified_base (350)..(350): a, c, t, g, unknown or other
  misc_feature (350)..(350): n is a, c, g, or t
  modified_base (376)..(376): a, c, t, g, unknown or other
  misc_feature (376)..(376): n is a, c, g, or t
  modified_base (542)..(542): a, c, t, g, unknown or other
  misc_feature (542)..(542): n is a, c, g, or t
tcagtgtgagtagtcacgaccggtgctcgatttagtacacgtgattagggattggggaaagcatcatccaacaaccacatcccttctctacagaagcctctgagaggaaagttcttcaccatggactggacctggagggtcttctgcttgctggctgtagctccaggtaaagggccaactggttccaggactgaggaagggtattttttccagtttagaggactgtcattttctactgtgtcctctccgcaggtgctcactcccaggtgcagttggtccagtctgggctgaggtgaagagccgtggggcctcgaggtgaaggtttccngcaaggcatctggatactcctnacgacctactacattcacgtgggtcncgacacggcccctggacagggtacttggagtggagtagggaataatcactcccgtagtagtggtagaccaacaaacgtacgcaacgagaacgttccgagggcagacgtccacagcggaccgggacaccgtaccaccggaaccaccggtcaacagtggacgcgtagngcacgctcg

SEQ ID NO: 164295 - DNA, 535 bp, Homo sapiens
  misc_feature: GYAE6OF02F8HPP.43.23.C01.1.454.CMB.1.raw
  modified_base (327)..(327): a, c, t, g, unknown or other
  misc_feature (327)..(327): n is a, c, g, or t
  modified_base (374)..(374): a, c, t, g, unknown or other
  misc_feature (374)..(374): n is a, c, g, or t
tcagtgtgagtagtcacgaccggtgctcgatttagtacacgtgattagggattggggaaagcatcatccaacaaccacatcccttctctacagaagcctctgagaggaaagttcttcaccatggactggacctggagggtcttctgcttgctggctgtagctccaggtaaagggccaactggttccaggactgaggaagggtattttttccagtttagaggactgtcattttctactgtgtcctctccgcaggtgctcacctcccaggtgcagttggtccagtctggggctgaggtgaagagcctggggcctcagtgaaggtttccngcaaggcatctggatactccttcacgacctactacattcactgggtncgacaggcccctggacagggacttggagtggatgggaataatcatccctagtagtggtgccaacaactacgacacagaagttccgagggcagagtcaccagtcgaccgggacacgtaccacgaccacggtacctacgataggacgcgtgacgcagcctacg

SEQ ID NO: 164296 - DNA, 533 bp, Homo sapiens
  misc_feature: GYAE6OF02IIQB9.43.23.C01.1.454.CMB.1.raw
  modified_base (329)..(329): a, c, t, g, unknown or other
  misc_feature (329)..(329): n is a, c, g, or t
  modified_base (374)..(374): a, c, t, g, unknown or other
  misc_feature (374)..(374): n is a, c, g, or t
tcagtgtgagtagtcacgaccggtgctcgatttagtacacgtgattagggattggggaaagcatcatccaacaaccacatcccttctctacagaagcctctgagaggaaagttcttcaccatggactggacctggagggtcttctgcttgctggctgtagctccaggtaaagggccaactggttccaggactgaggaagggtattttttccagttttagaggactgtcatttttctactgtgtcctctccgcaggtgctcactcccaggtgcagttggtccagtctggggctgaggtgaagaagctgggggcctcagtgaaggtttccngcaaggcatctggatactcctcacgacctactacattcactgggncgacaggccctggacagggacttgagtggagtggaataatcactccctagtagtggtcgccaacaactacgcaacagacgtaccgaggcagacgtcacagtcggaccgggacacgtccacgaccacggtctacgagtggacgctggacgcacgcctcgg

SEQ ID NO: 164297 - DNA, 650 bp, Homo sapiens
  misc_feature: GYAE6OF02G0VRA.43.23.C01.1.454.CMB.1.raw
  modified_base (318)..(318): a, c, t, g, unknown or other
  misc_feature (318)..(318): n is a, c, g, or t
  modified_base (335)..(335): a, c, t, g, unknown or other
  misc_feature (335)..(335): n is a, c, g, or t
  modified_base (384)..(384): a, c, t, g, unknown or other
  misc_feature (384)..(384): n is a, c, g, or t
  modified_base (387)..(387): a, c, t, g, unknown or other
  misc_feature (387)..(387): n is a, c, g, or t
tcagtgtgagtagtcacgaccggtgctcgatttagtacacgtgattagggaagttaggggtctggcgccaggggtcccttccaactactcagcaacatggcctggactccgtctctttctgttcctcctcacttgctgcccagggtccagttctcagactgtggtgactcaggagccctcactgactgtcgtccccaggagggacagtcactctcacctgtgtctttggtggctggaccagtcaccagtgcttaccataccaaagtcggttccagcagaacgcctgacgacggccccaacggcactgtatttatggtncgactaacaacactccncggaccctcgtccggtttcacggctccctcgtcgggacaagctcgcctnacnctgtcaggtgtagcacgccgtaggacgggacggacggcgttggaacttacgttacgtcggcctcgtcctataacgttattaaggttcggtcgggccggtcgggttggggtttagggttccgggggacgggtacggggaaccgaacggtacgtccgggtaccggttcgggtcgggttccgaacgggtacccgtaacggcccgtttcccggaccccgttccggtacccttccggttcccgtttaccgttccccgaccccttaccc

SEQ ID NO: 164298 - DNA, 541 bp, Homo sapiens
  misc_feature: GYAE6OF02G4N26.43.23.C01.1.454.CMB.1.raw
  modified_base (253)..(253): a, c, t, g, unknown or other
  misc_feature (253)..(253): n is a, c, g, or t
  modified_base (327)..(327): a, c, t, g, unknown or other
  misc_feature (327)..(327): n is a, c, g, or t
  modified_base (523)..(523): a, c, t, g, unknown or other
  misc_feature (523)..(523): n is a, c, g, or t
tcagtgtgagtagtcacgaccggtgctcgatttagtacacgtgattagggattggggaaagcatcatccaacaaccacatcccttctctacagaagcctctgagaggaaagttcttcaccatggactggacctggagggtcttctgcttgctggctgtagctccaggtaaaggccaactggttccaggactgaggaaggtattttttccagtttagaggactgtcatttttcactgtgtcctctccgcaggtnctcacctcccaggtgcagttggccagtctggggctgaggtgaagaagccgtggggcctcgagtgaaggtttccngcaaggcatctggatactccttcacgtacctactacattcacgtggtgcgacgacggcccctaggacagggtacttggagtggagtagggaataatcatccgtagtgtgtcgacacaactcgacacagtaacgtccgaggcagacgtcacgagtcgaccgggacaccgtccaccgaccgacgtcacgacgtggacncgtagacgcgacgctcgg

SEQ ID NO: 164299 - DNA, 650 bp, Homo sapiens
  misc_feature: GYAE6OF02IC1EV.43.23.C01.1.454.CMB.1.raw
  modified_base (337)..(337): a, c, t, g, unknown or other
  misc_feature (337)..(337): n is a, c, g, or t
tcagtgtgagtagtcacgaccggtgctcgatttagtacacgtgattagggattgggggaaagcatcatccaacaaccacatcccttctctacagaagcctctgagaggaaagttcttcaccatggactggacctgggagggtcttctgcttgctggctgtagctccaggtaaagggccaactggttccaggactgaggaaggtatttttccagtttagaggactgtcattttctactgtgtcctctccgcaggtgctcacctcccgaggtgcagttcggtccagttcgtggggctggaggtgaaggaagccgtggggcctgagtgtaacggtttccngacgaaggcatcgtaggatacctccttacgacgaaccctactacgattaccgacgttgggtcacgaacacgggcccctaggaccgaggggtacttggaggtgggagtagggtaaatactacacgttacccgtaaggttaggtgggtcaccctaaacgaaacgtaccgacaacgtacggaacgttcccggagggacaaggtacgtaccaaccgtacgtacgggaacccggggtaacaccgtacccgaaccggtaacccgtaccggtacctaacgacgtgggacgacgtggaacggaccgtacggacccgtacgg

SEQ ID NO: 164300 - DNA, 750 bp, Homo sapiens
  misc_feature: GYAE6OF02H7RFI.43.23.C01.1.454.CMB.1.raw
  modified_base (271)..(271): a, c, t, g, unknown or other
  misc_feature (271)..(271): n is a, c, g, or t
  modified_base (436)..(436): a, c, t, g, unknown or other
  misc_feature (436)..(436): n is a, c, g, or t
tcagtgtgagtagtcacgaccggtgctcgatttagtacacgtgattagggattggggaaagcatcatccaacaaccacatcccttctctaacagaagcctctgagaggaaagttcttcaccatggactggacctggagggtcttctgcttgctggctgtagctccaggtaaagggccaactggttcaggctgaggaagggtatttttccagtttagaggactgtctattttctacttgtcgtcctctccgcaggtgctcacctccaggtcncagtttggtccaggtctcggggctggaggtgtaagaacggtccgtacgggggcccttacgagggttacgtacggttttaccctggaccgaagggtccagtcgtaggacttaccgttccttcgaaccgtacctacttactacttacgacgttggtacgtaccgaancccggtccccgtagggacgtagggttacgtcgggtagtaggtaacggttagggaacttaacgtctaccgttacccgtaaggttaggttcggacgtaacccgtaaggtaaaacccctgtacccgtaaagtaacgtacgttaaccccgggaggtaaccggagtaacgtcctaaacccgagggttaacccgggtaacccgggggacctaaacccggtccgtaaacccgggaaccccgttaaccgggttacccgtaaccggtaacgttacggaaccgggttccaacgggttacgtacccggtacggtacccttaccgg

SEQ ID NO: 164301 - DNA, 568 bp, Homo sapiens
  misc_feature: GYAE6OF02HV1GF.43.23.C01.1.454.CMB.1.raw
  modified_base (258)..(258): a, c, t, g, unknown or other
  misc_feature (258)..(258): n is a, c, g, or t
  modified_base (272)..(272): a, c, t, g, unknown or other
  misc_feature (272)..(272): n is a, c, g, or t
  modified_base (333)..(333): a, c, t, g, unknown or other
  misc_feature (333)..(333): n is a, c, g, or t
  modified_base (545)..(545): a, c, t, g, unknown or other
  misc_feature (545)..(545): n is a, c, g, or t
tcagtgtgagtagtcacgaccggtgctcgatttagtacacgtgattagggattggggaaagcatcatccaacaaccacatcccttctctacagaagcctctgagaggaaagttcttcaccatggactggacctggagggtcttctgcttgctggctgtagctccgaggtaaagggccaacgtggttccaggactgaggaaggtatttttccagtttagaggactgtctattttctactgtcgtcctctccgcaggtcnctcactccgaggtnctaggttcggtccagtcgtggggctggaggtgaagagccgtgggctcgaggtgtacgttcngcgaaggcagtcgtaggatacctcctcacgtacctactactatcgagtgggtcgcgacaccggtcccgtggacgtacgggtacttaggaggtaggagtaggaataactcgtacgtccgtagttagtcggtacgaccaacaacgtacacaacgagtacgtcgaggcagctacacgagacggacgacacgtaccgacgaccacgtcacgtacgnggacgcgtagacgcacgtctacg

SEQ ID NO: 164302 - DNA, 357 bp, Homo sapiens
  misc_feature: GYAE6OF02J0FO4.43.23.C01.1.454.CMB.1.raw
  modified_base (333)..(333): a, c, t, g, unknown or other
  misc_feature (333)..(333): n is a, c, g, or t
  modified_base (335)..(338): a, c, t, g, unknown or other
  misc_feature (335)..(338): n is a, c, g, or t
  modified_base (340)..(357): a, c, t, g, unknown or other
  misc_feature (340)..(357): n is a, c, g, or t
tcagtgtgagtagtcacgaccggtgctcgatttagtacacgtgattagggattggggctggcgccaggggtcccttccaatatcagcaccatggcctggactcctctctttctgttcctcctcacttgctgcccagggtccaattctcagactgtggtgagggaggagccctcactgactgtgtccccaggagggacagtcactctcaccttgtacttccaacactggagctgtcacaatggtacagcccaaggctacgccccctggtccactctcgttccccacctcctcactactcacactgacgcggctggacaacggcgcatagcagtnannnnannnnnnnnnnnnnnnnnn

SEQ ID NO: 164303 - DNA, 691 bp, Homo sapiens
  misc_feature: GYAE6OF02IDANO.43.23.C01.1.454.CMB.1.raw
  modified_base (306)..(306): a, c, t, g, unknown or other
  misc_feature (306)..(306): n is a, c, g, or t
  modified_base (328)..(328): a, c, t, g, unknown or other
  misc_feature (328)..(328): n is a, c, g, or t
tcagtgtgagtagtcacgaccggtgctcgatttagtacacgtgattagggagttggggaaagcatcatccaacaaccacatcccttctctacagaagcctctgagaggaaagttcttcaccatggactggacctggaggtcttctgcttgctggctgtagctccaggtaaaggccaactggtccaggactgaggaaggtattttttccagtttagaggactgtctattttctactgtcgtcctctccgcgaggtcgctcacctccgaggtgcagttggtccagtcgtggggctggaggtgaagaancgtgggcctgagtgagtttccngcagcatcgtgactactctcacgtacctacatacttcacgtgggtcgacgacgacggcccctggaacgtacgggtacttcggaggttggaacgtagggtaaattaacgtcaacgttacccgtaagggttagtaggttcgaccctaaacgtaaaccgttaccgacgtaaccgacggtaaaccgtttaccggaacggggtacaagggtaacgttaccaacccggtaggttaccggggaaacccggggacctaacccggttacccggaaacccgggtaacccgtaacccggggttaacctaaaccgtaggttaaccgggacggttaccggttacggaaccggtaccggtacccggtacgtaaccgg

SEQ ID NO: 164304 - DNA, 565 bp, Homo sapiens
  misc_feature: GYAE6OF02GVEQG.43.23.C01.1.454.CMB.1.raw
  modified_base (252)..(252): a, c, t, g, unknown or other
  misc_feature (252)..(252): n is a, c, g, or t
  modified_base (302)..(302): a, c, t, g, unknown or other
  misc_feature (302)..(302): n is a, c, g, or t
  modified_base (325)..(325): a, c, t, g, unknown or other
  misc_feature (325)..(325): n is a, c, g, or t
  modified_base (379)..(379): a, c, t, g, unknown or other
  misc_feature (379)..(379): n is a, c, g, or t
tcagtgtgagtagtcacgaccggtgctcgatttagtacacgtgattagggattgggggaaagcatcatccaacaaccacatcccttctctacagaagcctctgagaggaaagttcttcaccatggactggacctggagggtcttctgcttgctggctgtagctccaggtaaagggccaactggttccaggactgaggaagggtattttttccagtttagaggactgtcattttctactgtgtcctctccgcnggtgctcactcccaggtgcagttggtccagtctggggctgaggtgaagancgtgggcctcagtgaaggtttcngcaaggcatctggactactccttcacgacctactacattcacgtgggtgcgacncggcccctggaccagggtaccttaggagtggaagtggggaattaagtcactcccgtagtagtggtcgaccaacgaactacgcacgagaacgttccgaggcagacgtcaccagtggacccgggtacacgtccgaccgaccgaccggtacctacgacgtcggacgacgtacgacgacacgtccgtacg

SEQ ID NO: 164305 - DNA, 614 bp, Homo sapiens
  misc_feature: GYAE6OF02GE32D.43.23.C01.1.454.CMB.1.raw
  modified_base (270)..(270): a, c, t, g, unknown or other
  misc_feature (270)..(270): n is a, c, g, or t
  modified_base (334)..(334): a, c, t, g, unknown or other
  misc_feature (334)..(334): n is a, c, g, or t
tcagtgtgagtagtcacgaccggtgctcgatttagtacacgtgattagggattggggaaagcatcatccaacaaccacatcccttctctacagaagcctctgagaggaaagttcttcaccatggactggacctggagggtcttctgcttgctggctgtagctccaggtaaagggccaactggttccaggactgaggaagggtattttttccagtttagaggactgtctattttctatgtgtcctctccgcaggtgctcactcccaggtcnctagttggtccagtcgtggggctggaggtgaagagccgtggggcctcgaggtgtaaggtttccnggcaaggctatcgtggacttaccttccttccaacgacctactacacttacacgttgggtcgacgaccgtacggcccctggacgagggtacgttggagtggagtaggggaataatcgtactccgtaaggtaggtggtcgtacctaacaaccgtacgacctaacgaacgtaagttaccgagggacagacgtacaccgtagtccggaaccgggacaccgtaccgaaccggacccgtacggtaccgtacgtagtacggacgcgtacgacggcgaccgtcgtacg

SEQ ID NO: 164306 - DNA, 745 bp, Homo sapiens
  misc_feature: GYAE6OF02JTL87.43.23.C01.1.454.CMB.1.raw
  modified_base (198)..(198): a, c, t, g, unknown or other
  misc_feature (198)..(198): n is a, c, g, or t
  modified_base (247)..(247): a, c, t, g, unknown or other
  misc_feature (247)..(247): n is a, c, g, or t
  modified_base (727)..(727): a, c, t, g, unknown or other
  misc_feature (727)..(727): n is a, c, g, or t
tcagtgtgagtagtcacgaccggtgctcgatttagtacacgtgattagggattggggaaagcatcatccaacaaccacatcccttctctacagaagcctctgagaggtaaagttcttcaccatggactggacctggaggtcttctgcttgctggctgtagctccaggtaacggccaactgtccaggactgaggaggtntttttccagtttagagtactgtctattttcactgttcgtcctcgtccgntaggtgcctacaccttcccgaggttgcctaggttcgtccgaggtcgtggggtcctgtacggtagaacgaggtccggtgggtccctacgaggttcgtaacggttttcccacggtacgtaaacgggcctagtccgttagggtacctaccgttcccgtttaccaacccgtacccgttaccttacgaacgtttccgagtttcgggtcggaccgtaccgaacccggtcccggtacggaccggtacggtcgtttacggcggtaggtaggttacgggtaaacgttacgacgttaccgtacccggttagtacgggttggtaccgtacccaaaccgtaaacctccggtactaaccgtacggttaacgttaccccggaagggtcccaaagggtcgtacccgtaaccgtaggtaccgggaacccgggtacacccgtaccggacccgtaaccggaaccggttaacacgggtacgtacggtacgcggttacgnggtaacgcgtaccgtacg

SEQ ID NO: 164307 - DNA, 976 bp, Homo sapiens
  misc_feature: GYAE6OF02HM6OC.43.23.C01.1.454.CMB.1.raw
tcagtgtgagtagtcacgaccggtgctcgatttagtacacgtgattagggattggggaaagcatcatccaacaaccacatcccttctctacagaagcctctgagaggaaagttcttcaccatggaccgtcggacgtgggaggttcttctgtcgttcgcgtggtcgtagtacgcctaccggaaagggtaaacgggacctaacggttcggttaccgaaggtacgtagggaaggggtaagggttttacttttttaccgtaaggtttaaggacggtacgttacgttactttactttttactacgttggttccgttcccttcccgtccgtacgtacgggtcgtcctaccgtacccgtacccggtagggttcgtaacggttgggttttccggtaccgtacgggttccgggtcgggggtccgttaggggtaacggggtaaggaaaacgggtaaccggtcccggggtaccgggggtacccttacggtaagggttacgggttaaccggttttccgacggtaacggtaacgggtcttaacgttcggtacggtaacctttacccttacccgttacgaacccgttacccttaactaacttactttaccggtacggttggggtaccgaccggaaccgtaccccgggttaccccggtaagggaaccgggtaacggggtttaccgttaggggtacgggtaaggggtaagggttaaacgggtaaacttaaccgttaaccgtaaccggtttacccggttaaagggttcggtacgggttacccgaacccgtaaaaccgtaaacggtaccgaaccctaaacggtaacgttaaccggtaaccggacgggtaactaacggtaccgtaccgaaacccgggtaggtaacccgggaaccgggtaccccaccgtaacccggacccggtaaaccggtcccgttacgtaaccgtagggtacgtacggtaccgaggtacccggtaccggttacggccgtaacgg

SEQ ID NO: 164308 - DNA, 564 bp, Homo sapiens
  misc_feature: GYAE6OF02JDABG.43.23.C01.1.454.CMB.1.raw
  modified_base (326)..(326): a, c, t, g, unknown or other
  misc_feature (326)..(326): n is a, c, g, or t
  modified_base (376)..(376): a, c, t, g, unknown or other
  misc_feature (376)..(376): n is a, c, g, or t
tcagtgtgagtagtcacgaccggtgctcgatttagtacacgtgattggggattggggaaagcatcatccaacaaccacatcccttctctacagaagcctctgagaggaaagttcttcaccatggactggacctggagggtcttctgcttgctggctgtagctccaggtaaagggccaactggttccaggactgaggaagggtattttttccagtttagaggactgtcattttctactgtgtcctctccgcaggtgctcactcccaggtgcagttgtccagtctggggctggaggtgaagagccgtggggcctgagtgacggtttcngcaaggcatcgtgactctcttcacgtacctactacattcgacgtgggtcncgacgacggcccctggaccagggtctgagtggagtagggataagtcacttccgtagtgtggtcgaccaactaacctacgacacgtacgtacggtaccagggcaagcgtacgacctacgtcggaccgggtacacgtcccacggaccctacggtcaacgtacgtaggacgtcgacgcacgaccgcgtacg

SEQ ID NO: 164309 - DNA, 883 bp, Homo sapiens
  misc_feature: GYAE6OF02I6H5C.43.23.C01.1.454.CMB.1.raw
tcagtgtgagtagtcacgaccggtgctcgatttagtacacgtgattagggattgggaaagcatcatccaacaaccacatcccttctctacagaagcctctgagaggaaagttcttcaccatggactggacctggaggtcttctgcttgctggctgtagctccaggtaaaggccaactggttccaggactgaggaaggtattttttccagtttagaggactgtctattttctactgtcgtcctctccgcgaggtcgcctcacctcccgaggtcgctagttcggcctagtcgtggggcctggaggtgaagacgccgtgggtcctcgtagtcggtaacggtttcctagcgtaaggctacgtcgtggtactaccgttccttacgaccgtacccttaactaacctacgtttaccgtacggttcggggtacgtaccccgtaacggtaccccgggttacccccggtaggaaacccggtacggggttaacgtttacggacgggtacgggtaaggttaacggggtaaactttaaaccgttaccgttaaccgttaccccgtttaaaggggtttacggttaaccggggtttaaccgtaccccgttaaaaccgtaaaaccccgttaaccgggaacctaaaccgggtaaacgttaaacccgggtttacccggaaccgggtaccgttaacggtacccggttaacccgaaacccggttacggtaacccggggtaaccccggggtaacccgtacccgggttaaccccgaacccggggtaaaccccggttaacccgggttttaacccgtaacccgggttaacggttaccgggggtaaacccggttacccggtttaaccgggaccgttacccggaaacccggtttcccggttaaacccggg

SEQ ID NO: 164310 - DNA, 718 bp, Homo sapiens
  misc_feature: GYAE6OF02JYIKP.43.23.C01.1.454.CMB.1.raw
  modified_base (383)..(383): a, c, t, g, unknown or other
  misc_feature (383)..(383): n is a, c, g, or t
tcagtgtgagtagtcacgaccggtgctcgatttagtacacgtgattagggattggggaaagcatcatccaacaaccacatcccttctctacagaagcctctgagaggaaagttcttcaccatggactggacctggagggtcttctgcttgctggctgtagctccaggtaaggccaacgtggttccaggactggaggaaggtactttttccagtttagaggtactgtctattttcgtactgttcgttcctcgtccgctaggtgtcctccaccgtcccgaggttcgaccgtaggttcggtccgtaggttccggttgggggcttgggacgggttaggaaggaacggcccggtgggggtcctacgtaggtaggtaacgggttttccnggacgaacggtcaactcgtacggtaactacctccgtttaccgaccgtaaccctacttaaccgtacttccgtacgttggggtacaccgtacgaccggtacccctagggaccgtagggtacgttcggagtcggagtacggaattaacgtacgtacttacccgtaaggtcgtggtacgtacctaaaccgaaccgtacgacgtaacgaacgtaacgtaccgacggtacgaacgtacgtaaccgacgtacgtaccggaaccgggtaccgtaccgtacccgaaccggaacccgtaaccgtacctaacgacgtacggacgtacgagacgacgtacgcgtacg

SEQ ID NO: 164311 - DNA, 529 bp, Homo sapiens
  misc_feature: GYAE6OF02GD0XT.43.23.C01.1.454.CMB.1.raw
  modified_base (202)..(202): a, c, t, g, unknown or other
  misc_feature (202)..(202): n is a, c, g, or t
  modified_base (254)..(254): a, c, t, g, unknown or other
  misc_feature (254)..(254): n is a, c, g, or t
  modified_base (268)..(268): a, c, t, g, unknown or other
  misc_feature (268)..(268): n is a, c, g, or t
  modified_base (365)..(365): a, c, t, g, unknown or other
  misc_feature (365)..(365): n is a, c, g, or t
  modified_base (473)..(473): a, c, t, g, unknown or other
  misc_feature (473)..(473): n is a, c, g, or t
tcagtgtgagtagtcacgaccggtgctcgatttagtacacgtgattagggattggggaaagcatcatccaacaaccacatcccttctctacagaagcctctgagaggaaagttcttcaccatggactggacctggagggtcttctgcttgctggctgtagctccaggtaaagggccaactggttccaggactgaggaagggnttttttccagtttagaggactgtcattttctactgtgtcctctccgcaggtnctcactcccaggtncagttggtccagtctggggctgaggtgaagaagccgtggggcctcgagtgaaggtttcctgcaaggcatctggatactccttcaccgacctactacntttcactgggtgcgacaggcccctggacagggacttgagtggatgggaatatcatccctagtagtggtagccaacaactacgcacagaagttccaggcagagtcacangacgggacacgtcaccggaccacggtcctaacgactggacgcgtgacgcagcctcg

SEQ ID NO: 164312 - DNA, 777 bp, Homo sapiens
  misc_feature: GYAE6OF02FP44X.43.23.C01.1.454.CMB.1.raw
  modified_base (176)..(176): a, c, t, g, unknown or other
  misc_feature (176)..(176): n is a, c, g, or t
  modified_base (314)..(314): a, c, t, g, unknown or other
  misc_feature (314)..(314): n is a, c, g, or t
  modified_base (372)..(372): a, c, t, g, unknown or other
  misc_feature (372)..(372): n is a, c, g, or t
tcagtgtgagtagtcacgaccggtgctcgatttagtacacgtgattagggattgggggtctggcgccaggggtcccttccaatatcagcaccatggcctggactcctctctttctgttcctcctcacttgctgcccagggtccagttctcagactggtggtgactcaggagccctnactgactgtcgtccccgagggagggacagtcactctcacctgtgtcgtttggtggctggaccagtcaccagtgccttaccataccaaactggtaccagacagaagcctaggacaacggcccacggcacgtgtattagnggtacgacgaactaaaccaactacgtaccgtcggtaccccgtggttccccggtttacncggtcctcccgtccggtccgggggacaaacggctcgccgtagtaccgtacgttcggtacgtgggttacgtcgaccgtacgtaccggtaggaacgggtacggtacgggtcttaccggtaacttacgttaccgtcggtaccgttcggtactcgttaaacgttagttacggtaggggttcggtccgggtacggggtttaggggttaccggggttacgggggtaccgggtaaaccggggaacccgtaacggtcccgggttaccgggtaccccgggtttacccggacgggggtaccctaacccgggtacccggaaaccgggttccccgttaccccgggtacccccggttccggtaaccgtttcccggttacccggtttacccccggttcccccgttacccccgttacccg

SEQ ID NO: 164313 - DNA, 589 bp, Homo sapiens
  misc_feature: GYAE6OF02F7K14.43.23.C01.1.454.CMB.1.raw
  modified_base (342)..(342): a, c, t, g, unknown or other
  misc_feature (342)..(342): n is a, c, g, or t
  modified_base (397)..(397): a, c, t, g, unknown or other
  misc_feature (397)..(397): n is a, c, g, or t
  modified_base (402)..(402): a, c, t, g, unknown or other
  misc_feature (402)..(402): n is a, c, g, or t
  modified_base (410)..(410): a, c, t, g, unknown or other
  misc_feature (410)..(410): n is a, c, g, or t
tcagtgtgagtagtcacgaccggtgctcgatttagtacacgtgattagggattggggaaagcatcatccaacaaccacatcccttctctacagaagcctctgagaggaaagttcttcaccatggactggacctggagggtcttctgcttgctggctgtagctccgaggtaaagggccaacgtggttccaggactggaggaaggtattttttccagtttagaggtactgtctattttctactgtgtcctctccgcaggtgctccacctcccaggtcgcaggttggtccagtcgtggggctggaggtagaagaacgccgtggggcctcgagtgtaacgtttccngacaaggcagtctggtactacctccttacacgtacctactactattcacgtggtncgacncggtcccnggacgagggtactgagtggagtggaataatcactccgtagtagtgcaccacaactacgacacagtactccggaggcagtacgtacacgagtacgggaccgggaacctaccgacccgacggaacccgtacggtcctaacgtagcgggacgtacggtaggacgtaccgacgtacccgtacg

SEQ ID NO: 164314 - DNA, 852 bp, Homo sapiens
  misc_feature: GYAE6OF02IP9NY.43.23.C01.1.454.CMB.1.raw
  modified_base (345)..(345): a, c, t, g, unknown or other
  misc_feature (345)..(345): n is a, c, g, or t
  modified_base (421)..(421): a, c, t, g, unknown or other
  misc_feature (421)..(421): n is a, c, g, or t
tcagtgtgagtagtcacgaccggtgctcgatttagtacacgtgattagggattggggaaagcatcatccaacaaccacatcccttctctacagaagcctctgagaggaaagttcttcaccatggactggacctggaggtcttctgcttgctggctgtagctccgaggtaaaggccaactggtcaggactggaggaaggtatttttccagtttagaggactgtctattttctactgtgtcctctccgctaggtgcctacgactcccgaggtgccaggtttcgtccagttcgtggggctaggaggtgaagacgcccggtggggcctcgaggtggtaacggttttccngacgaagctagttcgtaggtactaccttccgtacaccggtaacccttactaactactttaccgacgttgggggtcnccgggtaacgacccgggtacccccggtaagggggtacccgtaacgggggttacccggtttagggtcgggttaaagggaacggtttaggggtaaaacttaaacgttaccgtaacgttaccccggttaaggggtttaaccggtttccgggtacggtaaaccccgtaaacccggtaaaaaccgttacccgggtaaccgtaaaccggtaaagggttaaacccggtttaacccggaaacggggtacgtaaccggtaaccgtacccgtaaaccggtaaaccggttacccgggaaaccccgggggtaaccgtacccggttaaccccgggaaccggtaaaccccgtaaacccgggttaccgtttaaaccggacggtttaccgggtaaccggtacccggttaacgggaaccggtaccccggtaacggaccggttaaccgg

SEQ ID NO: 164315 - DNA, 730 bp, Homo sapiens
  misc_feature: GYAE6OF02FIC57.43.23.C01.1.454.CMB.1.raw
  modified_base (241)..(241): a, c, t, g, unknown or other
  misc_feature (241)..(241): n is a, c, g, or t
tcagtgtgagtagtcacgaccggtgctcgatttagtacacgtgattagggattggggtctggcgccaggggtcccttccaatatcagcaccatggcctggactcctctctttctgttcctcctcacttgctgcccagggtccagttctcagactgtggtgactcaggagccctcactgactgtgtccccaggaggacagtcactctcacctgtgctttggtggctggaccagtcaccagtncttaccactaccaaactggttccagcagaagcctaggacaacggccccacggcactgtactttagtggtcgcgaactaaaccaaactacctccgtacggaccccgtcggtaccccggttttcgaccggtcctccccgtaccggtccgggggaacaacggtacctcgcccgttaggaacctacgtcgtcgagggttcgtcgactacggtccgtaggacggaccggaggtccgtagtaaccttacgttacgtcgtaccgttcgtaccttagtaacttacgtttagtcgggttacgggccggtccgggttaggggttccggtttaccgggggacgggtaaacgggtaaccgtaacggtacgtacccggtaacccggttccgtacggggttacccgaacgggtacccccgaagggtccccgtacccggtacccccgttcgggtacccgttacccggttcccgttacccggttccccgtacccccgttaccccg

SEQ ID NO: 164316 - DNA, 802 bp, Homo sapiens
  misc_feature: GYAE6OF02IG47G.43.23.C01.1.454.CMB.1.raw
tcagtgtgagtagtcacgaccggtgctcgatttagtacacgtgattagggattggggaaagcatcatccaacaaccacatcccttctctacagaagcctctgagaggaaagttcttcaccatggactggacctggagggtcttctgcttgctggctgtagctccaggtaaagggccaactggttccaggactggaggaagggtattttttccagttttagaggactgtctattttctactgttgtcctctccgcaggtgctcacctcccgaggtcgcgtaggttcggtccaggttcgtcggggcttggaggtagaaggaacgtccgtcgggggcctacgaggttcgtaacggttttccctaggaccgaagggctaacgtcgtaggtaacttaccgttccgtaccaccgtaacccttaacttaccgtactttaccgacgttgggggactccggaaccgtaccggggtacccccttagggaaccggtaacggggtacgtttcgggtaacgggttcgggtaaacggtaaggggtaaacttaacgttaaccgttaaccgttaccccggttaaggttaacgggttcgggttaccgtaacccgtaaaaccgtaaaccgttaaccgaacctaaaccggtaacggtaaacggttacccggaaggtaccgtaaggtaaccgtaccgaaccgtaacggtaccgggaacccggggtaaccgtacccggtacccgaacccggtaacccggtacccggtacctaaccgtaacgtacgggtacgtcgtacggaaccgtaccggtacgcccgtacgg

SEQ ID NO: 164317 - DNA, 806 bp, Homo sapiens
  misc_feature: GYAE6OF02FS5FA.43.23.C01.1.454.CMB.1.raw
  modified_base (248)..(248): a, c, t, g, unknown or other
  misc_feature (248)..(248): n is a, c, g, or t
  modified_base (792)..(792): a, c, t, g, unknown or other
  misc_feature (792)..(792): n is a, c, g, or t
tcagtgtgagtagtcacgaccggtgctcgatttagtacacgtgattagggattggggaaagcatcatccaacaaccacatcccttctctacagaagcctctgagaggaaagttcttcaccatggactggacctggagggtcttctgcttgctggctgtagctccaggtaaggccaactggtccagactgaggaggtatttttcagtttagagactgtctatttctacttgtgtcctctccgcaggtcnctcactcccgaggtcgcgtagttggtccgagtcgtggggctggaggtagaacggtaacgccggttaggggcccttacggtacggtaggtaacggttttcccgtaggaccgtaaacgggtcctaacgtttccgttacgggtaaactttacccgtttaccccgttaccgtaacccggtaaaccccttaaccctttaacccgtaaccgtttttacccgtaaccgggtttcggggtacccggtaaccggaacccggtaaccccgggtccccccggttaaggggaacccggtaacgggggtaccgtttagggtaacgggttaggggtaaaccgttaaggggttaaaccttaaacggtacctaaccggttacccgttaaggttacggttcggtacggacccgtaaaccgtaaccgtacgacgaacgacggttaacgtaccggtaggaccgtaggtacgtaccaacgtacggtaccgggaaccgggtaaccgtaccgtacccgaaccggtacccgtacggtactaccgtacgtacggacgtacgtcggacnccgtacgtcctagg

SEQ ID NO: 164318 - DNA, 698 bp, Homo sapiens
  misc_feature: GYAE6OF02HR4X7.43.23.C01.1.454.CMB.1.raw
tcagtgtgagtagtcacgaccggtgctcgatttagtacacgtgattagggattggggaaagcatcatccaacaaccacatcccttctctacagaagcctctgagaggaaagttcttcaccatggactggacctggagggtcttctgcttgctggctgtagctccaggtaaagggccaactggttccaggactgaggaagggtattttttccagtttagaggactgtctatttttctactgttcgtcctctccgctaggtgtctcactccgaggtgctagttggtccagtctggggctggaggtgaagaagccgtaggggccctgtagtaggtaacggtttccgtgacgaaggcagtcgtaggacttacgttccttacaccgtaccctacttaactacttcctaacgttcggggttcgaccgaccgaaccgggtcccccgttagggacggtaacgggtacgtttaggtaacggtcgggtaaggtaaggggtaaataaacgttcaaaccgttccgttaaggtacgtggttccgaacccgtaaccgaaacgttacgactaacgacgtaacgtcggaacggtaccgaagtacgtaccgtaaccgagtaccgggaaccgggacgacccgttaccggaaccggtaacccggaccggtaccgtacgacgtacggacgtccggtagacgtacgacgtccgtaccgg

SEQ ID NO: 164319 - DNA, 685 bp, Homo sapiens
  misc_feature: GYAE6OF02HR6EN.43.23.C01.1.454.CMB.1.raw
  modified_base (345)..(345): a, c, t, g, unknown or other
  misc_feature (345)..(345): n is a, c, g, or t
  modified_base (409)..(409): a, c, t, g, unknown or other
  misc_feature (409)..(409): n is a, c, g, or t
tcagtgtgagtagtcacgaccggtgctcgatttagtacacgtgattagggattggggaaagcatcatccaacaaccacatcccttctctacagaagcctctgagaggaaagttcttcaccatggactggacctggaggtcttctgcttgctggctgtagctccgaggtaaaggccaactggttccaggactggaggaaggtatttttccagtttagagactgtctattttctactgtcgtcctctccgcgtaggtcgcctcacctccgaggtgcctaggttcggtccaggttcgtggggcctggaggtgaagacggccgtgggacctgtagtggtaacggttccngacgaacggcagtcgtaggtacttacctccttacaccgtacctactactacttcgacgtggtcnccgaacgacggcccgtaggacggtaggtacgttggtaggtagggtagtagggtaaactactacgtacttacccgttaggtacggtcggttaccgaccgtaaactaaacgtaacccagaaccgaacggttaacggtacccgaagggacgtaaggtacccgtacgtaaaccgacggtaccggggacccgggaacctacccgttaccggaaacccggcggttaaacccggtcttaaccggacgtacggtacggtccgtaggacgtcggaccgtcgtacg

SEQ ID NO: 164320 - DNA, 680 bp, Homo sapiens
  misc_feature: GYAE6OF02IK93K.43.23.C01.1.454.CMB.1.raw
  modified_base (263)..(263): a, c, t, g, unknown or other
  misc_feature (263)..(263): n is a, c, g, or t
  modified_base (351)..(351): a, c, t, g, unknown or other
  misc_feature (351)..(351): n is a, c, g, or t
  modified_base (568)..(568): a, c, t, g, unknown or other
  misc_feature (568)..(568): n is a, c, g, or t
tcagtgtgagtagtcacgaccggtgctcgatttagtacacgtgattagggattggggaaagcatcatccaacaaccacatcccttctctacagaagcctctgagaggaaagttcttcaccatggactggacctgggagggtcttctgcttgctggctgtagctccaggtaaaggcctaacgtggttccaggactggaggtaaggtattttttccagtttagaggtactgtctattttctactgtcgtcctctccgcgaggtcnctccacctcccgaggtgctaggtttggtccagtcgtggggctggaggtgaagacgtccgtggggccttacgagtaggtacggtttccnggcaaggctatcgtaggacttacctcctacaaccgtaccctaacttacctattaccgaggtggtcgcggaaccgtaccggtccccgtggtaaccgagggttacctttaggaggttagggaacggtaaggtaaacttaacgtacgtaaccgtacccgttaggtaagttggtaccgacctaaacgtaaacgtaccgacgtaacgtacggtaacgttcgngggaactagaacggtaccaaccgtagtaccgggaaccggcgtaccgaccgaaccgtaaccggtacgtccgtaacgtaggtacggacgcgtacgaggtccgtagccctaacgg

SEQ ID NO: 164321 - DNA, 695 bp, Homo sapiens
  misc_feature: GYAE6OF02F3RMP.43.23.C01.1.454.CMB.1.raw
  modified_base (255)..(255): a, c, t, g, unknown or other
  misc_feature (255)..(255): n is a, c, g, or t
  modified_base (280)..(280): a, c, t, g, unknown or other
  misc_feature (280)..(280): n is a, c, g, or t
  modified_base (347)..(347): a, c, t, g, unknown or other
  misc_feature (347)..(347): n is a, c, g, or t
  modified_base (360)..(360): a, c, t, g, unknown or other
  misc_feature (360)..(360): n is a, c, g, or t
tcagtgtgagtagtcacgaccggtgctcgatttagtacacgtgattagggattggggaaagcatcatccaacaaccacatcccttctctacagaagcctctgagaggaaagttcttcaccatggactggacctgggagggtcttctgcttgctggctgtagcctccgaaggtaaaggccaactcggttccaggactggaaggaggtatttttccagtttagaggactgtctattttctactgtcgtcctctccgngaggtcgctccacctcccgaggtcnctaggttcgtcctagtcgtggggctggaggtagaagacggccgtggggcctgagtagtacggttccngacgagcagtcgngactactcctacacgtacctactactacttacgtacgtcggtcgacgtaccgaccggtccccgtagggaccgtagggtcgttgggtaggtacggagtaggaaattactctaacgttccgtagttaggtcggtacgaaccctaaacgtaaacgccgacgtaccgtaagggtaaccgtaccgggaagggtcctaaaggtccgtaaccgtaaccaacgggttaacccgggaaccgggtaaccgacccgtacccggaaccgtaacccggtaaccggttaaccgtaaccgtacggtacgggtaacgtcgtaaccgggacgtaccgaccgtaccgtaccgg

SEQ ID NO: 164322 - DNA, 717 bp, Homo sapiens
  misc_feature: GYAE6OF02FG5A5.43.23.C01.1.454.CMB.1.raw
  modified_base (345)..(345): a, c, t, g, unknown or other
  misc_feature (345)..(345): n is a, c, g, or t
tcagtgtgagtagtcacgaccggtgctcgatttagtacacgtgattagggattggggaaacgcatcattccaacaacccacatcccttctctacagaagcctctgagagaaagttcttcacatggactggacctgagggtcttctgcttgctggctgtagctccaggtaaaggccaactggtccaggactgagagggtatttttccagttagagtactgtactatttctactgtacgttcctcgtccgcaggttgctcacttcccgaggtgcctagttcggtacctagtcgtggggctaggacggttgaagagccgttaggggaccctgaggttgtaaggttccngactacgggctaactcgtggattacctccgttacaccggtaccttacgtacgtatttccgaacgttcgggtacgacgtaaccgacggggtccccccttaggggaacccgtaagggggtacccgttacgggtaacgttacgggtaacgttacggggtaaacttaacgtacgttaactacccgttaaggtacggttacggttacgtacccgtaaacgtaaaccgtaccggtacaaccggtaacgtaaaccggttaccgaacgggtacaacggtacgttaccgaacgtacgtacggacccgggaacgttccgaccgtaccgaaccctacggtacctacgtacgtacggacgtacgtagaccgcaccgtcgtaccg

SEQ ID NO: 164323 - DNA, 998 bp, Homo sapiens
  misc_feature: GYAE6OF02JQVT6.43.23.C01.1.454.CMB.1.raw
  modified_base (200)..(200): a, c, t, g, unknown or other
  misc_feature (200)..(200): n is a, c, g, or t
  modified_base (264)..(264): a, c, t, g, unknown or other
  misc_feature (264)..(264): n is a, c, g, or t
tcagtgtgagtagtcacgaccggtgctcgatttagtacacgtgattagggattggggaaagcatcatccaacaaccacatcccttctctacagaagcctctgagaggaaagttcttcaccatggactggacctggaggtcttctgcttgctggctgtagctccaggtaaaggccaactggtccaggactggaggaggttntttttcagtttagaggtactgtctatttctattgtcgttcctctccgcgtacggtgtcctaccnccgtcccgaggttcgcgtacggttgtcctaggttcggtacggggtctggtacggtacggaagtacgtccggtacgggggcctacggaggttacggtaacggttttcccgaggacctaaacggtcgtaacgttccggttaaggtacctttaccgttccttaccgtaaccgttaccgttaactaacgttacgtttaccgacggttcgggtaccgtaccggtaacccgtaccggtaccccggtacgggtaaaccggtacggggtttaacgtttacgggaagggtttacgggttaaacggttacggggtaaaactttaaccgggtaccgttaaaccgttaccccgggtttaaagggtacccggtttacggtaaaccgtaaccccgttaaaaccgggttaaacccgtaccgtaaacccggtaacgttaaccggggtttaaaacccgttaccggggaaacccgggtacgtaaaccggggtttaaaccccgttaacccggtaaacccgggttaaacccggtaaacccgggggggtttaaccccggggtaaaaccccccggtttaccccgggtttaaacccggggaaccccgggtttaaaccccccgggggttaaaccggttttaacccggtttaaaacccgggggaccggtttacccggggtaacccgggttttacggtaaaccgggtttaaccccggggtaaacccggttttaccccggacccgggtttaaaaccccggg

SEQ ID NO: 164324 - DNA, 683 bp, Homo sapiens
  misc_feature: GYAE6OF02FPGTC.43.23.C01.1.454.CMB.1.raw
  modified_base (328)..(328): a, c, t, g, unknown or other
  misc_feature (328)..(328): n is a, c, g, or t
tcagtgtgagtagtcacgaccggtgctcgatttagtacacgtgattagggattggggaaagcatcatccaacaaccacatcccttctctacagaagcctctgagaggaaagttcttcaccatggactggacctggagggtcttctgcttgctggctgtagctccaggtaaagggccaatggttccaggactgaggaagggtattttttccagtttagaggactgtcattttctactgtgtcctctccgcaggtgcctcactccccaggtgcagttggtccagtcgtggggctggaggtgaagaagccgtggggcctgagtgagttccngcgaggcatcgtggatacctccttacacgacctactactacttaccgacgtgggtcgaccgtacgtaccgggcccccgtagggaaccgagggtaccgtttgggaacggtgggtaacggttaggggtaaattaacgttacctaaccgttacccgttaacggtaggttacgggtcgtacctaaaccgtaaacgtacgtaccgaacgtaacggtaacgttaccggaacgggtacgaacggtaacgttaccgaacccgtaacgtacgggaccgtaacgggacccgtacccggtaacccgaaccggtaacccgtacgtacccgtaacgtggtacgtacgtcggacgacgaccgcgtaccg

SEQ ID NO: 164325 - DNA, 719 bp, Homo sapiens
  misc_feature: GYAE6OF02F43FF.43.23.C01.1.454.CMB.1.raw
  modified_base (198)..(198): a, c, t, g, unknown or other
  misc_feature (198)..(198): n is a, c, g, or t
  modified_base (588)..(588): a, c, t, g, unknown or other
  misc_feature (588)..(588): n is a, c, g, or t
tcagtgtgagtagtcacgaccggtgctcgatttagtacacgtgattagggattgggaaagcatcatccaacaaccacatcccttctcgtacagaagcctctggagaggaaacgttcttcaccatggactggacctgggacggtcttctgcttgctggctcgtagctccgaggtaaggccactgtccagctgagaggtntttttcagttagagtactgtctatttctactgtcgtcctccgtccgcgtaggtcgaccttccacgtcccgaggttcgacgtacggttggtccgtagtccgtggggtcctaggaggtacgaaggtaacggccgtggggcctgtacggttacggacgttttcccgaggacgaaggtctagttcctaggtacgttaccttccgttacaccgttaacctaccttacgtactttcgaccggtgggtcgacggtacgtacccggtaccccgtagggtaccgagggtacgttgggaacggtaggacggtaggtaactaactacgaacgttccgtaaggtaggtacgtacgaccgtaacgtaacctacgactaacgacgtaacgtacgtagcggtaanaccgttacacgtaacggacggtaaccgggaccgtacgtacccggaccgtaacccgggtaacccgttacgtaacccgtaggtaaccggtacggttaaccgacggtaccggtcccgtaccggtaccgtaacgg

SEQ ID NO: 164326 - DNA, 803 bp, Homo sapiens
  misc_feature: GYAE6OF02GWLJ3.43.23.C01.1.454.CMB.1.raw
  modified_base (204)..(204): a, c, t, g, unknown or other
  misc_feature (204)..(204): n is a, c, g, or t
tcagtgtgagtagtcacgaccggtgctcgatttagtacacgtgattagggattggggaaagcatcatccaacaaccacatcccttctctacagaagcctctgagaggaaagttcttcaccatggactggacctggagggtcttctgcttgctggctgtagctccaggtaaaggccaactggttccagggactggaggaagggtntttttccagtttagaggtactgtctattttcactgtcgtcctctccgcaggtgctccactcccgaggtgccgtagttcggtcctaggtcgtacgggggctaggtgggttagaaggaacggtcccggtggggggccccttcgaaggttacggtaaacgggttttccctaggaccgaaagggtctaacgttccgtacgggtaacttacccgttccttaccgtaaccggtacccttaacgtaactactttccgaccggttaggggtcgacccggtaacgaccggtcccccgtaggggaaccgacggggttacctttagggaacggttgggtaacggttacgggtaaacttaaacggttcctaaacgttacccggtaaacggttacggttacgggtaccgtaacccgtaaccgtaaaccggtactaccgtaaacgtaacgggtaccgttaaccggacgggtacgacggtacggttaccaaccggtacgttaccggggacccgggaacgtacccggaccgtacccggtaacccggaccggtttacccgaaccgtaacggttccggaacggtccggtacggaccgttaccgacgttcccgtaacg

SEQ ID NO: 164327 - DNA, 760 bp, Homo sapiens
  misc_feature: GYAE6OF02F761Z.43.23.C01.1.454.CMB.1.raw
  modified_base (248)..(248): a, c, t, g, unknown or other
  misc_feature (248)..(248): n is a, c, g, or t
tcagtgtgagtagtcacgaccggtgctcgatttagtacacgtgattagggattggggaaagcatcatccaacaaccacatcccttctctacagaagcctctgagaggaaagttcttcaccatggactggacctggagggtcttctgcttgctggctgtagctccaggtaaagggccaactggttccaggactgaggaagggtatttttccagtttagaggctgtctatttctactgtgtcctctccgnagtgctcactcccgagtgcagttcggtccagtctggggtctggaggtagaagacgccgttaggggcctacgaggtcgtaacggttttcccgagtacgaaacggctacgttcgtagggaacttaccgtcccttaccgaaccgtaaccctaactacgtaactttaccgacgttacgggtcgaccgtaacctacggggtccccctagggacccgtaacggggtaccgtttagggaacggttacgggaacgttaacggggtaaacttaaacgttaccgtaaacgttccccggtttaaggtacgggttgggttacgaacccgtaaaccgtaaaccgtaaccgaccgtaaaccggtaacgtaaccggttaccggacgggtaacgtaacgggtaacgttaccgaaacccgtaacgttaacccggggaacctaccgtacccaaccggaacccgtaaccggtacgttaccgacgttacggacgtacggtacggtaacggcgaacccggttccgtagtaccg

SEQ ID NO: 164328 - DNA, 649 bp, Homo sapiens
  misc_feature: GYAE6OF02JLWAV.43.23.C01.1.454.CMB.1.raw
  modified_base (247)..(247): a, c, t, g, unknown or other
  misc_feature (247)..(247): n is a, c, g, or t
  modified_base (252)..(252): a, c, t, g, unknown or other
  misc_feature (252)..(252): n is a, c, g, or t
  modified_base (335)..(335): a, c, t, g, unknown or other
  misc_feature (335)..(335): n is a, c, g, or t
  modified_base (413)..(413): a, c, t, g, unknown or other
  misc_feature (413)..(413): n is a, c, g, or t
tcagtgtgagtagtcacgaccggtgctcgatttagtacacgtgattagggagttggggaaagcatcatccaacaaccacatcccttctctacagaagcctctgagaggaaagttcttcaccatggactggacctggaggtcttctgcttgctggctgtagctcgaggtaaacggcaactggtccaggactgaggaggtatttttccagtttagaggtactgtctattttcactgtcgtcctctccgnaggtnctcactcccgaggtgctagttcgtcctagtcgtggggctggaggtagaagacgccgtggggcctcgaggtgtaacggtttccngaccgtaaggctagtcgtcggtacttaccgtccttaccaacggtacccttactactacgttctaacggtcggggtacnccgaccgtaccggtccccgtagggaccgtagggtccgttgaggtcggagtaggtaactactacgtactccgtaaggtgtacggctacctaacgaactacgacaacgtacgtaacgttaccgacggtacgtaacgtacgtccgaaacgtacggtacgggaaccggacctaccggtaaccaaccgtaccggtaacgtacgtaaccgaggtcggtacgcgtgaaccgtcggacgctacg

SEQ ID NO: 164329 - DNA, 753 bp, Homo sapiens
  misc_feature: GYAE6OF02IFP56.43.23.C01.1.454.CMB.1.raw
tcagtgtgagtagtcacgaccggtgctcgatttagtacacgtgattagggattggggaaagcatcatccaacaaccacatcccttctctacagaagcctctgagaggaaagttcttcaccatggactggacctgggagggtcttctgcttgctggctgtagctccaggtaaaggccaactggttccaggactgaggaagggtatttttccagttttagaggactgtctattttctactgtcgtcctctcgcaggtgctcacctccaggtcacgagttcgtccagtcgtggggtctggaggtagaagtaacggccgtgggcctagaggttaggtaacgtttcagcgaaggtctactcgtaggaacttaccttccgttacgaaccgtacctaactactagttccaacggttgggtacgaccgaacgcccggtccccgtaggaaccggtacgggttaccgtttagggtaggttacgggaaggttaaggggtaaaacttaacgttactaccgttacccggttaagggttaacgttacgggtaaccgaacccgttaaaccgtaaaaccgtaacccgtataaaccggaacgttaaaccggttaccggaacggggaactaaggtaacggttaccgaaacctacgggtaccgggaaccgggaccgtaacccgtacccgaaaccggtaacccgtaaacggttacccgtaacttacggtacggtaacgtcggttaacgaacggaccgaccgtaccgtaaccgg

SEQ ID NO: 164330 - DNA, 561 bp, Homo sapiens
  misc_feature: GYAE6OF02HS0CS.43.23.C01.1.454.CMB.1.raw
  modified_base (254)..(254): a, c, t, g, unknown or other
  misc_feature (254)..(254): n is a, c, g, or t
  modified_base (379)..(379): a, c, t, g, unknown or other
  misc_feature (379)..(379): n is a, c, g, or t
tcagtgtgagtagtcacgaccggtgctcgatttagtacacgtgattagggattggggaaagcatcatccaacaaccacatcccttctctacagaagcctctgagaggaaagttcttcaccatggactggacctggagggtcttctgcttgctggctgtagctccaggtaaagggccaactggttccaggactgaggaagggattttttccagtttagaggactgtcatttttcactgtgtcctctccgcaggtnctcactccaggtgcagttgtccagtcgtgggctgaggtgaagagccgtggggcctcgagtgaaggtttcctgccgaaggcagtctggactacctccttacacgacctactacattcacgtggtcncgacacggccctggacagggtacttggagtggaagtgggaataagtcatccgtagtagtggtacaccacaaactacgacacgaagtacgttacgaacgggacaggtactccaccagtcggaccgggacaccgtaccaccggaaccgaccggtcacgtagcggacgcgtacgagccacgctcg

SEQ ID NO: 164331 - DNA, 824 bp, Homo sapiens
  misc_feature: GYAE6OF02HRX6P.43.23.C01.1.454.CMB.1.raw
  modified_base (801)..(801): a, c, t, g, unknown or other
  misc_feature (801)..(801): n is a, c, g, or t
tcagtgtgagtagtcacgaccggtgctcgatttagtacacgtgattagggattggggaaagcatcatccaacaaccacatcccttctctacagaagcctctgagaggaaagttcttcaccatggactggacctggagggtcttctgcttgctggctgtagctccaggtaaacgggccaactggtcaggactgaggaggtactttttccagtttagagactgtctattttctactgtcgtcctctccgtcaggttcgctcacctacccgaggttcgcgtaggtttcggtccaggttccggtgggggccttagggacgggttaggaaacggtaacggtcccgggttacggggggccccttacggtaacgggttagggttaaaccgggtttttcccgaggaccgaagggtcctagttaccgtacggtacttacccgtaccctttaccgaacccgtaacccttaccttaaccgtactttacccgtaacgggttcggggttcgaacccggtaacccggtacccgggtacccccggtaggggtaacccgggtaacggggggttaccgtttacgggtacgggtaacggggttaacgggttaaacggggtaaacttaaaccgtaaccttaacccgttcccggttaaggtacgggttacgggtaccgtaaccccgaaaccttaaaccgaccgaccgtaaccgtaacgggtaaccggttacccggagggacctaacggacgttaccgaaccggacgaccgggaacccggacgacccgtacccgaccggaacccgtacggtaccacgtacgngacgtcgacgagcgccgtctacg

SEQ ID NO: 164332 - DNA, 194 bp, Homo sapiens
  misc_feature: GYAE6OF01BQG13.30.10.A10.1.454.CMB.1.raw
  modified_base (192)..(194): a, c, t, g, unknown or other
  misc_feature (192)..(194): n is a, c, g, or t
tcagcacgctacgtcacgaccggtgctcgattagcgtcgatctcagggtccggagatcatgaggtgtccttggtttgggaagaggaagactgacggtcccaggagttcaggtgctgggcacagcggccctgggctgcctggtcaaggactacttccacgtagcgtgctgagcgggctggcaaggcgcatagnnn

SEQ ID NO: 164333 - DNA, 198 bp, Homo sapiens
  misc_feature: GYAE6OF01AL9Z9.30.10.A10.1.454.CMB.1.raw
  modified_base (195)..(198): a, c, t, g, unknown or other
  misc_feature (195)..(198): n is a, c, g, or t
tcagcacgctacgtcacgaccggtgctcgatttagcgtcgatctcagggtccggagatcatgaggtgtccttgggtttgggaagaggaagactgatggtccccaggagttcaggtgctgggcacagcggccctgggctgcctggtcaaggactacttccacgtagcgtgctgagcgggctggcaaggcgcatagnnnn

SEQ ID NO: 164334 - DNA, 203 bp, Homo sapiens
  misc_feature: GYAE6OF01D6DPG.30.10.A10.1.454.CMB.1.raw
  modified_base (201)..(203): a, c, t, g, unknown or other
  misc_feature (201)..(203): n is a, c, g, or t
tcagcacgctacgtcacgaccggtgctcgatttagcgtcgatctcagggtccgggagatcatgagggtgtccttgggttttgggggaagaggaagactgacggtcccccaggagttcaggtgctgggcacagcggccctgggctgcctggtcaaggactacttccacgtagcgtgctgagcgggctggcaaggcgcatagnnn

SEQ ID NO: 164335 - DNA, 248 bp, Homo sapiens
  misc_feature: GYAE6OF01D3NLZ.30.10.A10.1.454.CMB.1.raw
  modified_base (241)..(248): a, c, t, g, unknown or other
  misc_feature (241)..(248): n is a, c, g, or t
tcagcacgctacgtcacgaccggtgctcgatttagcgtcgatctcagggtcttcgtggctcacgtccaccaccacgcatgtgacctcaggggtccggagatcatgagggtgtccttgggtttgggggaagaggaagactgacggtcccccaggagttcaggtgctgggcacagcggccctgggctgcctggtcaaggctacttccacgtagcgtgctgagcgggctggcaaggcgcatagnnnnnnnn

SEQ ID NO: 164336 - DNA, 235 bp, Homo sapiens
  misc_feature: GYAE6OF01A141B.30.10.A10.1.454.CMB.1.raw
  modified_base (207)..(235): a, c, t, g, unknown or other
  misc_feature (207)..(235): n is a, c, g, or t
tcagcacgctacgtcacgaccggtgctcgatttagcgtcgatctcgaggggtccgggagatcatgaggggtgtccttgggtttgggggaagaggaagactgacggtccccccaggagttcaggtgctgggcacagcggccctgggctggccctggtcaaggctacgttccgacgtagcgtgctgagcgggctggcaaggcgcatagnnnnnnnnnnnnnnnnnnnnnnnnnnnnn

SEQ ID NO: 164337 - DNA, 245 bp, Homo sapiens
  misc_feature: GYAE6OF01B3GXE.30.10.A10.1.454.CMB.1.raw
  modified_base (242)..(245): a, c, t, g, unknown or other
  misc_feature (242)..(245): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggtttgggggaagaggaagactgacggtcccccaggagttcaggtgctgggcacagcggcctgggctgcctggtcaaggactacttccacgtagcgtgctgagcgggctggcaaggcgcatagnnnn

SEQ ID NO: 164338 - DNA, 199 bp, Homo sapiens
  misc_feature: GYAE6OF01BX2T6.30.10.A10.1.454.CMB.1.raw
  modified_base (195)..(199): a, c, t, g, unknown or other
  misc_feature (195)..(199): n is a, c, g, or t
tcagcacgctacgtcacgaccggtgctcgatttagcgtcgatctcagggtccggagatcatgaggtgtccttgggtttgggaagaggaagactgacggtccccaggagttcaggtgctgggcacagcggccctgggctgcatggtcaaggactacttccacgtagcgtgctgagcgggctggcaaggcgcatagnnnnn

SEQ ID NO: 164339 - DNA, 200 bp, Homo sapiens
  misc_feature: GYAE6OF01CKMB4.30.10.A10.1.454.CMB.1.raw
  modified_base (199)..(200): a, c, t, g, unknown or other
  misc_feature (199)..(200): n is a, c, g, or t
tcagcacgctacgtcacgaccggtgctcgatttagcgtcgatctcagggtccgggagatcatgagggtgtccttgggtttggggaagaggaagactgacggtcccccaggagttcaggtgctgggcacagcggccctgggctgcctggtcaaggactacttccacgtagcgtgctgagcgggctggcaaggcgcatagnn

SEQ ID NO: 164340 - DNA, 242 bp, Homo sapiens
  misc_feature: GYAE6OF01DVVFY.30.10.A10.1.454.CMB.1.raw
  modified_base (240)..(242): a, c, t, g, unknown or other
  misc_feature (240)..(242): n is a, c, g, or t
tcagcacgctacgtcacgaccggtgctcgatttagcgtcgatctcagggtcttcgtggctcacgtccaccaccacgcatgtgacctcagggtccgggagatcatgagggtgtccttgggtttggggaagaggaagactgacggtcccccaggagttcaggtgctgggcacagcggcctgggctgcctggtcaaggactacttccacgtagcgtgctgagcgggctggcaaggcgcatagnnn

SEQ ID NO: 164341 - DNA, 212 bp, Homo sapiens
  misc_feature: GYAE6OF01CT7DX.30.10.A10.1.454.CMB.1.raw
  modified_base (203)..(212): a, c, t, g, unknown or other
  misc_feature (203)..(212): n is a, c, g, or t
tcagcacgctacgtcacgaccggtgctcgatttagcgtcgatctcaggggtccgggagatcatgagggtgtccttgggttttgggggaagaggaagactgacggtcccccaggagttcaggtgctgggcacgagcggccctgggctgcctggtcaaggactacttccacgtagcgtgctgagcgggctggcaaggcgcatagnnnnnnnnnn

SEQ ID NO: 164342 - DNA, 245 bp, Homo sapiens
  misc_feature: GYAE6OF01AE5LK.30.10.A10.1.454.CMB.1.raw
  modified_base (240)..(245): a, c, t, g, unknown or other
  misc_feature (240)..(245): n is a, c, g, or t
tcagcacgctacgtcacgaccggtgctcgatttagcgtcgatctcagggtcttcgtggctcacgtccaccaccacgcatgtgacctcagggtccgggagatcatgagggtgtccttgggtttggggaagaggaagactgacggtcccccaggagttcaggtgctgggcacagcggccctgggctgcctggtcaaggactacttccacgtagcgtgctgagcggctggcaaggcgcatagnnnnnn

SEQ ID NO: 164343 - DNA, 202 bp, Homo sapiens
  misc_feature: GYAE6OF01ANQ7H.30.10.A10.1.454.CMB.1.raw
  modified_base (199)..(202): a, c, t, g, unknown or other
  misc_feature (199)..(202): n is a, c, g, or t
tcagcacgctacgtcacgaccggtgctcgatttagcgtcgatctcagggtccgggagatcatgagggtgtccttgggtttggggaagaggaagactgacggtcccccaggagttcaggtgctgggcacagcggccctgggctgcctggtcaaggactacttccacgtagcgtgctgagcgggctggcaaggcgcatagnnnn

SEQ ID NO: 164344 - DNA, 209 bp, Homo sapiens
  misc_feature: GYAE6OF01BAO79.30.10.A10.1.454.CMB.1.raw
  modified_base (201)..(209): a, c, t, g, unknown or other
  misc_feature (201)..(209): n is a, c, g, or t
tcagcacgctacgtcacgaccggtgctcgatttagcgtcgatctcagggtccgggagatcatgagggtgtccttgggttttgggggaagaggaagactgacggtcccccaggagttcaggtgctgggcacagcggccctgggctgcctggtcaaggactacttccacgtagcgtgctgagcgggctggcaaggcgcatagnnnnnnnnn

SEQ ID NO: 164345 - DNA, 202 bp, Homo sapiens; identical to SEQ ID NO: 164343
  misc_feature: GYAE6OF01BQJTQ.30.10.A10.1.454.CMB.1.raw
  modified_base (199)..(202): a, c, t, g, unknown or other
  misc_feature (199)..(202): n is a, c, g, or t

SEQ ID NO: 164346 - DNA, 246 bp, Homo sapiens
  misc_feature: GYAE6OF01BNV2H.30.10.A10.1.454.CMB.1.raw
  modified_base (242)..(246): a, c, t, g, unknown or other
  misc_feature (242)..(246): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggtttgggggaagaggaagactgacggtccccaggagttcaggtgctgggcacagcggccctgggctgcctggtcaaggactacttccacgtagcgtgctgagcgggctggcaaggcgcatagnnnnn

SEQ ID NO: 164347 - DNA, 246 bp, Homo sapiens
  misc_feature: GYAE6OF01A0XD6.30.10.A10.1.454.CMB.1.raw
  modified_base (243)..(246): a, c, t, g, unknown or other
  misc_feature (243)..(246): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggtttgggggaagaggaagactgacggtcccccaggagttcaggtgctgggcacagcggccctgggctgcctggtcaaggactacttccacgtagcgtgctgagcgggctggcaaggcgcatagnnnn

SEQ ID NO: 164348 - DNA, 203 bp, Homo sapiens
  misc_feature: GYAE6OF01BAOMG.30.10.A10.1.454.CMB.1.raw
  modified_base (198)..(203): a, c, t, g, unknown or other
  misc_feature (198)..(203): n is a, c, g, or t
tcagcacgctacgtcacgaccggtgctcgatttagcgtcgatctcagggtccggagatcgatgagggtgtccttgggtttggggaagaggaagactgacggtccccaggagttcaggtgctgggcacagcggccctgggctgcctggtcaaggactacttccacgtagcgtgctgagcgggctggcaaggcgcatagnnnnnn

SEQ ID NO: 164349 - DNA, 205 bp, Homo sapiens
  misc_feature: GYAE6OF01BXG25.30.10.A10.1.454.CMB.1.raw
  modified_base (199)..(205): a, c, t, g, unknown or other
  misc_feature (199)..(205): n is a, c, g, or t
tcagcacgctacgtcacgaccggtgctcgatttagcgtcgatctcagggtccgggagatcatgagggtgtccttgggtttggggaagaggaagactgacggtcccccaggagttcaggtgctgggcacagcggccctgggctgcctggtcaaggactacttccacgtagcgtgctgagcgggctggcaaggcgcatagnnnnnnn

SEQ ID NO: 164350 - DNA, 264 bp, Homo sapiens
  misc_feature: GYAE6OF01EOJP7.30.10.A10.1.454.CMB.1.raw
  modified_base (244)..(264): a, c, t, g, unknown or other
  misc_feature (244)..(264): n is a, c, g, or t
tcagcacgctacgtcacgaccggtgctcgatttagcgtcgatctcagggtcttcgtggctcacgtccgaccaccacgcatgtgacctcaggggtccgggagatcatgagggtgtccttgggtttgggggaagaggaagactgacggtcccccaggagttcaggtgctgggcacagcggccctgggctgcctggtcaaggactacttccacgtagcgtgctgagcgggctggcaaggcgcatagnnnnnnnnnnnnnnnnnnnnn

SEQ ID NO: 164351 - DNA, 210 bp, Homo sapiens
  misc_feature: GYAE6OF01ANW9U.30.10.A10.1.454.CMB.1.raw
  modified_base (199)..(210): a, c, t, g, unknown or other
  misc_feature (199)..(210): n is a, c, g, or t
tcagcacgctacgtcacgaccggtgctcgatttagcgtcgatctcagggtccgggagatcatgagggtgtccttgggtttggggaagaggaagactgacggtcccccaggagttcaggtgctgggcacagcggccctgggctgcctggtcaaggactacttccacgtagcgtgctgagcgggctggcaaggcgcatagnnnnnnnnnnnn

SEQ ID NO: 164352 - DNA, 199 bp, Homo sapiens
  misc_feature: GYAE6OF01ALOXX.30.10.A10.1.454.CMB.1.raw
  modified_base (199)..(199): a, c, t, g, unknown or other
  misc_feature (199)..(199): n is a, c, g, or t
tcagcacgctacgtcacgaccggtgctcgatttagcgtcgatctcagggtccgggagatcatgagggtgtccttgggtttggggaagaggaagactgacggtcccccaggagttcaggtgctgggcacagcggccctgggctgcctggtcaaggactacttccacgtagcgtgctgagcgggctggcaaggcgcatagn

SEQ ID NO: 164353 - DNA, 246 bp, Homo sapiens
  misc_feature: GYAE6OF01EFRIC.30.10.A10.1.454.CMB.1.raw
  modified_base (242)..(246): a, c, t, g, unknown or other
  misc_feature (242)..(246): n is a, c, g, or t
tcagcacgctacgtcacgaccggtgctcgatttagcgtcgatctcagggtcttcgtggctcacgtccaccaccacgcatgtgacctcagggtccgggagatcatgagggtgtccttgggtttgggggaagaggaagactgacggtcccccaggagttcaggtgctgggcacagcggccctgggctgcctggtcaaggactacttccacgtagcgtgctgagcgggctggcaaggcgcatagnnnnn

SEQ ID NO: 164354 - DNA, 246 bp, Homo sapiens; identical to SEQ ID NO: 164347
  misc_feature: GYAE6OF01ELQHG.30.10.A10.1.454.CMB.1.raw
  modified_base (243)..(246): a, c, t, g, unknown or other
  misc_feature (243)..(246): n is a, c, g, or t

SEQ ID NO: 164355 - DNA, 199 bp, Homo sapiens
  misc_feature: GYAE6OF01DBIRG.30.10.A10.1.454.CMB.1.raw
  modified_base (197)..(199): a, c, t, g, unknown or other
  misc_feature (197)..(199): n is a, c, g, or t
tcagcacgctacgtcacgaccggtgctcgatttagcgtcgatctcagggtccgggagatcatgaggtgtccttgggtttggggaagaggaagactgacggtcccccaggagttcaggtgctggcacagcggccctgggctgcctggtcaaggactacttccacgtagcgtgctgagcgggctggcaaggcgcatagnnn

SEQ ID NO: 164356 - DNA, 204 bp, Homo sapiens
  misc_feature: GYAE6OF01BZQWG.30.10.A10.1.454.CMB.1.raw
  modified_base (200)..(204): a, c, t, g, unknown or other
  misc_feature (200)..(204): n is a, c, g, or t
tcagcacgctacgtcacgaccggtgctcgatttagcgtcgatctcagggtccgggagatcatgagggtgtccttgggtttgggggaagaggaagactgacggtcccccaggagttcaggtgctgggcacagcggccctgggctgcctggtcaaggactacttccacgtagcgtgctgagcgggctggcaaggcgcatagnnnnn

SEQ ID NO: 164357 - DNA, 246 bp, Homo sapiens; identical to SEQ ID NO: 164347
  misc_feature: GYAE6OF01C7E9U.30.10.A10.1.454.CMB.1.raw
  modified_base (243)..(246): a, c, t, g, unknown or other
  misc_feature (243)..(246): n is a, c, g, or t

SEQ ID NO: 164358 - DNA, 225 bp, Homo sapiens
  misc_feature: GYAE6OF01CL28C.30.10.A10.1.454.CMB.1.raw
  modified_base (201)..(225): a, c, t, g, unknown or other
  misc_feature (201)..(225): n is a, c, g, or t
tcagcacgctacgtcacgaccggtgctcgatttagcgtcgatctcagggggtccgggagatcatgagggtgtccttgggtttgggggaagaggaagactgacggtcccccaggagttcaggtgctgggcacagcggccctgggctgcctggtcaaggctacttccacgtagcgtgctgagcgggctggcaaggcgcatagnnnnnnnnnnnnnnnnnnnnnnnnn

SEQ ID NO: 164359 - DNA, 198 bp, Homo sapiens
  misc_feature: GYAE6OF01B06ZE.30.10.A10.1.454.CMB.1.raw
  modified_base (197)..(198): a, c, t, g, unknown or other
  misc_feature (197)..(198): n is a, c, g, or t
tcagcacgctacgtcacgaccggtgctcgatttagcgtcgatctcagggtccgggagatcatgagggtgtccttgggtttggggaagaggaagactgacggtcccccaggagttcaggtgctggcacagcggcctgggctgcctggtcaaggactacttccacgtagcgtgctgagcgggctggcaaggcgcatagnn

SEQ ID NO: 164360 - DNA, 201 bp, Homo sapiens
  misc_feature: GYAE6OF01CVHL1.30.10.A10.1.454.CMB.1.raw
  modified_base (200)..(201): a, c, t, g, unknown or other
  misc_feature (200)..(201): n is a, c, g, or t
tcagcacgctacgtcacgaccggtgctcgatttagcgtcgatctcagggtccgggagatcatgagggtgtccttgggtttgggggaagaggaagactgacggtcccccaggagttcaggtgctgggcacagcggccctgggctgcctggtcaaggactacttccacgtagcgtgctgagcgggctggcaaggcgcatagnn

SEQ ID NO: 164361 - DNA, 203 bp, Homo sapiens
  misc_feature: GYAE6OF01CA5FZ.30.10.A10.1.454.CMB.1.raw
  modified_base (200)..(203): a, c, t, g, unknown or other
  misc_feature (200)..(203): n is a, c, g, or t
tcagcacgctacgtcacgaccggtgctcgatttagcgtcgatctcagggtccgggagatcatgagggtgtccttgggttttggggaagaggaagactgacggtcccccaggagttcaggtgctgggcacagcggccctgggctgcctggtcaaggactacttccacgtagcgtgctgagcgggctggcaaggcgcatagnnnn

SEQ ID NO: 164362 - DNA, 219 bp, Homo sapiens
  misc_feature: GYAE6OF01B4BGY.30.10.A10.1.454.CMB.1.raw
  modified_base (203)..(219): a, c, t, g, unknown or other
  misc_feature (203)..(219): n is a, c, g, or t
tcagcacgctacgtcacgaccggtgctcgatttagcgtcgatctcagggggtccgggagatcatgagggtgtccttgggtttgggggaagaggaagactgaccggtcccccaggagttcaggtgctgggcacagcggccctgggctgcctggtcaaggactacttccacgtagcgtgctgagcgggctggcaaggcgcatagnnnnnnnnnnnnnnnnn

SEQ ID NO: 164363 - DNA, 202 bp, Homo sapiens
  misc_feature: GYAE6OF01ELNUS.30.10.A10.1.454.CMB.1.raw
  modified_base (201)..(202): a, c, t, g, unknown or other
  misc_feature (201)..(202): n is a, c, g, or t
tcagcacgctacgtcacgaccggtgctcgatttagcgtcgatctcagggtccgggagatcatgagggtgtccttgggttttgggggaagaggaagactgacggtcccccaggagttcaggtgctgggcacagcggccctgggctgcctggtcaaggactacttccacgtagcgtgctgagcgggctggcaaggcgcatagnn

SEQ ID NO: 164364 - DNA, 201 bp, Homo sapiens
  misc_feature: GYAE6OF01AGOLV.30.10.A10.1.454.CMB.1.raw
  modified_base (198)..(201): a, c, t, g, unknown or other
  misc_feature (198)..(201): n is a, c, g, or t
tcagcacgctacgtcacgaccggtgctcgatttagcgtcgatctcagggtccgggagatcatgaggtgtccttgggtttggggaagaggaagactgacggtcccccaggagttcaggtgctgggcacagcggccctgggctgcctggtcaaggactacttccacgtagcgtgctgagcgggctggcaaggcgcatagnnnn

SEQ ID NO: 164365 - DNA, 204 bp, Homo sapiens
  misc_feature: GYAE6OF01DE5U4.30.10.A10.1.454.CMB.1.raw
  modified_base (201)..(204): a, c, t, g, unknown or other
  misc_feature (201)..(204): n is a, c, g, or t
tcagcacgctacgtcacgaccggtgctcgatttagcgtcgatctcagggtccgggagatcatgagggtgtccttgggttttgggggaagaggaagactgacggtcccccaggagttcaggtgctgggcacagcggccctgggctgcctggtcaaggactacttccacgtagcgtgctgagcgggctggcaaggcgcatagnnnn

SEQ ID NO: 164366 - DNA, 249 bp, Homo sapiens
  misc_feature: GYAE6OF01CCAQB.30.10.A10.1.454.CMB.1.raw
  modified_base (244)..(249): a, c, t, g, unknown or other
  misc_feature (244)..(249): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttgggggaagaggaagactgacggtcccccaggagttcaggtgctgggcacagcggccctgggctgcctggtcaaggactacttccacgtagcgtgctgagcgggctggcaaggcgcatagnnnnnn

SEQ ID NO: 164367 - DNA, 200 bp, Homo sapiens
  misc_feature: GYAE6OF01CKRP5.30.10.A10.1.454.CMB.1.raw
  modified_base (198)..(200): a, c, t, g, unknown or other
  misc_feature (198)..(200): n is a, c, g, or t
tcagcacgctacgtcacgaccggtgctcgatttagcgtcgatctcagggtccgggagatcatgaggtgtccttgggtttggggaagaggaagactgacggtcccccaggagttcaggtgctgggcacagcggccctgggctgcctggtcaaggactacttccacgtagcgtgctgagcgggctggcaaggcgcatagnnn

SEQ ID NO: 164368 - DNA, 199 bp, Homo sapiens
  misc_feature: GYAE6OF01BUCUL.30.10.A10.1.454.CMB.1.raw
  modified_base (197)..(199): a, c, t, g, unknown or other
  misc_feature (197)..(199): n is a, c, g, or t
tcagcacgctacgtcacgaccggtgctcgatttagcgtcgatctcagggtccggagatcatgagggtgtccttgggtttggggaagaggaagactgacggtccccaggagttcaggtgctgggcacagcggccctgggctgcctggtcaaggactacttccacgtagcgtgctgagcgggctggcaaggcgcatagnnn

SEQ ID NO: 164369 - DNA, 247 bp, Homo sapiens
  misc_feature: GYAE6OF01CA9VS.30.10.A10.1.454.CMB.1.raw
  modified_base (243)..(247): a, c, t, g, unknown or other
  misc_feature (243)..(247): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggtttgggggaagaggaagactgacggtcccccaggagttcaggtgctgggcacagcggccctgggctgcctggtcaaggactacttccacgtagcgtgctgagcgggctggcaaggcgcatagnnnnn

SEQ ID NO: 164370 - DNA, 247 bp, Homo sapiens; identical to SEQ ID NO: 164369
  misc_feature: GYAE6OF01D7G3R.30.10.A10.1.454.CMB.1.raw
  modified_base (243)..(247): a, c, t, g, unknown or other
  misc_feature (243)..(247): n is a, c, g, or t

SEQ ID NO: 164371 - DNA, 244 bp, Homo sapiens
  misc_feature: GYAE6OF01DVNJ5.30.10.A10.1.454.CMB.1.raw
  modified_base (243)..(244): a, c, t, g, unknown or other
  misc_feature (243)..(244): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggtttgggggaagaggaagactgacggtcccccaggagttcaggtgctgggcacagcggccctgggctgcctggtcaaggactacttccacgtagcgtgctgagcgggctggcaaggcgcatagnn

SEQ ID NO: 164372 - DNA, 246 bp, Homo sapiens; identical to SEQ ID NO: 164347
  misc_feature: GYAE6OF01B2783.30.10.A10.1.454.CMB.1.raw
  modified_base (243)..(246): a, c, t, g, unknown or other
  misc_feature (243)..(246): n is a, c, g, or t

SEQ ID NO: 164373 - DNA, 202 bp, Homo sapiens; identical to SEQ ID NO: 164363
  misc_feature: GYAE6OF01BOW0B.30.10.A10.1.454.CMB.1.raw
  modified_base (201)..(202): a, c, t, g, unknown or other
  misc_feature (201)..(202): n is a, c, g, or t

SEQ ID NO: 164374 - DNA, 205 bp, Homo sapiens
  misc_feature: GYAE6OF01DY2WN.30.10.A10.1.454.CMB.1.raw
  modified_base (202)..(205): a, c, t, g, unknown or other
  misc_feature (202)..(205): n is a, c, g, or t
tcagcacgctacgtcacgaccggtgctcgatttagcgtcgatctcaggggtccgggagatcatgagggtgtccttgggttttgggggaagaggaagactgacggtcccccaggagttcaggtgctgggcacagcggccctgggctgcctggtcaaggactacttccacgtagcgtgctgagcgggctggcaaggcgcatagnnnn

SEQ ID NO: 164375 - DNA, 202 bp, Homo sapiens; identical to SEQ ID NO: 164343
  misc_feature: GYAE6OF01B6BBV.30.10.A10.1.454.CMB.1.raw
  modified_base (199)..(202): a, c, t, g, unknown or other
  misc_feature (199)..(202): n is a, c, g, or t

SEQ ID NO: 164376 - DNA, 246 bp, Homo sapiens; identical to SEQ ID NO: 164347
  misc_feature: GYAE6OF01CT3Q0.30.10.A10.1.454.CMB.1.raw
  modified_base (243)..(246): a, c, t, g, unknown or other
  misc_feature (243)..(246): n is a, c, g, or t

SEQ ID NO: 164377 - DNA, 201 bp, Homo sapiens; identical to SEQ ID NO: 164360
  misc_feature: GYAE6OF01CR40R.30.10.A10.1.454.CMB.1.raw
  modified_base (200)..(201): a, c, t, g, unknown or other
  misc_feature (200)..(201): n is a, c, g, or t

SEQ ID NO: 164378 - DNA, 203 bp, Homo sapiens
  misc_feature: GYAE6OF01CR4ZJ.30.10.A10.1.454.CMB.1.raw
  modified_base (202)..(203): a, c, t, g, unknown or other
  misc_feature (202)..(203): n is a, c, g, or t
tcagcacgctacgtcacgaccggtgctcgatttagcgtcgatctcaggggtccgggagatcatgagggtgtccttgggttttgggggaagaggaagactgacggtcccccaggagttcaggtgctgggcacagcggccctgggctgcctggtcaaggactacttccacgtagcgtgctgagcgggctggcaaggcgcatagnn

SEQ ID NO: 164379 - DNA, 252 bp, Homo sapiens
  misc_feature: GYAE6OF01BE8IP.30.10.A10.1.454.CMB.1.raw
  modified_base (242)..(252): a, c, t, g, unknown or other
  misc_feature (242)..(252): n is a, c, g, or t
tcagcacgctacgtcacgaccggtgctcgatttagcgtcgatctcaggggtcttcgtggctcacgtccaccaccacgcatgtgacctcaggggtccgggagatcatgagggtgtccttgggtttgggggagaggaagactgacggtcccccaggagttcaggtgctgggcacagcggccctgggctgcctggtcaaggactacttccacgtagcgtgctgagcggctggcaaggcgcatagnnnnnnnnnnn

SEQ ID NO: 164380 - DNA, 247 bp, Homo sapiens
  misc_feature: GYAE6OF01B59B1.30.10.A10.1.454.CMB.1.raw
  modified_base (242)..(247): a, c, t, g, unknown or other
  misc_feature (242)..(247): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggtttgggggaagaggaagactgacggtcccccaggagttcaggtgctgggcacagcggccctgggctgcctggtcaaggactacttccacgtagcgtgctgagcggctggcaaggcgcatagnnnnnn

SEQ ID NO: 164381 - DNA, 246 bp, Homo sapiens; identical to SEQ ID NO: 164347
  misc_feature: GYAE6OF01DTGY8.30.10.A10.1.454.CMB.1.raw
  modified_base (243)..(246): a, c, t, g, unknown or other
  misc_feature (243)..(246): n is a, c, g, or t

SEQ ID NO: 164382 - DNA, 209 bp, Homo sapiens
  misc_feature: GYAE6OF01CI7BG.30.10.A10.1.454.CMB.1.raw
  modified_base (202)..(209): a, c, t, g, unknown or other
  misc_feature (202)..(209): n is a, c, g, or t
tcagcacgctacgtcacgaccggtgctcgatttagcgtcgatctcaggggtccgggagatcatgagggtgtccttgggtttgggggaagaggaagactgacggtccccccaggagttcaggtgctgggcacagcggccctgggctgcctggtcaaggactacttccacgtagcgtgctgagcgggctggcaaggcgcatagnnnnnnnn

SEQ ID NO: 164383 - DNA, 203 bp, Homo sapiens; identical to SEQ ID NO: 164334
  misc_feature: GYAE6OF01AZFB9.30.10.A10.1.454.CMB.1.raw
  modified_base (201)..(203): a, c, t, g, unknown or other
  misc_feature (201)..(203): n is a, c, g, or t

SEQ ID NO: 164384 - DNA, 202 bp, Homo sapiens; identical to SEQ ID NO: 164363
  misc_feature: GYAE6OF01BQ9SJ.30.10.A10.1.454.CMB.1.raw
  modified_base (201)..(202): a, c, t, g, unknown or other
  misc_feature (201)..(202): n is a, c, g, or t

SEQ ID NO: 164385 - DNA, 208 bp, Homo sapiens
  misc_feature: GYAE6OF01CWT6W.30.10.A10.1.454.CMB.1.raw
  modified_base (201)..(208): a, c, t, g, unknown or other
  misc_feature (201)..(208): n is a, c, g, or t
tcagcacgctacgtcacgaccggtgctcgatttagcgtcgatctcgaggggtccgggagatcatgagggtgtccttgggttttggggaagaggaagactgacggtcccccagtagttcaggtgctgggcacagcggccctgggctgcctggtcaggactacttccacgtagcgtgctgagcgggctggcaaggcgcatagnnnnnnnn

SEQ ID NO: 164386 - DNA, 244 bp, Homo sapiens
  misc_feature: GYAE6OF01CF10Q.30.10.A10.1.454.CMB.1.raw
  modified_base (242)..(244): a, c, t, g, unknown or other
  misc_feature (242)..(244): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggtttgggggaagaggaagactgacggtcccccaggagttcaggtgctgggcacagcggccctgggctgcctggtcaaggactacttccacgtaggtgctgagcgggctggcaaggcgcatagnnn

SEQ ID NO: 164387 - DNA, 210 bp, Homo sapiens
  misc_feature: GYAE6OF01BTPEU.30.10.A10.1.454.CMB.1.raw
  modified_base (201)..(210): a, c, t, g, unknown or other
  misc_feature (201)..(210): n is a, c, g, or t
tcagcacgctacgtcacgaccggtgctcgatttagcgtcgatctcaggggtccgggagatcatgagggtgtccttgggtttgggggaagaggaagactgacggtcccccaggagttcaggtgctgggcacagcggccctgggctgcctggtaaaggactacttccacgtagcgtgctgagcgggctggcaaggcgcatagnnnnnnnnnn

SEQ ID NO: 164388 - DNA, 246 bp, Homo sapiens
  misc_feature: GYAE6OF01CHW8I.30.10.A10.1.454.CMB.1.raw
  modified_base (242)..(246): a, c, t, g, unknown or other
  misc_feature (242)..(246): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggtttggggaagaggaagactgacggtcccccaggagttcaggtgctgggcacagcggccctgggctgcctggtcaaggactacttccacgtagcgtgctgagcgggctggcaaggcgcatagnnnnn

SEQ ID NO: 164389 - DNA, 233 bp, Homo sapiens
  misc_feature: GYAE6OF01EIQQI.30.10.A10.1.454.CMB.1.raw
  modified_base (204)..(233): a, c, t, g, unknown or other
  misc_feature (204)..(233): n is a, c, g, or t
tcagcacgctacgtcacgaccggtgctcgatttagcgtcgatctcaggggtccgggagatcatgagggtgtccgttgggttttgggggaagaggaagacgtgacggtcccccaggagttcaggtgctgggcacagcggcctgggctgcctgggtcaaggctacgttccacgtagcgtgctgagcgggctggcaaggcgcatagnnnnnnnnnnnnnnnnnnnnnnnnnnnnnn

SEQ ID NO: 164390 - DNA, 221 bp, Homo sapiens
  misc_feature: GYAE6OF01BPZ87.30.10.A10.1.454.CMB.1.raw
  modified_base (202)..(221): a, c, t, g, unknown or other
  misc_feature (202)..(221): n is a, c, g, or t
tcagcacgctacgtcacgaccggtgctcgatttagcgtcgatctcgaggggtccgggagatcatggagggtgtccttgggtttggggaagaggaagactgacggtcccccaggagttcaggtgctgggcacaggcggccctgggctgcctggtcaaggctactccacgtagcgtgctgagcgggctggcaaggcgcatagcnnnnnnnnnnnnnnnnnnnn

SEQ ID NO: 164391 - DNA, 246 bp, Homo sapiens; identical to SEQ ID NO: 164347
  misc_feature: GYAE6OF01A6IR9.30.10.A10.1.454.CMB.1.raw
  modified_base (243)..(246): a, c, t, g, unknown or other
  misc_feature (243)..(246): n is a, c, g, or t

SEQ ID NO: 164392 - DNA, 201 bp, Homo sapiens
  misc_feature: GYAE6OF01AHMZL.30.10.A10.1.454.CMB.1.raw
  modified_base (201)..(201): a, c, t, g, unknown or other
  misc_feature (201)..(201): n is a, c, g, or t
tcagcacgctacgtcacgaccggtgctcgatttagcgtcgatctcagggtccgggagatcatgagggtgtccttgggttttgggggaagaggaagactgacggtcccccaggagttcaggtgctgggcacagcggccctgggctgcctggtcaaggactacttccacgtagcgtgctgagcgggctggcaaggcgcatagn

SEQ ID NO: 164393 - DNA, 200 bp, Homo sapiens; identical to SEQ ID NO: 164339
  misc_feature: GYAE6OF01AM2K5.30.10.A10.1.454.CMB.1.raw
  modified_base (199)..(200): a, c, t, g, unknown or other
  misc_feature (199)..(200): n is a, c, g, or t

SEQ ID NO: 164394 - DNA, 204 bp, Homo sapiens; identical to SEQ ID NO: 164365
  misc_feature: GYAE6OF01AHQG8.30.10.A10.1.454.CMB.1.raw
  modified_base (201)..(204): a, c, t, g, unknown or other
  misc_feature (201)..(204): n is a, c, g, or t

SEQ ID NO: 164395 - DNA, 205 bp, Homo sapiens
  misc_feature: GYAE6OF01CI72E.30.10.A10.1.454.CMB.1.raw
  modified_base (201)..(205): a, c, t, g, unknown or other
  misc_feature (201)..(205): n is a, c, g, or t
tcagcacgctacgtcacgaccggtgctcgatttagcgtcgatctcagggtccgggagatcatgagggtgtccttgggttttgggggaagaggaagactgacggtcccccaggagttcaggtgctgggcacagcggccctgggctgcctggtcaaggactacttccacgtagcgtgctgagcgggctggcaaggcgcatagnnnnn

SEQ ID NO: 164396 - DNA, 203 bp, Homo sapiens
  misc_feature: GYAE6OF01AYNSQ.30.10.A10.1.454.CMB.1.raw
  modified_base (202)..(203): a, c, t, g, unknown or other
  misc_feature (202)..(203): n is a, c, g, or t
tcagcacgctacgtcacgaccggtgctcgatttagcgtcgatctcagggtccgggagatcatgagggtgtccttgggttttgggggaagaggaagactgacggtccccccaggagttcaggtgctgggcacagcggccctgggctgcctggtcaaggactacttccacgtagcgtgctgagcgggctggcaaggcgcatagnn

SEQ ID NO: 164397 - DNA, 208 bp, Homo sapiens
  misc_feature: GYAE6OF01DMLS0.30.10.A10.1.454.CMB.1.raw
  modified_base (201)..(208): a, c, t, g, unknown or other
  misc_feature (201)..(208): n is a, c, g, or t
tcagcacgctacgtcacgaccggtgctcgatttagcgtcgatctcagggtccgggagatcatgagggtgtccttgggttttgggggaagaggaagactgacggtcccccaggagttcaggtgctgggcacagcggccctgggctgcctggtcaaggactacttccacgtagcgtgctgagcgggctggcaaggcgcatagnnnnnnnn

SEQ ID NO: 164398 - DNA, 247 bp, Homo sapiens; identical to SEQ ID NO: 164369
  misc_feature: GYAE6OF01EGUOJ.30.10.A10.1.454.CMB.1.raw
  modified_base (243)..(247): a, c, t, g, unknown or other
  misc_feature (243)..(247): n is a, c, g, or t

SEQ ID NO: 164399 - DNA, 244 bp, Homo sapiens
  misc_feature: GYAE6OF01CJV4V.30.10.A10.1.454.CMB.1.raw
  modified_base (242)..(244): a, c, t, g, unknown or other
  misc_feature (242)..(244): n is a, c, g, or t
tcagcacgctacgtcacgaccggtgctcgatttagcgtcgatctcagggtcttcgtggctcacgtccaccaccacgcatgtgacctcaggggtccggagatcatgagggtgtccttgggtttgggggaagaggaagactgacggtcccccaggagttcaggtgctgggcacagcggccctgggctgcctggtcaaggactacttccacgtagcgtgctgagcgggctggcaaggcgcatagnnn

SEQ ID NO: 164400 - DNA, 246 bp, Homo sapiens; identical to SEQ ID NO: 164347
  misc_feature: GYAE6OF01DCNN6.30.10.A10.1.454.CMB.1.raw
  modified_base (243)..(246): a, c, t, g, unknown or other
  misc_feature (243)..(246): n is a, c, g, or t

SEQ ID NO: 164401 - DNA, 235 bp, Homo sapiens
  misc_feature: GYAE6OF01BECWY.30.10.A10.1.454.CMB.1.raw
  modified_base (205)..(235): a, c, t, g, unknown or other
  misc_feature (205)..(235): n is a, c, g, or t
tcagcacgctacgtcacgaccggtgctcgatttagcgtcgatctcaggggtccgggagatcattgagggtgtccttgggttttgggggaagaggaagactgacggtccccccaggagttcaggtgctgggcacgagcggccctgggctgccgtggtcaaggactacttccacgtagcgtgctgagcggctggcaaggcgcatagnnnnnnnnnnnnnnnnnnnnnnnnnnnnnnn

SEQ ID NO: 164402 - DNA, 201 bp, Homo sapiens; identical to SEQ ID NO: 164360
  misc_feature: GYAE6OF01C6DP6.30.10.A10.1.454.CMB.1.raw
  modified_base (200)..(201): a, c, t, g, unknown or other
  misc_feature (200)..(201): n is a, c, g, or t

SEQ ID NO: 164403 - DNA, 220 bp, Homo sapiens
  misc_feature: GYAE6OF01DW8IR.30.10.A10.1.454.CMB.1.raw
  modified_base (203)..(220): a, c, t, g, unknown or other
  misc_feature (203)..(220): n is a, c, g, or t
tcagcacgctacgtcacgaccggtgctcgatttagcgtcgatctcaggggtccgggagatcatgagggtgtccttgggttttgggggaagaggaagactgacggtccccccaggagttcaggtgctgggcacagcggccctgggctgcctggtcaaggactacttccacgtagcgtgctgagcgggctggcaaggcgcatagnnnnnnnnnnnnnnnnnn

SEQ ID NO: 164404 - DNA, 254 bp, Homo sapiens
  misc_feature: GYAE6OF01CIGY1.30.10.A10.1.454.CMB.1.raw
  modified_base (241)..(254): a, c, t, g, unknown or other
  misc_feature (241)..(254): n is a, c, g, or t
tcagcacgctacgtcacgaccggtgctcgatttagcgtcgatctcagggtcttcgtggctcacgtccaccaccacgcatgtgacctcagggtccggagatcatgagggtgtccttgggtttgggggaagaggaagactgacggtcccccaggagttcaggtgctgggcacagcggccctgggctgcctggtcaaggactacttccacgtagcgtgctgagcgggctggcaaggcgcatagnnnnnnnnnnnnnn

SEQ ID NO: 164405 - DNA, 202 bp, Homo sapiens
  misc_feature: GYAE6OF01DA3VD.30.10.A10.1.454.CMB.1.raw
  modified_base (201)..(202): a, c, t, g, unknown or other
  misc_feature (201)..(202): n is a, c, g, or t
tcagcacgctacgtcacgaccggtgctcgatttagcgtcgatctcagggtccgggagatcatgagggtgtccttgggtttgggggaagaggaagactgacggtccccccaggagttcaggtgctgggcacagcggccctgggctgcctggtcaaggactacttccacgtagcgtgctgagcgggctggcaaggcgcatagnn

SEQ ID NO: 164406 - DNA, 243 bp, Homo sapiens
  misc_feature: GYAE6OF01DLUO3.30.10.A10.1.454.CMB.1.raw
  modified_base (240)..(243): a, c, t, g, unknown or other
  misc_feature (240)..(243): n is a, c, g, or t
tcagcacgctacgtcacgaccggtgctcgatttagcgtcgatctcagggtcttcgtggctcacgtccaccaccacgcatgtgacctcagggtccgggagatcatgagggtgtccttgggtttggggaagaggaagactgacggtccccaggagttcaggtgctgggcacagcggccctgggctgcctggtcaaggactacttccacgtagcgtgctgagcgggctggcaaggcgcatagnnnn

SEQ ID NO: 164407 - DNA, 246 bp, Homo sapiens; identical to SEQ ID NO: 164347
  misc_feature: GYAE6OF01D0RUR.30.10.A10.1.454.CMB.1.raw
  modified_base (243)..(246): a, c, t, g, unknown or other
  misc_feature (243)..(246): n is a, c, g, or t

SEQ ID NO: 164408 - DNA, 204 bp, Homo sapiens
  misc_feature: GYAE6OF01ELNAK.30.10.A10.1.454.CMB.1.raw
  modified_base (202)..(204): a, c, t, g, unknown or other
  misc_feature (202)..(204): n is a, c, g, or t
tcagcacgctacgtcacgaccggtgctcgatttagcgtcgatctcaggggtccgggagatcatgagggtgtccttgggttttgggggaagaggaagactgacggtcccccaggagttcaggtgctgggcacagcggccctgggctgcctggtcaaggactacttccacgtagcgtgctgagcgggctggcaaggcgcatagnnn

SEQ ID NO: 164409 - DNA, 205 bp, Homo sapiens
  misc_feature: GYAE6OF01B2ESL.30.10.A10.1.454.CMB.1.raw
  modified_base (204)..(205): a, c, t, g, unknown or other
  misc_feature (204)..(205): n is a, c, g, or t
tcagcacgctacgtcacgaccggtgctcgatttagcgtcgatctcgaggggtccgggagatcatggagggtgtccgttggggtttgggggaagaggaagactgaccggtcccccaggagttcaggtgctggcacagcggcctgggctgcctggtcaaggactacttccacgtagcgtgctgagcgggctggcaaggcgcatagnn

SEQ ID NO: 164410 - DNA, 231 bp, Homo sapiens
  misc_feature: GYAE6OF01DO1QI.30.10.A10.1.454.CMB.1.raw
  modified_base (206)..(231): a, c, t, g, unknown or other
  misc_feature (206)..(231): n is a, c, g, or t
tcagcacgctacgtcacgaccggtgctcgatttagcgtcgatctcgaggggtccgggagatcatgagggtgtccttgggttttgggggaagaggaagactgacggtccccccgacggagttcaggtgctgggcacagcggccctgggctgcctggtcaaggactacttccacgtagcgtgctgagcgggctggcaaggcgcatagnnnnnnnnnnnnnnnnnnnnnnnnnn

SEQ ID NO: 164411 - DNA, 246 bp, Homo sapiens; identical to SEQ ID NO: 164347
  misc_feature: GYAE6OF01ASULT.30.10.A10.1.454.CMB.1.raw
  modified_base (243)..(246): a, c, t, g, unknown or other
  misc_feature (243)..(246): n is a, c, g, or t

SEQ ID NO: 164412 - DNA, 204 bp, Homo sapiens
  misc_feature: GYAE6OF01E262V.30.10.A10.1.454.CMB.1.raw
  modified_base (201)..(204): a, c, t, g, unknown or other
  misc_feature (201)..(204): n is a, c, g, or t
tcagcacgctacgtcacgaccggtgctcgatttagcgtcgatctcagggtccgggagatcatgagggtgtccttgggttttgggggaagaggaagactgacggtcccccaggagttcaggtgctgggcacagcggccctgggctgcctggtcaaggacttacttccacgtagcgtctgagcgggctggcaaggcgcatagnnnn

SEQ ID NO: 164413 - DNA, 223 bp, Homo sapiens
  misc_feature: GYAE6OF01B2IGG.30.10.A10.1.454.CMB.1.raw
  modified_base (200)..(223): a, c, t, g, unknown or other
  misc_feature (200)..(223): n is a, c, g, or t
tcagcacgctacgtcacgaccggtgctcgatttagcgtcgatctcaggggtccgggagatcatgagggtgtccttgggtttgggggaagaggaagactgacggtcccccaggagttcaggtgctgggcacgagcggcctggctgcctggtcaaggactacttccacgtagcgtgctgagcggctggacaaggcgcatagnnnnnnnnnnnnnnnnnnnnnnnn

SEQ ID NO: 164414 - DNA, 248 bp, Homo sapiens
  misc_feature: GYAE6OF01DQUA3.30.10.A10.1.454.CMB.1.raw
  modified_base (243)..(248): a, c, t, g, unknown or other
  misc_feature (243)..(248): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggtttgggggaagaggaagactgacggtcccccaggagttcaggtgctgggcacagcggccctgggctgcctggtcaaggactacttccacgtagcgtgctgagcgggctggcaaggcgcatagnnnnnn

SEQ ID NO: 164415 - DNA, 235 bp, Homo sapiens
  misc_feature: GYAE6OF01ANSC5.30.10.A10.1.454.CMB.1.raw
  modified_base (202)..(235): a, c, t, g, unknown or other
  misc_feature (202)..(235): n is a, c, g, or t
tcagcacgctacgtcacgaccggtgctcgatttagcgtcgatctcaggggtccgggagatcatgagggtgtccttgggttttgggggaagaggaagactgacggtccccccaggagttcaggtgctgggcacagcggccctgggctgcctggtcaggactacttccacgtagcgtgctgagcgggctggcaaggcgcatagnnnnnnnnnnnnnnnnnnnnnnnnnnnnnnnnnn

SEQ ID NO: 164416 - DNA, 246 bp, Homo sapiens; identical to SEQ ID NO: 164347
  misc_feature: GYAE6OF01B3825.30.10.A10.1.454.CMB.1.raw
  modified_base (243)..(246): a, c, t, g, unknown or other
  misc_feature (243)..(246): n is a, c, g, or t

SEQ ID NO: 164417 - DNA, 246 bp, Homo sapiens; identical to SEQ ID NO: 164347
  misc_feature: GYAE6OF01CZ6M9.30.10.A10.1.454.CMB.1.raw
  modified_base (243)..(246): a, c, t, g, unknown or other
  misc_feature (243)..(246): n is a, c, g, or t

SEQ ID NO: 164418 - DNA, 246 bp, Homo sapiens; identical to SEQ ID NO: 164347
  misc_feature: GYAE6OF01EUBR5.30.10.A10.1.454.CMB.1.raw
  modified_base (243)..(246): a, c, t, g, unknown or other
  misc_feature (243)..(246): n is a, c, g, or t

SEQ ID NO: 164419 - DNA, 246 bp, Homo sapiens
  misc_feature: GYAE6OF01DNZ3E.30.10.A10.1.454.CMB.1.raw
  modified_base (190)..(190): a, c, t, g, unknown or other
  misc_feature (190)..(190): n is a, c, g, or t
  modified_base (207)..(246): a, c, t, g, unknown or other
  misc_feature (207)..(246): n is a, c, g, or t
tcagcacgctacgtcacgaccggtgctcgatttagcgtcgatctcagggggtccgggagatcatgagggtgtccttgggtttgggggaagaggaagactgacggtcccccgacggagttcaggtgctgggcacagcggccctgggctgcctgggtcaaggctacttccacgtagcgttgctgagccgggntggcaaggccgcatagnnnnnnnnnnnnnnnnnnnnnnnnnnnnnnnnnnnnnnnn

SEQ ID NO: 164420 - DNA, 205 bp, Homo sapiens; identical to SEQ ID NO: 164374
  misc_feature: GYAE6OF01C38J8.30.10.A10.1.454.CMB.1.raw
  modified_base (202)..(205): a, c, t, g, unknown or other
  misc_feature (202)..(205): n is a, c, g, or t

SEQ ID NO: 164421 - DNA, 204 bp, Homo sapiens; identical to SEQ ID NO: 164408
  misc_feature: GYAE6OF01DSE35.30.10.A10.1.454.CMB.1.raw
  modified_base (202)..(204): a, c, t, g, unknown or other
  misc_feature (202)..(204): n is a, c, g, or t

SEQ ID NO: 164422 - DNA, 204 bp, Homo sapiens
  misc_feature: GYAE6OF01CO7LV.30.10.A10.1.454.CMB.1.raw
  modified_base (201)..(204): a, c, t, g, unknown or other
  misc_feature (201)..(204): n is a, c, g, or t
tcagcacgctacgtcacgaccggtgctcgatttagcgtcgatctcaggggtccgggagatcatgagggtgtccttgggtttgggggaagaggaagactgacggtcccccaggagttcaggtgctgggcacagcggccctgggctgcctggtcaaggactacttccacgtagcgtgctgagcgggctggcaaggcgcatagnnnn

SEQ ID NO: 164423 - DNA, 211 bp, Homo sapiens
  misc_feature: GYAE6OF01CPYYJ.30.10.A10.1.454.CMB.1.raw
  modified_base (201)..(211): a, c, t, g, unknown or other
  misc_feature (201)..(211): n is a, c, g, or t
tcagcacgctacgtcacgaccggtgctcgatttagcgtcgatctcaggggtccgggagatcatgagggtgtccttgggtttgggggaagaggaagactgacggtcccccaggagttcaggtgctgggcacagcggccctgggctgcctggtcaaggactacttccacgtagcgtgctgagcgggctggcaaggcgcatagnnnnnnnnnnn

SEQ ID NO: 164424 - DNA, 253 bp, Homo sapiens
  misc_feature: GYAE6OF01BT5X3.30.10.A10.1.454.CMB.1.raw
  modified_base (206)..(206): a, c, t, g, unknown or other
  misc_feature (206)..(206): n is a, c, g, or t
  modified_base (208)..(253): a, c, t, g, unknown or other
  misc_feature (208)..(253): n is a, c, g, or t
tcagcacgctacgtcacgaccggtgctcgatttagcgtcgatctcaggggtccggggagatcatgagggtgtcccttgggtttgggggaagaggaagactcgacggtccccccaggagttcaggtgctgggcacagcggccctgggctgcctggtcaaggactacttccacgtagcgtgctgagcgggctggcaaggcgcataggnannnnnnnnnnnnnnnnnnnnnnnnnnnnnnnnnnnnnnnnnnnnnn

SEQ ID NO: 164425 - DNA, 247 bp, Homo sapiens; identical to SEQ ID NO: 164369
  misc_feature: GYAE6OF01A42TD.30.10.A10.1.454.CMB.1.raw
  modified_base (243)..(247): a, c, t, g, unknown or other
  misc_feature (243)..(247): n is a, c, g, or t

SEQ ID NO: 164426 - DNA, 200 bp, Homo sapiens; identical to SEQ ID NO: 164367
  misc_feature: GYAE6OF01DLCJ2.30.10.A10.1.454.CMB.1.raw
  modified_base (198)..(200): a, c, t, g, unknown or other
  misc_feature (198)..(200): n is a, c, g, or t

SEQ ID NO: 164427 - DNA, 202 bp, Homo sapiens
  misc_feature: GYAE6OF01C24TY.30.10.A10.1.454.CMB.1.raw
  modified_base (202)..(202): a, c, t, g, unknown or other
  misc_feature (202)..(202): n is a, c, g, or t
tcagcacgctacgtcacgaccggtgctcgatttagcgtcgatctcaggggtccgggagatcatgagggtgtccttgggtttgggggaagaggaagactgacggtccccccaggagttcaggtgctgggcacagcggccctgggctgcctggtcaaggactacttccacgtagcgtgctgagcgggctggcaaggcgcatagn

SEQ ID NO: 164428 - DNA, 247 bp, Homo sapiens
  misc_feature: GYAE6OF01EHFRJ.30.10.A10.1.454.CMB.1.raw
  modified_base (242)..(247): a, c, t, g, unknown or other
  misc_feature (242)..(247): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggtttgggggaagaggaagactgacggtcccccaggagttcaggtgctgggcacagcggcctgggctgcctggtcaaggactacttccacgtagcgtgctgagcgggctggcaaggcgcatagnnnnnn

SEQ ID NO: 164429 - DNA, 213 bp, Homo sapiens
  misc_feature: GYAE6OF01CW68C.30.10.A10.1.454.CMB.1.raw
  modified_base (200)..(213): a, c, t, g, unknown or other
  misc_feature (200)..(213): n is a, c, g, or t
tcagcacgctacgtcacgaccggtgctcgatttagcgtcgatctcgaggggtccgggagatcatgagggtgtccttgggtttgggggaagaggaagactgacggtcccccaggagttcaggtgctgggcacagcggcctgggctgcctggtcaaggctacttccacgtagcgtgctgagcgggctggcaaggcgcatagnnnnnnnnnnnnnn

SEQ ID NO: 164430 - DNA, 246 bp, Homo sapiens; identical to SEQ ID NO: 164347
  misc_feature: GYAE6OF01BJG3V.30.10.A10.1.454.CMB.1.raw
  modified_base (243)..(246): a, c, t, g, unknown or other
  misc_feature (243)..(246): n is a, c, g, or t

SEQ ID NO: 164431 - DNA, 204 bp, Homo sapiens; identical to SEQ ID NO: 164422
  misc_feature: GYAE6OF01CG1A1.30.10.A10.1.454.CMB.1.raw
  modified_base (201)..(204): a, c, t, g, unknown or other
  misc_feature (201)..(204): n is a, c, g, or t

SEQ ID NO: 164432 - DNA, 202 bp, Homo sapiens; identical to SEQ ID NO: 164363
  misc_feature: GYAE6OF01EFLK9.30.10.A10.1.454.CMB.1.raw
  modified_base (201)..(202): a, c, t, g, unknown or other
  misc_feature (201)..(202): n is a, c, g, or t

SEQ ID NO: 164433 - DNA, 249 bp, Homo sapiens
  misc_feature: GYAE6OF01CZ6YR.30.10.A10.1.454.CMB.1.raw
  modified_base (243)..(249): a, c, t, g, unknown or other
  misc_feature (243)..(249): n is a, c, g, or t
tcagcacgctacgtcacgaccggtgctcgatttagcgtcgatctcagggtcttcgtggctcacgtccaccaccacgcatgtgacctcaggggtccggagatcatgagggtgtccttgggttttgggggaagaggaagactgacggtcccccaggagttcaggtgctgggcacagcggccctgggctgcctggtcaaggactacttccacgtagcgtgctgagcgggctggcaaggcgcatagnnnnnnn

SEQ ID NO: 164434 - DNA, 246 bp, Homo sapiens; identical to SEQ ID NO: 164347
  misc_feature: GYAE6OF01AGD7B.30.10.A10.1.454.CMB.1.raw
  modified_base (243)..(246): a, c, t, g, unknown or other
  misc_feature (243)..(246): n is a, c, g, or t

SEQ ID NO: 164435 - DNA, 218 bp, Homo sapiens
  misc_feature: GYAE6OF01EO61Z.30.10.A10.1.454.CMB.1.raw
  modified_base (202)..(218): a, c, t, g, unknown or other
  misc_feature (202)..(218): n is a, c, g, or t
tcagcacgctacgtcacgaccggtgctcgatttagcgtcgatctcaggggtccgggagatcatgagggtgtccttgggttttgggggaagaggaagactgacggtcccccaggagttcaggtgctgggcacagcggccctgggctgcctggtcaaggactacttccacgtagcgtgctgagcgggctggcaaggcgcatagnnnnnnnnnnnnnnnnn

SEQ ID NO: 164436 - DNA, 203 bp, Homo sapiens; identical to SEQ ID NO: 164396
  misc_feature: GYAE6OF01DUYPH.30.10.A10.1.454.CMB.1.raw
  modified_base (202)..(203): a, c, t, g, unknown or other
  misc_feature (202)..(203): n is a, c, g, or t

SEQ ID NO: 164437 - DNA, 244 bp, Homo sapiens; identical to SEQ ID NO: 164371
  misc_feature: GYAE6OF01EVXHE.30.10.A10.1.454.CMB.1.raw
  modified_base (243)..(244): a, c, t, g, unknown or other
  misc_feature (243)..(244): n is a, c, g, or t

SEQ ID NO: 164438 - DNA, 204 bp, Homo sapiens; identical to SEQ ID NO: 164365
  misc_feature: GYAE6OF01D5QHV.30.10.A10.1.454.CMB.1.raw
  modified_base (201)..(204): a, c, t, g, unknown or other
  misc_feature (201)..(204): n is a, c, g, or t

SEQ ID NO: 164439 - DNA, 207 bp, Homo sapiens
  misc_feature: GYAE6OF01CXGX9.30.10.A10.1.454.CMB.1.raw
  modified_base (202)..(207): a, c, t, g, unknown or other
  misc_feature (202)..(207): n is a, c, g, or t
tcagcacgctacgtcacgaccggtgctcgatttagcgtcgatctcaggggtccgggagatcatgagggtgtccttgggttttgggggaagaggaagactgacggtcccccaggagttcaggtgctgggcacagcggccctgggctgcctggtcaaggactacttccacgtagcgtgctgagcgggctggcaaggcgcatagnnnnnn

SEQ ID NO: 164440 - DNA, 205 bp, Homo sapiens
  misc_feature: GYAE6OF01BWQOF.30.10.A10.1.454.CMB.1.raw
  modified_base (203)..(205): a, c, t, g, unknown or other
  misc_feature (203)..(205): n is a, c, g, or t
tcagcacgctacgtcacgaccggtgctcgatttagcgtcgatctcaggggtccgggagatcatgagggtgtccttgggttttgggggaagaggaagactgacggtccccccaggagttcaggtgctgggcacagcggccctgggctgcctggtcaaggactacttccacgtagcgtgctgagcgggctggcaaggcgcatagnnn

SEQ ID NO: 164441 - DNA, 204 bp, Homo sapiens; identical to SEQ ID NO: 164422
  misc_feature: GYAE6OF01CSQYX.30.10.A10.1.454.CMB.1.raw
  modified_base (201)..(204): a, c, t, g, unknown or other
  misc_feature (201)..(204): n is a, c, g, or t

SEQ ID NO: 164442 - DNA, 257 bp, Homo sapiens
  misc_feature: GYAE6OF01C5RMQ.30.10.A10.1.454.CMB.1.raw
  modified_base (218)..(257): a, c, t, g, unknown or other
  misc_feature (218)..(257): n is a, c, g, or t
tcagcacgctacgtcacgaccggtgctcgatttagcgtcgatctcaggggttccggggagatcactgagggtgtccgttgggttttggggggaagaggtaagacttggacggtccccccaggagttcaggtgactgggcacagcggccctgggctgtcctggtcaaggcgttacttccacgtagcgtagtctggaggcgggctggcaaggcgcatagnnnnnnnnnnnnnnnnnnnnnnnnnnnnnnnnnnnnnnnn

SEQ ID NO: 164443 - DNA, 203 bp, Homo sapiens; identical to SEQ ID NO: 164396
  misc_feature: GYAE6OF01ELKMB.30.10.A10.1.454.CMB.1.raw
  modified_base (202)..(203): a, c, t, g, unknown or other
  misc_feature (202)..(203): n is a, c, g, or t

SEQ ID NO: 164444 - DNA, 203 bp, Homo sapiens
  misc_feature: GYAE6OF01BOOSD.30.10.A10.1.454.CMB.1.raw
  modified_base (201)..(203): a, c, t, g, unknown or other
  misc_feature (201)..(203): n is a, c, g, or t
tcagcacgctacgtcacgaccggtgctcgatttagcgtcgatctcaggggtccgggagatcatgagggtgtccttgggtttgggggaagaggaagactgacggtcccccaggagttcaggtgctgggcacagcggccctgggctgcctggtcaaggactacttccacgtagcgtgctgagcgggctggcaaggcgcatagnnn

SEQ ID NO: 164445 - DNA, 204 bp, Homo sapiens; identical to SEQ ID NO: 164422
  misc_feature: GYAE6OF01DIZ4T.30.10.A10.1.454.CMB.1.raw
  modified_base (201)..(204): a, c, t, g, unknown or other
  misc_feature (201)..(204): n is a, c, g, or t

SEQ ID NO: 164446 - DNA, 258 bp, Homo sapiens
  misc_feature: GYAE6OF01CO179.30.10.A10.1.454.CMB.1.raw
  modified_base (239)..(239): a, c, t, g, unknown or other
  misc_feature (239)..(239): n is a, c, g, or t
  modified_base (244)..(258): a, c, t, g, unknown or other
  misc_feature (244)..(258): n is a, c, g, or t
tcagcacgctacgtcacgaccggtgctcgatttagcgtcgatctcgaggggtcttcgtggctcacgtccaccaccacgcatgtgacctcagggtccgggagatcatgacggtgtccttgggttttgggggaagaggaagactgacggtcccccaggagttcaggtgctgggcacagcggccctgggctgcctggtcaaggctactcgacgtagcgtgctgagcgggctgggcaaggcgnatagnnnnnnnnnnnnnnn

SEQ ID NO: 164447 - DNA, 245 bp, Homo sapiens
  misc_feature: GYAE6OF01CXEJL.30.10.A10.1.454.CMB.1.raw
  modified_base (243)..(245): a, c, t, g, unknown or other
  misc_feature (243)..(245): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttgggggaagaggaagactgacggtcccccaggagttcaggtgctgggcacagcggcctgggctgcctggtcaaggactacttccacgtagcgtgctgagcgggctggcaaggcgcatagnnn

SEQ ID NO: 164448 - DNA, 247 bp, Homo sapiens; identical to SEQ ID NO: 164369
  misc_feature: GYAE6OF01B9J2A.30.10.A10.1.454.CMB.1.raw
  modified_base (243)..(247): a, c, t, g, unknown or other
  misc_feature (243)..(247): n is a, c, g, or t

SEQ ID NO: 164449 - DNA, 210 bp, Homo sapiens
  misc_feature: GYAE6OF01AETUD.30.10.A10.1.454.CMB.1.raw
  modified_base (202)..(210): a, c, t, g, unknown or other
  misc_feature (202)..(210): n is a, c, g, or t
tcagcacgctacgtcacgaccggtgctcgatttagcgtcgatctcgaggggtccgggagatcatgagggtgtccttgggtttgggggaagaggaagactgacggtcccccaggagttcaggtgctgggcacagcggccctgggctgcctggtcaaggactacttccacgtagcgtgctgagcgggctggcaaggcgcatagnnnnnnnnn

SEQ ID NO: 164450 - DNA, 203 bp, Homo sapiens; identical to SEQ ID NO: 164378
  misc_feature: GYAE6OF01AO2U4.30.10.A10.1.454.CMB.1.raw
  modified_base (202)..(203): a, c, t, g, unknown or other
  misc_feature (202)..(203): n is a, c, g, or t

SEQ ID NO: 164451 - DNA, 224 bp, Homo sapiens
  misc_feature: GYAE6OF01ASYF6.30.10.A10.1.454.CMB.1.raw
  modified_base (203)..(224): a, c, t, g, unknown or other
  misc_feature (203)..(224): n is a, c, g, or t
tcagcacgctacgtcacgaccggtgctcgatttagcgtcgatctcagggtccggggagatcatgagggtgtccttgggttttgggggaagaggaagactgacggtccccccaggagttcaggtgctgggcacagcggccctgggctgcctggtcaaggactacttccacgtagcgtgctgagcgggctggcaaggcgcatagnnnnnnnnnnnnnnnnnnnnnn

SEQ ID NO: 164452 - DNA, 248 bp, Homo sapiens
  misc_feature: GYAE6OF01BKDHE.30.10.A10.1.454.CMB.1.raw
  modified_base (244)..(248): a, c, t, g, unknown or other
  misc_feature (244)..(248): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttgggggaagaggaagactgacggtcccccaggagttcaggtgctgggcacagcggccctgggctgcctggtcaaggactacttccacgtagcgtgctgagcgggctggcaaggcgcatagnnnnn

SEQ ID NO: 164453 - DNA, 201 bp, Homo sapiens; identical to SEQ ID NO: 164360
  misc_feature: GYAE6OF01CUW6X.30.10.A10.1.454.CMB.1.raw
  modified_base (200)..(201): a, c, t, g, unknown or other
  misc_feature (200)..(201): n is a, c, g, or t

SEQ ID NO: 164454 - DNA, 218 bp, Homo sapiens
  misc_feature: GYAE6OF01A24DD.30.10.A10.1.454.CMB.1.raw
  modified_base (199)..(218): a, c, t, g, unknown or other
  misc_feature (199)..(218): n is a, c, g, or t
tcagcacgctacgtcacgaccggtgctcgatttagcgtcgatctcagggtccgggagatcatgaggtgtccttgggtttgggggaagaggaagactgacggtcccccaggagttcaggtgctgggcacagcggccctgggctgcctggtcaaggactacttccacgtagcgtgctgagcgggctggcaaggcgcatagnnnnnnnnnnnnnnnnnnnn

SEQ ID NO: 164455 - DNA, 205 bp, Homo sapiens; identical to SEQ ID NO: 164395
  misc_feature: GYAE6OF01CBR6R.30.10.A10.1.454.CMB.1.raw
  modified_base (201)..(205): a, c, t, g, unknown or other
  misc_feature (201)..(205): n is a, c, g, or t

SEQ ID NO: 164456 - DNA, 247 bp, Homo sapiens; identical to SEQ ID NO: 164369
  misc_feature: GYAE6OF01CBVB6.30.10.A10.1.454.CMB.1.raw
  modified_base (243)..(247): a, c, t, g, unknown or other
  misc_feature (243)..(247): n is a, c, g, or t

SEQ ID NO: 164457 - DNA, 247 bp, Homo sapiens
  misc_feature: GYAE6OF01CBY6D.30.10.A10.1.454.CMB.1.raw
  modified_base (244)..(247): a, c, t, g, unknown or other
  misc_feature (244)..(247): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttgggggaagaggaagactgacggtcccccaggagttcaggtgctgggcacagcggccctgggctgcctggtcaaggactacttccacgtagcgtgctgagcgggctggcaaggcgcatagnnnn

SEQ ID NO: 164458 - DNA, 201 bp, Homo sapiens
  misc_feature: GYAE6OF01BU2TK.30.10.A10.1.454.CMB.1.raw
  modified_base (200)..(201): a, c, t, g, unknown or other
  misc_feature (200)..(201): n is a, c, g, or t
tcagcacgctacgtcacgaccggtgctcgatttagcgtcgatctcagggtccgggagatcatgagggtgtccttgggttttgggggaagaggaagactgacggtcccccaggagttcaggtgctgggcacagcggccctgggctgcctggtcaaggactacttccacgtgcgtgctgagcgggctggcaaggcgcatagnn

SEQ ID NO: 164459 - DNA, 250 bp, Homo sapiens
  misc_feature: GYAE6OF01C65GS.30.10.A10.1.454.CMB.1.raw
  modified_base (246)..(250): a, c, t, g, unknown or other
  misc_feature (246)..(250): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttggggggaagaggaagactgacggtccccccaggagttcaggtgctgggcacagcggccctgggctgcctggtcaaggactacttccacgtagcgtgctgagcgggctggcaaggcgcatagnnnnn

SEQ ID NO: 164460 - DNA, 246 bp, Homo sapiens; identical to SEQ ID NO: 164347
  misc_feature: GYAE6OF01AO5WH.30.10.A10.1.454.CMB.1.raw
  modified_base (243)..(246): a, c, t, g, unknown or other
  misc_feature (243)..(246): n is a, c, g, or t

SEQ ID NO: 164461 - DNA, 206 bp, Homo sapiens
  misc_feature: GYAE6OF01D3ZK5.30.10.A10.1.454.CMB.1.raw
  modified_base (203)..(206): a, c, t, g, unknown or other
  misc_feature (203)..(206): n is a, c, g, or t
tcagcacgctacgtcacgaccggtgctcgatttagcgtcgatctcaggggtccgggagatcatgagggtgtccttgggttttgggggaagaggaagactgacggtccccccaggagttcaggtgctgggcacagcggccctgggctgcctggtcaaggactacttccacgtagcgtgctgagcgggctggcaaggcgcatagnnnn

SEQ ID NO: 164462 - DNA, 206 bp, Homo sapiens
  misc_feature: GYAE6OF01BIJZ0.30.10.A10.1.454.CMB.1.raw
  modified_base (200)..(206): a, c, t, g, unknown or other
  misc_feature (200)..(206): n is a, c, g, or t
tcagcacgctacgtcacgaccggtgctcgatttagcgtcgatctcaggggtccgggagatcatgagggtgtccttgggtttgggggaagaggaagactgacggtcccccaggagttcaggtgctgggcacagcggccctgggctgcctggtcaaggctacttccacgtagcgtgctgagcgggctggcaaggcgcatagnnnnnnn

SEQ ID NO: 164463 - DNA, 245 bp, Homo sapiens
  misc_feature: GYAE6OF01B99PT.30.10.A10.1.454.CMB.1.raw
  modified_base (243)..(245): a, c, t, g, unknown or other
  misc_feature (243)..(245): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggtttgggggaagaggaagactgacggtcccccaggagttcaggtgctgggcacagcggccctgggctgcctggtcaaggactacttccacgtagcgtgctgagcgggctggcaaggcgcatagnnn

SEQ ID NO: 164464 - DNA, 249 bp, Homo sapiens
  misc_feature: GYAE6OF01AHPR0.30.10.A10.1.454.CMB.1.raw
  modified_base (243)..(249): a, c, t, g, unknown or other
  misc_feature (243)..(249): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggtttgggggaagaggaagactgacggtcccccaggagttcaggtgctgggcacagcggccctgggctgcctggtcaaggactacttccacgtagcgtgctgagcgggctggcaaggcgcatagnnnnnnn

SEQ ID NO: 164465 - DNA, 202 bp, Homo sapiens; identical to SEQ ID NO: 164363
  misc_feature: GYAE6OF01EJT43.30.10.A10.1.454.CMB.1.raw
  modified_base (201)..(202): a, c, t, g, unknown or other
  misc_feature (201)..(202): n is a, c, g, or t

SEQ ID NO: 164466 - DNA, 221 bp, Homo sapiens
  misc_feature: GYAE6OF01CQORS.30.10.A10.1.454.CMB.1.raw
  modified_base (212)..(221): a, c, t, g, unknown or other
  misc_feature (212)..(221): n is a, c, g, or t
tcagcacgctacgtcacgaccggtgctcgatttagcgtcgatctcaggggtccgggaggatcatgagggtgtccttgggttttggggggaagaggaagactgagggtccccccaggaggttcaggtggctcgggcgaccagcggccctgggcgtgcctcggtcaaggactacttccacgtagcgtgctgagcgggctggcaaggcgcatagnnnnnnnnnn

SEQ ID NO: 164467 - DNA, 208 bp, Homo sapiens
  misc_feature: GYAE6OF01CZJIY.30.10.A10.1.454.CMB.1.raw
  modified_base (203)..(208): a, c, t, g, unknown or other
  misc_feature (203)..(208): n is a, c, g, or t
tcagcacgctacgtcacgaccggtgctcgatttagcgtcgatctcaggggtccgggagatcatgagggtgtccttgggttttgggggaagaggaagactgacggtccccccaggagttcaggtgctgggcacagcggccctgggctgcctggtcaaggactacttccacgtagcgtgctgagcgggctggcaaggcgcatagnnnnnn

SEQ ID NO: 164468 - DNA, 203 bp, Homo sapiens; identical to SEQ ID NO: 164378
  misc_feature: GYAE6OF01CG249.30.10.A10.1.454.CMB.1.raw
  modified_base (202)..(203): a, c, t, g, unknown or other
  misc_feature (202)..(203): n is a, c, g, or t

SEQ ID NO: 164469 - DNA, 205 bp, Homo sapiens; identical to SEQ ID NO: 164440
  misc_feature: GYAE6OF01D4VM4.30.10.A10.1.454.CMB.1.raw
  modified_base (203)..(205): a, c, t, g, unknown or other
  misc_feature (203)..(205): n is a, c, g, or t

SEQ ID NO: 164470 - DNA, 204 bp, Homo sapiens
  misc_feature: GYAE6OF01DYDTV.30.10.A10.1.454.CMB.1.raw
  modified_base (203)..(204): a, c, t, g, unknown or other
  misc_feature (203)..(204): n is a, c, g, or t
tcagcacgctacgtcacgaccggtgctcgatttagcgtcgatctcaggggtccgggagatcatgagggtgtccttgggttttgggggaagaggaagactgacggtccccccaggagttcaggtgctgggcacagcggccctgggctgcctggtcaaggactacttccacgtagcgtgctgagcgggctggcaaggcgcatagnn

SEQ ID NO: 164471 - DNA, 215 bp, Homo sapiens
  misc_feature: GYAE6OF01D5UB0.30.10.A10.1.454.CMB.1.raw
  modified_base (213)..(215): a, c, t, g, unknown or other
  misc_feature (213)..(215): n is a, c, g, or t
tcagcacgctacgtcacgaccggtgctcgatttagcgtcgatctcaggggtccgggagatcatggagggtgtccgtttggggttttgggggaagaggaagactggaccggtcccccaggagttcaggtgcgtgggcacaggccggcccgtgggctgcctggtcaaggacttacttccacgtagcgtgctgagcgggctggcaaggcgcatagnnn

SEQ ID NO: 164472 - DNA, 204 bp, Homo sapiens; identical to SEQ ID NO: 164470
  misc_feature: GYAE6OF01DZFF7.30.10.A10.1.454.CMB.1.raw
  modified_base (203)..(204): a, c, t, g, unknown or other
  misc_feature (203)..(204): n is a, c, g, or t

SEQ ID NO: 164473 - DNA, 248 bp, Homo sapiens; identical to SEQ ID NO: 164414
  misc_feature: GYAE6OF01BOMO2.30.10.A10.1.454.CMB.1.raw
  modified_base (243)..(248): a, c, t, g, unknown or other
  misc_feature (243)..(248): n is a, c, g, or t

SEQ ID NO: 164474 - DNA, 205 bp, Homo sapiens; identical to SEQ ID NO: 164440
  misc_feature: GYAE6OF01DRZJY.30.10.A10.1.454.CMB.1.raw
  modified_base (203)..(205): a, c, t, g, unknown or other
  misc_feature (203)..(205): n is a, c, g, or t

SEQ ID NO: 164475 - DNA, 311 bp, Homo sapiens
  misc_feature: GYAE6OF01BS183.30.10.A10.1.454.CMB.1.raw
  modified_base (239)..(239): a, c, t, g, unknown or other
  misc_feature (239)..(239): n is a, c, g, or t
  modified_base (245)..(247): a, c, t, g, unknown or other
  misc_feature (245)..(247): n is a, c, g, or t
  modified_base (249)..(250): a, c, t, g, unknown or other
  misc_feature (249)..(250): n is a, c, g, or t
  modified_base (252)..(252): a, c, t, g, unknown or other
  misc_feature (252)..(252): n is a, c, g, or t
  modified_base (256)..(256): a, c, t, g, unknown or other
  misc_feature (256)..(256): n is a, c, g, or t
  modified_base (262)..(263): a, c, t, g, unknown or other
  misc_feature (262)..(263): n is a, c, g, or t
  modified_base (265)..(265): a, c, t, g, unknown or other
  misc_feature (265)..(265): n is a, c, g, or t
  modified_base (278)..(311): a, c, t, g, unknown or other
  misc_feature (278)..(311): n is a, c, g, or t
tcagcacgctacgtcacgaccggtgctcgatttagcgtcgatctcgagggtcttcgtggctcacgtccaccaccacgcatgtgacctcaggggtccgggagatcatgagggtgtccttgggttttgggggaagaggaagactgacggtccccccaggagttcaggtgctgggcacagcggccctgggctgcctggtcaaggctacttccacgtagcgtgctgagcggctggcaagggcncatagnnngnncnagantgcatnngnagcagcagcttgnnnnnnnnnnnnnnnnnnnnnnnnnnnnnnnnnn

SEQ ID NO: 164476 - DNA, 201 bp, Homo sapiens; identical to SEQ ID NO: 164360
  misc_feature: GYAE6OF01ESG7U.30.10.A10.1.454.CMB.1.raw
  modified_base (200)..(201): a, c, t, g, unknown or other
  misc_feature (200)..(201): n is a, c, g, or t

SEQ ID NO: 164477 - DNA, 204 bp, Homo sapiens; identical to SEQ ID NO: 164408
  misc_feature: GYAE6OF01B1ZEJ.30.10.A10.1.454.CMB.1.raw
  modified_base (202)..(204): a, c, t, g, unknown or other
  misc_feature (202)..(204): n is a, c, g, or t

SEQ ID NO: 164478 - DNA, 218 bp, Homo sapiens
  misc_feature: GYAE6OF01CN606.30.10.A10.1.454.CMB.1.raw
  modified_base (201)..(218): a, c, t, g, unknown or other
  misc_feature (201)..(218): n is a, c, g, or t
tcagcacgctacgtcacgaccggtgctcgatttagcgtcgatctcaggggtccgggagatcatgagggtgtccttgggtttgggggaagaggaagactgacggtcccccaggagttcaggtgctgggcacagcggccctgggctgcctggtcaaggactacttccacgtagcgtgctgagcgggctggcaaggcgcatagnnnnnnnnnnnnnnnnnn

SEQ ID NO: 164479 - DNA, 205 bp, Homo sapiens; identical to SEQ ID NO: 164440
  misc_feature: GYAE6OF01D27PH.30.10.A10.1.454.CMB.1.raw
  modified_base (203)..(205): a, c, t, g, unknown or other
  misc_feature (203)..(205): n is a, c, g, or t

SEQ ID NO: 164480 - DNA, 212 bp, Homo sapiens
  misc_feature: GYAE6OF01BN3WM.30.10.A10.1.454.CMB.1.raw
  modified_base (202)..(212): a, c, t, g, unknown or other
  misc_feature (202)..(212): n is a, c, g, or t
tcagcacgctacgtcacgaccggtgctcgatttagcgtcgatctcaggggtccgggagatcatgagggtgtccttgggttttgggggaagaggaagactgacggtcccccaggagttcaggtgctgggcacagcggccctgggctgcctggtcaaggactacttccacgtagcgtgctgagcgggctggcaaggcgcatagnnnnnnnnnnn

SEQ ID NO: 164481 - DNA, 282 bp, Homo sapiens
  misc_feature: GYAE6OF01DAOFN.30.10.A10.1.454.CMB.1.raw
  modified_base (251)..(251): a, c, t, g, unknown or other
  misc_feature (251)..(251): n is a, c, g, or t
  modified_base (253)..(282): a, c, t, g, unknown or other
  misc_feature (253)..(282): n is a, c, g, or t
tcagcacgctacgtcacgaccggtgctcgatttagcgtcgatctcgagggtcttcgtggctcacggtcccaccaccacgcatgtcgacctcaggggtccgggagatcatgagggtgtccttgggttttggggggaagaggaagactgacggtcccccaggagttcaggtgctgggcacagcggccctgggctgcctgggtcaaggacgtacttccacgtagcgtgctgagcgggctggcaaggcgcatagnannnnnnnnnnnnnnnnnnnnnnnnnnnnnn

SEQ ID NO: 164482 - DNA, 246 bp, Homo sapiens
  misc_feature: GYAE6OF01ENWI8.30.10.A10.1.454.CMB.1.raw
  modified_base (242)..(246): a, c, t, g, unknown or other
  misc_feature (242)..(246): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggtttgggggaagaggaagactgacggtcccccaggagttcaggtgctgggcacagcggcctgggctgcctggtcaaggactacttccacgtagcgtgctgagcgggctggcaaggcgcatagnnnnn

SEQ ID NO: 164483 - DNA, 257 bp, Homo sapiens
  misc_feature: GYAE6OF01ARJND.30.10.A10.1.454.CMB.1.raw
  modified_base (248)..(257): a, c, t, g, unknown or other
  misc_feature (248)..(257): n is a, c, g, or t
tcagcacgctacgtcacgaccggtgctcgatttagcgtcgatctcgtaggggtacttcgtggctcacggtcccaccaccacgcatgtgacctcagggtccgggagagtcatgagggtgtccttgggtttgggggaagaggaagactgacggtcccccaggagttcaggtgctgggcacagcgccctgggctgcctggtcaaggactacttccacgtagcgtgctgagcgggctggcaaggcgcatagnnnnnnnnnn

SEQ ID NO: 164484 - DNA, 203 bp, Homo sapiens; identical to SEQ ID NO: 164378
  misc_feature: GYAE6OF01C3CYU.30.10.A10.1.454.CMB.1.raw
  modified_base (202)..(203): a, c, t, g, unknown or other
  misc_feature (202)..(203): n is a, c, g, or t

SEQ ID NO: 164485 - DNA, 202 bp, Homo sapiens
  misc_feature: GYAE6OF01CK52K.30.10.A10.1.454.CMB.1.raw
  modified_base (198)..(202): a, c, t, g, unknown or other
  misc_feature (198)..(202): n is a, c, g, or t
tcagcacgctacgtcacgaccggtgctcgatttagcgtcgatctcagggtccgggagatcatgaggtgtccttgggtttggggaagaggaagactgacggtcccccaggagttcaggtgctgggcacagcggccctgggctgcctggtcaaggactacttccacgtagcgtgctgagcgggctggcaaggcgcatagnnnnn

SEQ ID NO: 164486 - DNA, 246 bp, Homo sapiens
  misc_feature: GYAE6OF01BX3XA.30.10.A10.1.454.CMB.1.raw
  modified_base (243)..(246): a, c, t, g, unknown or other
  misc_feature (243)..(246): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggtttgggggaagaggaagactgacggtcccccaggagttcaggtgctgggcacagcggccctgggctgactggtcaaggactacttccacgtagcgtgctgagcgggctggcaaggcgcatagnnnn

SEQ ID NO: 164487 - DNA, 214 bp, Homo sapiens
  misc_feature: GYAE6OF01D67G7.30.10.A10.1.454.CMB.1.raw
  modified_base (203)..(214): a, c, t, g, unknown or other
  misc_feature (203)..(214): n is a, c, g, or t
tcagcacgctacgtcacgaccggtgctcgatttagcgtcgatctcaggggtccgggagatcatgagggtgtccttgggttttgggggaagaggaagactgaccggtcccccaggagttcaggtgctgggcacagcggccctgggctgcctggtcaaggactacttccacgtagcgtgctgagcgggctggcaaggcgcatagnnnnnnnnnnnn

SEQ ID NO: 164488 - DNA, 246 bp, Homo sapiens
  misc_feature: GYAE6OF01D893W.30.10.A10.1.454.CMB.1.raw
  modified_base (242)..(246): a, c, t, g, unknown or other
  misc_feature (242)..(246): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggtttgggggaagaggaagactgacggtcccccaggagttcaggtgctgggcacagcggccctgggctgcctggtcaaggctacttccacgtagcgtgctgagcgggctggcaaggcgcatagnnnnn

SEQ ID NO: 164489 - DNA, 244 bp, Homo sapiens
  misc_feature: GYAE6OF01A8UJZ.30.10.A10.1.454.CMB.1.raw
  modified_base (242)..(244): a, c, t, g, unknown or other
  misc_feature (242)..(244): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggtttgggggaagaggaagactgacggtcccccaggagttcaggtgctgggcacagcggccctgggctgcctggtcaaggactacttccacgtagcgtgctgagcggctggcaaggcgcatagnnn

SEQ ID NO: 164490 - DNA, 206 bp, Homo sapiens; identical to SEQ ID NO: 164461
  misc_feature: GYAE6OF01CMDRE.30.10.A10.1.454.CMB.1.raw
  modified_base (203)..(206): a, c, t, g, unknown or other
  misc_feature (203)..(206): n is a, c, g, or t

SEQ ID NO: 164491 - DNA, 202 bp, Homo sapiens
  misc_feature: GYAE6OF01BSZ09.30.10.A10.1.454.CMB.1.raw
  modified_base (199)..(202): a, c, t, g, unknown or other
  misc_feature (199)..(202): n is a, c, g, or t
tcagcacgctacgtcacgaccggtgctcgatttagcgtcgatctcagggtccgggagatcatgaggtgtccttgggtttgggggaagaggaagactgacggtcccccaggagttcaggtgctgggcacagcggccctgggctgcctggtcaaggactacttccacgtagcgtgctgagcgggctggcaaggcgcatagnnnn

SEQ ID NO: 164492 - DNA, 249 bp, Homo sapiens
  misc_feature: GYAE6OF01DGIFY.30.10.A10.1.454.CMB.1.raw
  modified_base (243)..(249): a, c, t, g, unknown or other
  misc_feature (243)..(249): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttgggggaagaggaagactgacggtcccccaggagttcaggtgctgggcacagcggccctgggctgcctggtcaaggactacttccacgtagcgtgctgagcggctggcaaggcgcatagnnnnnnn

SEQ ID NO: 164493 - DNA, 205 bp, Homo sapiens; identical to SEQ ID NO: 164374
  misc_feature: GYAE6OF01B0FVK.30.10.A10.1.454.CMB.1.raw
  modified_base (202)..(205): a, c, t, g, unknown or other
  misc_feature (202)..(205): n is a, c, g, or t

SEQ ID NO: 164494 - DNA, 204 bp, Homo sapiens; identical to SEQ ID NO: 164422
  misc_feature: GYAE6OF01CLTDU.30.10.A10.1.454.CMB.1.raw
  modified_base (201)..(204): a, c, t, g, unknown or other
  misc_feature (201)..(204): n is a, c, g, or t

SEQ ID NO: 164495 - DNA, 246 bp, Homo sapiens
  misc_feature: GYAE6OF01BTMXB.30.10.A10.1.454.CMB.1.raw
  modified_base (244)..(246): a, c, t, g, unknown or other
  misc_feature (244)..(246): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttgggggaagaggaagactgacggtcccccaggagttcaggtgctgggcacagcggccctgggctgcctggtcaaggactacttccacgtagcgtgctgagcgggctggcaaggcgcatagnnn

SEQ ID NO: 164496 - DNA, 203 bp, Homo sapiens; identical to SEQ ID NO: 164378
  misc_feature: GYAE6OF01EMC90.30.10.A10.1.454.CMB.1.raw
  modified_base (202)..(203): a, c, t, g, unknown or other
  misc_feature (202)..(203): n is a, c, g, or t

SEQ ID NO: 164497 - DNA, 245 bp, Homo sapiens; identical to SEQ ID NO: 164337
  misc_feature: GYAE6OF01BSL78.30.10.A10.1.454.CMB.1.raw
  modified_base (242)..(245): a, c, t, g, unknown or other
  misc_feature (242)..(245): n is a, c, g, or t

SEQ ID NO: 164498 - DNA, 244 bp, Homo sapiens
  misc_feature: GYAE6OF01A015R.30.10.A10.1.454.CMB.1.raw
  modified_base (244)..(244): a, c, t, g, unknown or other
  misc_feature (244)..(244): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttgggggaagaggaagactgacggtcccccaggagttcaggtgctgggcacagcggccctgggctgcctggtcaaggactacttccacgtagcgtgctgagcgggctggcaaggcgcatagn

SEQ ID NO: 164499 - DNA, 203 bp, Homo sapiens
  misc_feature: GYAE6OF01EE3LT.30.10.A10.1.454.CMB.1.raw
  modified_base (201)..(203): a, c, t, g, unknown or other
  misc_feature (201)..(203): n is a, c, g, or t
tcagcacgctacgtcacgaccggtgctcgatttagcgtcgatctcaggggtccgggagatcatgagggtgtccttgggttttgggggaagaggaagactgacggtcccccaggagttcaggtgctgggcacagcggccctgggctgcctggtcaaggactacttcacgtagcgtgctgagcgggctggcaaggcgcatagnnn

SEQ ID NO: 164500 - DNA, 245 bp, Homo sapiens; identical to SEQ ID NO: 164463
  misc_feature: GYAE6OF01EUE40.30.10.A10.1.454.CMB.1.raw
  modified_base (243)..(245): a, c, t, g, unknown or other
  misc_feature (243)..(245): n is a, c, g, or t

SEQ ID NO: 164501 - DNA, 207 bp, Homo sapiens
  misc_feature: GYAE6OF01D8GSM.30.10.A10.1.454.CMB.1.raw
  modified_base (203)..(207): a, c, t, g, unknown or other
  misc_feature (203)..(207): n is a, c, g, or t
tcagcacgctacgtcacgaccggtgctcgatttagcgtcgatctcaggggtccgggagatcatgagggtgtccttgggttttgggggaagaggaagactgacggtccccccaggagttcaggtgctgggcacagcggccctgggctgcctggtcaaggactacttccacgtagcgtgctgagcgggctggcaaggcgcatagnnnnn

SEQ ID NO: 164502 - DNA, 209 bp, Homo sapiens
  misc_feature: GYAE6OF01ACRWY.30.10.A10.1.454.CMB.1.raw
  modified_base (203)..(209): a, c, t, g, unknown or other
  misc_feature (203)..(209): n is a, c, g, or t
tcagcacgctacgtcacgaccggtgctcgatttagcgtcgatctcaggggtccgggagatcatgagggtgtccttgggttttgggggaagaggaagactgacggtccccccaggagttcaggtgctgggcacagcggccctgggctgcctggtcaaggactacttccacgtagcgtgctgagcgggctggcaaggcgcatagnnnnnnn

SEQ ID NO: 164503 - DNA, 240 bp, Homo sapiens
  misc_feature: GYAE6OF01BQ26W.30.10.A10.1.454.CMB.1.raw
  modified_base (208)..(240): a, c, t, g, unknown or other
  misc_feature (208)..(240): n is a, c, g, or t
tcagcacgctacgtcacgaccggtgctcgatttagcgtcgatctcgaggggtccgggagatcagttgagggtgtccttgggttttggggggaagaggaagactgacggtccccccaggagttcaggtgctgggcacgagcggccctgggctgccgtggtcaaggactacttccacgtagcgtgctgagcggctggcaaggcgcatagnnnnnnnnnnnnnnnnnnnnnnnnnnnnnnnnn

SEQ ID NO: 164504 - DNA, 210 bp, Homo sapiens
  misc_feature: GYAE6OF01EW7VM.30.10.A10.1.454.CMB.1.raw
  modified_base (203)..(210): a, c, t, g, unknown or other
  misc_feature (203)..(210): n is a, c, g, or t
tcagcacgctacgtcacgaccggtgctcgatttagcgtcgatctcaggggtccgggagatcatgagggtgtccttgggttttgggggaagaggaagactgacggtccccccaggagttcaggtgctgggcacagcggccctgggctgcctggtcaaggactacttccacgtagcgtgctgagcgggctggcaaggcgcatagnnnnnnnn

SEQ ID NO: 164505 - DNA, 245 bp, Homo sapiens; identical to SEQ ID NO: 164463
  misc_feature: GYAE6OF01E250E.30.10.A10.1.454.CMB.1.raw
  modified_base (243)..(245): a, c, t, g, unknown or other
  misc_feature (243)..(245): n is a, c, g, or t

SEQ ID NO: 164506 - DNA, 207 bp, Homo sapiens
  misc_feature: GYAE6OF01BJRAU.30.10.A10.1.454.CMB.1.raw
  modified_base (202)..(207): a, c, t, g, unknown or other
  misc_feature (202)..(207): n is a, c, g, or t
tcagcacgctacgtcacgaccggtgctcgatttagcgtcgatctcagggttccgggagatcatgagggtgtccttgggttttgggggaagaggaagactgacggtcccccaggagttcaggttctgggcacagcggccctgggctgcctggtcaaggactacttccacgtagcgtgctgagcgggctggcaaggcgcatagnnnnnn

SEQ ID NO: 164507 - DNA, 246 bp, Homo sapiens; identical to SEQ ID NO: 164347
  misc_feature: GYAE6OF01BBSNS.30.10.A10.1.454.CMB.1.raw
  modified_base (243)..(246): a, c, t, g, unknown or other
  misc_feature (243)..(246): n is a, c, g, or t

SEQ ID NO: 164508 - DNA, 203 bp, Homo sapiens
  misc_feature: GYAE6OF01B7SNZ.30.10.A10.1.454.CMB.1.raw
  modified_base (202)..(203): a, c, t, g, unknown or other
  misc_feature (202)..(203): n is a, c, g, or t
tcagcacgctacgtcacgaccggtgctcgatttagcgtcgatctcaggggtccgggagatcatgagggtgtccttgggttttgggggaagaggaagactgacggccccccaggagttcaggtgctgggcacagcggccctgggctgcctggtcaaggactacttccacgtagcgtgctgagcgggctggcaaggcgcatagnn

SEQ ID NO: 164509 - DNA, 250 bp, Homo sapiens; identical to SEQ ID NO: 164459
  misc_feature: GYAE6OF01DJJLM.30.10.A10.1.454.CMB.1.raw
  modified_base (246)..(250): a, c, t, g, unknown or other
  misc_feature (246)..(250): n is a, c, g, or t

SEQ ID NO: 164510 - DNA, 246 bp, Homo sapiens; identical to SEQ ID NO: 164347
  misc_feature: GYAE6OF01EGQI7.30.10.A10.1.454.CMB.1.raw
  modified_base (243)..(246): a, c, t, g, unknown or other
  misc_feature (243)..(246): n is a, c, g, or t

SEQ ID NO: 164511 - DNA, 291 bp, Homo sapiens
  misc_feature: GYAE6OF01EEUSF.30.10.A10.1.454.CMB.1.raw
  modified_base (257)..(291): a, c, t, g, unknown or other
  misc_feature (257)..(291): n is a, c, g, or t
tcagcacgctacgtcacgaccggtgctcgatttagcgtcgatctcagggtcttcggtggctcacgtccaccaccacgcatgtgtaccctcaggggtccgggagtatcatgagggtgtccttggggtttggggggaagaggaagactggacgggtccccccaggagttcaggtgcgtgggcacagcggccctgggctgcctggtcaaggactacttccacgtagcgtgctggagcgggcgtggcaaggcgcagtaggnnnnnnnnnnnnnnnnnnnnnnnnnnnnnnnnnnn

SEQ ID NO: 164512 - DNA, 252 bp, Homo sapiens
  misc_feature: GYAE6OF01DP4X9.30.10.A10.1.454.CMB.1.raw
  modified_base (244)..(252): a, c, t, g, unknown or other
  misc_feature (244)..(252): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttgggggaagaggaagactgacggtcccccaggagttcaggtgctgggcacagcggccctgggctgcctggtcaaggactacttccacgtagcgtgctgagcgggctggcaaggcgcatagnnnnnnnnn

SEQ ID NO: 164513 - DNA, 246 bp, Homo sapiens; identical to SEQ ID NO: 164347
  misc_feature: GYAE6OF01AP5OM.30.10.A10.1.454.CMB.1.raw
  modified_base (243)..(246): a, c, t, g, unknown or other
  misc_feature (243)..(246): n is a, c, g, or t

SEQ ID NO: 164514 - DNA, 206 bp, Homo sapiens; identical to SEQ ID NO: 164461
  misc_feature: GYAE6OF01BEPQ9.30.10.A10.1.454.CMB.1.raw
  modified_base (203)..(206): a, c, t, g, unknown or other
  misc_feature (203)..(206): n is a, c, g, or t

SEQ ID NO: 164515 - DNA, 212 bp, Homo sapiens
  misc_feature: GYAE6OF01EDJLF.30.10.A10.1.454.CMB.1.raw
  modified_base (204)..(212): a, c, t, g, unknown or other
  misc_feature (204)..(212): n is a, c, g, or t
tcagcacgctacgtcacgaccggtgctcgatttagcgtcgatctcaggggtccgggagatcgatgagggtgtccttgggttttgggggaagaggaagactgacggtccccccaggagttcaggtgctgggcacagcggccctgggctgcctggtcaaggactacttccacgtagcgtgctgagcgggctggcaaggcgcatagnnnnnnnnn

SEQ ID NO: 164516 - DNA, 209 bp, Homo sapiens; identical to SEQ ID NO: 164502
  misc_feature: GYAE6OF01ET41Y.30.10.A10.1.454.CMB.1.raw
  modified_base (203)..(209): a, c, t, g, unknown or other
  misc_feature (203)..(209): n is a, c, g, or t

SEQ ID NO: 164517 - DNA, 246 bp, Homo sapiens; identical to SEQ ID NO: 164347
  misc_feature: GYAE6OF01CCDIF.30.10.A10.1.454.CMB.1.raw
  modified_base (243)..(246): a, c, t, g, unknown or other
  misc_feature (243)..(246): n is a, c, g, or t

SEQ ID NO: 164518 - DNA, 203 bp, Homo sapiens; identical to SEQ ID NO: 164444
  misc_feature: GYAE6OF01C6FBK.30.10.A10.1.454.CMB.1.raw
  modified_base (201)..(203): a, c, t, g, unknown or other
  misc_feature (201)..(203): n is a, c, g, or t

SEQ ID NO: 164519 - DNA, 207 bp, Homo sapiens; identical to SEQ ID NO: 164501
  misc_feature: GYAE6OF01BJTOY.30.10.A10.1.454.CMB.1.raw
  modified_base (203)..(207): a, c, t, g, unknown or other
  misc_feature (203)..(207): n is a, c, g, or t

SEQ ID NO: 164520 - DNA, 205 bp, Homo sapiens; identical to SEQ ID NO: 164395
  misc_feature: GYAE6OF01BCQSA.30.10.A10.1.454.CMB.1.raw
  modified_base (201)..(205): a, c, t, g, unknown or other
  misc_feature (201)..(205): n is a, c, g, or t

SEQ ID NO: 164521 - DNA, 208 bp, Homo sapiens; identical to SEQ ID NO: 164467
  misc_feature: GYAE6OF01BDMS5.30.10.A10.1.454.CMB.1.raw
  modified_base (203)..(208): a, c, t, g, unknown or other
  misc_feature (203)..(208): n is a, c, g, or t

SEQ ID NO: 164522 - DNA, 214 bp, Homo sapiens
  misc_feature: GYAE6OF01EMPPB.30.10.A10.1.454.CMB.1.raw
  modified_base (204)..(214): a, c, t, g, unknown or other
  misc_feature (204)..(214): n is a, c, g, or t
tcagcacgctacgtcacgaccggtgctcgatttagcgtcgatctcaggggtccgggagatcatgagggtgtccttgggttttgggggaagaggaagactgacggtccccccaggagttcaggtgctgggcacagcggccctgggctgcctggtcaaggactacttccacgtaagcgtgctgagcgggctggcaaggcgcatagnnnnnnnnnnn

SEQ ID NO: 164523 - DNA, 204 bp, Homo sapiens; identical to SEQ ID NO: 164470
  misc_feature: GYAE6OF01CRSLO.30.10.A10.1.454.CMB.1.raw
  modified_base (203)..(204): a, c, t, g, unknown or other
  misc_feature (203)..(204): n is a, c, g, or t

SEQ ID NO: 164524 - DNA, 205 bp, Homo sapiens; identical to SEQ ID NO: 164374
  misc_feature: GYAE6OF01CDV1J.30.10.A10.1.454.CMB.1.raw
  modified_base (202)..(205): a, c, t, g, unknown or other
  misc_feature (202)..(205): n is a, c, g, or t

SEQ ID NO: 164525 - DNA, 247 bp, Homo sapiens
  misc_feature: GYAE6OF01CL87P.30.10.A10.1.454.CMB.1.raw
  modified_base (245)..(247): a, c, t, g, unknown or other
  misc_feature (245)..(247): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttgggggaagaggaagactgacggtccccccaggagttcaggtgctgggcacagcggccctgggctgcctggtcaaggactacttccacgtagcgtgctgagcgggctggcaaggcgcatagnnn

SEQ ID NO: 164526 - DNA, 234 bp, Homo sapiens
  misc_feature: GYAE6OF01B5N9J.30.10.A10.1.454.CMB.1.raw
  modified_base (203)..(234): a, c, t, g, unknown or other
  misc_feature (203)..(234): n is a, c, g, or t
tcagcacgctacgtcacgaccggtgctcgatttagcgtcgatctcaggggtccgggagatcatgagggtgtccttgggttttgggggaagaggaagactgacggtccccccaggagttcaggtgctggcacagcggccctgggctgcctggtcaaggactacgttccacgtagcgtgctgagcgggctggcaaggcgcatagnnnnnnnnnnnnnnnnnnnnnnnnnnnnnnnn

SEQ ID NO: 164527 - DNA, 261 bp, Homo sapiens
  misc_feature: GYAE6OF01CM7GZ.30.10.A10.1.454.CMB.1.raw
  modified_base (245)..(261): a, c, t, g, unknown or other
  misc_feature (245)..(261): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttggggttttgggggagaggaagactgacggtccccccaggagttcaggtgctgggcacagcggccctgggctgcctggtcaaggactacttccacgtagcgtgctgagcgggctggcaaggcgcatagnnnnnnnnnnnnnnnnn

SEQ ID NO: 164528 - DNA, 245 bp, Homo sapiens; identical to SEQ ID NO: 164463
  misc_feature: GYAE6OF01D7KLF.30.10.A10.1.454.CMB.1.raw
  modified_base (243)..(245): a, c, t, g, unknown or other
  misc_feature (243)..(245): n is a, c, g, or t

SEQ ID NO: 164529 - DNA, 246 bp, Homo sapiens; identical to SEQ ID NO: 164347
  misc_feature: GYAE6OF01CW0DC.30.10.A10.1.454.CMB.1.raw
  modified_base (243)..(246): a, c, t, g, unknown or other
  misc_feature (243)..(246): n is a, c, g, or t

SEQ ID NO: 164530 - DNA, 207 bp, Homo sapiens
  misc_feature: GYAE6OF01BW7BF.30.10.A10.1.454.CMB.1.raw
  modified_base (201)..(207): a, c, t, g, unknown or other
  misc_feature (201)..(207): n is a, c, g, or t
tcagcacgctacgtcacgaccggtgctcgatttagcgtcgatctcagggtccgggagatcatgagggtgtccttgggtttgggggaagaggaagactgacggtccccacgagttcaggtgctggcgacagcggccctcgggcgtgcctggtcaaggactacttccacgtagcgtgctgagcgggctggcaaggcgcatagnnnnnnn

SEQ ID NO: 164531 - DNA, 205 bp, Homo sapiens
  misc_feature: GYAE6OF01DAG8S.30.10.A10.1.454.CMB.1.raw
  modified_base (202)..(205): a, c, t, g, unknown or other
  misc_feature (202)..(205): n is a, c, g, or t
tcagcacgctacgtcacgaccggtgctcgatttagcgtcgatctcaggggtccgggagatcatgagggtgtccttgggtttgggggaagaggaagactgacggtccccccaggagttcaggtgctgggcacagcggccctgggctgcctggtcaaggactacttccacgtagcgtgctgagcgggctggcaaggcgcatagnnnn

SEQ ID NO: 164532 - DNA, 236 bp, Homo sapiens
  misc_feature: GYAE6OF01B4YBQ.30.10.A10.1.454.CMB.1.raw
  modified_base (210)..(236): a, c, t, g, unknown or other
  misc_feature (210)..(236): n is a, c, g, or t
tcagcacgctacgtcacgaccggtgctcgatttagcgtcgatctcgtagggggtccgggagatcgatgagggtgtccgttgggttttggggggaagaggaagactgacggtccccccaggagttcagggtgcgtcggcacagcggccctgggctgcctggtcaaggctacttccacgtagcgtgctgagcgggctggcaaggcgcatagnnnnnnnnnnnnnnnnnnnnnnnnnnn

SEQ ID NO: 164533 - DNA, 206 bp, Homo sapiens; identical to SEQ ID NO: 164461
  misc_feature: GYAE6OF01DN81G.30.10.A10.1.454.CMB.1.raw
  modified_base (203)..(206): a, c, t, g, unknown or other
  misc_feature (203)..(206): n is a, c, g, or t

SEQ ID NO: 164534 - DNA, 245 bp, Homo sapiens; identical to SEQ ID NO: 164463
  misc_feature: GYAE6OF01EEDQN.30.10.A10.1.454.CMB.1.raw
  modified_base (243)..(245): a, c, t, g, unknown or other
  misc_feature (243)..(245): n is a, c, g, or t

SEQ ID NO: 164535 - DNA, 252 bp, Homo sapiens
  misc_feature: GYAE6OF01DHXO2.30.10.A10.1.454.CMB.1.raw
  modified_base (246)..(252): a, c, t, g, unknown or other
  misc_feature (246)..(252): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttggggggaagaggaagactgacggtccccccaggagttcaggtgctgggcacagcggccctgggctgcctggtcaaggactacttccacgtagcgtgctgagcgggctggcaaggcgcatagnnnnnnn

SEQ ID NO: 164536 - DNA, 246 bp, Homo sapiens
  misc_feature: GYAE6OF01BLNL4.30.10.A10.1.454.CMB.1.raw
  modified_base (244)..(246): a, c, t, g, unknown or other
  misc_feature (244)..(246): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggtttgggggaagaggaagactgacggtccccccaggagttcaggtgctgggcacagcggccctgggctgcctggtcaaggactacttccacgtagcgtgctgagcgggctggcaaggcgcatagnnn

SEQ ID NO: 164537 - DNA, 203 bp, Homo sapiens
  misc_feature: GYAE6OF01C9Y6J.30.10.A10.1.454.CMB.1.raw
  modified_base (202)..(203): a, c, t, g, unknown or other
  misc_feature (202)..(203): n is a, c, g, or t
tcagcacgctacgtcacgaccggtgctcgatttagcgtcgatctcaggggtccgggagatcatgagggtgtccttgggtttgggggaagaggaagactgacggtccccccaggagttcaggtgctgggcacagcggccctgggctgcctggtcaaggactacttccacgtagcgtgctgagcgggctggcaaggcgcatagnn

SEQ ID NO: 164538 - DNA, 206 bp, Homo sapiens
  misc_feature: GYAE6OF01A67S3.30.10.A10.1.454.CMB.1.raw
  modified_base (202)..(206): a, c, t, g, unknown or other
  misc_feature (202)..(206): n is a, c, g, or t
tcagcacgctacgtcacgaccggtgctcgatttagcgtcgatctcaggggtccgggagatcatgagggtgtccttgggttttgggggaagaggaagactgacggtcccccaggagttcaggtgctgggcacagcggccctgggctgcctggtcaaggactacttccacgtagcgtgctgagcgggctggcaaggcgcatagnnnnn

SEQ ID NO: 164539 - DNA, 206 bp, Homo sapiens
  misc_feature: GYAE6OF01BT9ES.30.10.A10.1.454.CMB.1.raw
  modified_base (203)..(206): a, c, t, g, unknown or other
  misc_feature (203)..(206): n is a, c, g, or t
tcagcacgctacgtcacgaccggtgctcgatttagcgtcgatctcagggtccgggagatcatgagggtgtttccttgggttttgggggaagaggaagactgacggtcccccaggagttcaggtgctgggcacagcggccctgggctgcctggtcaaggactacttccacgtagcgtgctgagcgggctggcaaggcgcatagnnnn

SEQ ID NO: 164540 - DNA, 204 bp, Homo sapiens; identical to SEQ ID NO: 164422
  misc_feature: GYAE6OF01DMLLH.30.10.A10.1.454.CMB.1.raw
  modified_base (201)..(204): a, c, t, g, unknown or other
  misc_feature (201)..(204): n is a, c, g, or t

SEQ ID NO: 164541 - DNA, 205 bp, Homo sapiens; identical to SEQ ID NO: 164440
  misc_feature: GYAE6OF01EHVTG.30.10.A10.1.454.CMB.1.raw
  modified_base (203)..(205): a, c, t, g, unknown or other
  misc_feature (203)..(205): n is a, c, g, or t

SEQ ID NO: 164542 - DNA, 204 bp, Homo sapiens; identical to SEQ ID NO: 164408
  misc_feature: GYAE6OF01EMRIF.30.10.A10.1.454.CMB.1.raw
  modified_base (202)..(204): a, c, t, g, unknown or other
  misc_feature (202)..(204): n is a, c, g, or t

SEQ ID NO: 164543 - DNA, 204 bp, Homo sapiens; identical to SEQ ID NO: 164470
  misc_feature: GYAE6OF01BEQ3I.30.10.A10.1.454.CMB.1.raw
  modified_base (203)..(204): a, c, t, g, unknown or other
  misc_feature (203)..(204): n is a, c, g, or t

SEQ ID NO: 164544 - DNA, 204 bp, Homo sapiens; identical to SEQ ID NO: 164470
  misc_feature: GYAE6OF01DMPOL.30.10.A10.1.454.CMB.1.raw
  modified_base (203)..(204): a, c, t, g, unknown or other
  misc_feature (203)..(204): n is a, c, g, or t

SEQ ID NO: 164545 - DNA, 248 bp, Homo sapiens
  misc_feature: GYAE6OF01C0PZI.30.10.A10.1.454.CMB.1.raw
  modified_base (243)..(248): a, c, t, g, unknown or other
  misc_feature (243)..(248): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttgggggaagaggaagactgacggtcccccaggagttcaggtgctgggcacagcggccctgggctgcctggtcaaggactacttccacgtagcgtgctgagcggctggcaaggcgcatagnnnnnn

SEQ ID NO: 164546 - DNA, 206 bp, Homo sapiens
  misc_feature: GYAE6OF01C5GFP.30.10.A10.1.454.CMB.1.raw
  modified_base (202)..(206): a, c, t, g, unknown or other
  misc_feature (202)..(206): n is a, c, g, or t
tcagcacgctacgtcacgaccggtgctcgatttagcgtcgatctcaggggtccgggagatcatgagggtgtccttgggtttgggggaagaggaagactgacggtccccccaggagttcaggtgctgggcacagcggccctgggctgcctggtcaaggactacttccacgtagcgtgctgagcgggctggcaaggcgcatagnnnnn

SEQ ID NO: 164547 - DNA, 246 bp, Homo sapiens; identical to SEQ ID NO: 164347
  misc_feature: GYAE6OF01D2YH2.30.10.A10.1.454.CMB.1.raw
  modified_base (243)..(246): a, c, t, g, unknown or other
  misc_feature (243)..(246): n is a, c, g, or t

SEQ ID NO: 164548 - DNA, 251 bp, Homo sapiens
  misc_feature: GYAE6OF01DAIE8.30.10.A10.1.454.CMB.1.raw
  modified_base (243)..(251): a, c, t, g, unknown or other
  misc_feature (243)..(251): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggtttgggggaagaggaagactgacggtcccccaggagttcaggtgctgggcacagcggccctgggctgcctggtcaaggactacttccacgtagcgtgctgagcgggctggcaaggcgcatagnnnnnnnnn

SEQ ID NO: 164549 - DNA, 256 bp, Homo sapiens
  misc_feature: GYAE6OF01DMY0B.30.10.A10.1.454.CMB.1.raw
  modified_base (246)..(256): a, c, t, g, unknown or other
  misc_feature (246)..(256): n is a, c, g, or t
tcagcacgctacgtcacgaccggtgctcgatttagcgtcgatctcagggtcttcggtggctcacgtccaccaccacgcatgtgacctcaggggtccgggagatcatgagggtgtccttgggttttggggggaagaggaagactgacggtccccccaggagttcaggtgctgggcacagcggccctgggctgcctggtcaaggctacttccacgtagcgtgctgagcgggctggcaaggcgcatagnnnnnnnnnnn

SEQ ID NO: 164550 - DNA, 205 bp, Homo sapiens; identical to SEQ ID NO: 164440
  misc_feature: GYAE6OF01BZ47N.30.10.A10.1.454.CMB.1.raw
  modified_base (203)..(205): a, c, t, g, unknown or other
  misc_feature (203)..(205): n is a, c, g, or t

SEQ ID NO: 164551 - DNA, 248 bp, Homo sapiens
  misc_feature: GYAE6OF01DOOO6.30.10.A10.1.454.CMB.1.raw
  modified_base (245)..(248): a, c, t, g, unknown or other
  misc_feature (245)..(248): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttgggggaagaggaagactgacggtccccccaggagttcaggtgctgggcacagcggccctgggctgcctggtcaaggactacttccacgtagcgtgctgagcgggctggcaaggcgcatagnnnn

SEQ ID NO: 164552 - DNA, 248 bp, Homo sapiens; identical to SEQ ID NO: 164414
  misc_feature: GYAE6OF01EPJSI.30.10.A10.1.454.CMB.1.raw
  modified_base (243)..(248): a, c, t, g, unknown or other
  misc_feature (243)..(248): n is a, c, g, or t

SEQ ID NO: 164553 - DNA, 245 bp, Homo sapiens
  misc_feature: GYAE6OF01CBTJ1.30.10.A10.1.454.CMB.1.raw
  modified_base (243)..(245): a, c, t, g, unknown or other
  misc_feature (243)..(245): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggtttgggggaagaggaagactgacggtccccccaggagttcaggtgctgggcacagcggccctgggctgcctggtcaaggactacttccacgtagcgtgctgagcggctggcaaggcgcatagnnn

SEQ ID NO: 164554 - DNA, 254 bp, Homo sapiens
  misc_feature: GYAE6OF01DWL1N.30.10.A10.1.454.CMB.1.raw
  modified_base (245)..(254): a, c, t, g, unknown or other
  misc_feature (245)..(254): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggtttgggggaagaggaagactgacggtccccccaggagttcaggtgctgggcacagcggccctgggctgcctgggtcaaggactacttccacgtagcgtgctgagcgggctggcaaggcgcatagnnnnnnnnnn

SEQ ID NO: 164555 - DNA, 224 bp, Homo sapiens
  misc_feature: GYAE6OF01D5H6J.30.10.A10.1.454.CMB.1.raw
  modified_base (204)..(224): a, c, t, g, unknown or other
  misc_feature (204)..(224): n is a, c, g, or t
tcagcacgctacgtcacgaccggtgctcgatttagcgtcgatctcaggggtccgggagatcatgagggtgtccttgggttttggggggaagaggaagactgacggtccccccaggagttcaggtgctgggcacagcggccctgggctgcctggtcaaggactacttccacgtagcgtgctgagcgggctggcaaggcgcatagnnnnnnnnnnnnnnnnnnnnn

SEQ ID NO: 164556 - DNA, 284 bp, Homo sapiens
  misc_feature: GYAE6OF01D2BCT.30.10.A10.1.454.CMB.1.raw
  modified_base (248)..(284): a, c, t, g, unknown or other
  misc_feature (248)..(284): n is a, c, g, or t
tcagcacgctacgtcacgaccggtgctcgatttagcgtcgatctcagggtcttcgtggctcacgtccaccacctacgcatgtgacctcaggggtccgggagatcatgagggtgtccgttgggtttgggggaagaggaagactggacggtccccccaggagttcaggtgctgggcacagcggccctgggctgcctggtcaaggctacttccacgtagcgtgctgagcgggctggcaaggcgcgatagannnnnnnnnnnnnnnnnnnnnnnnnnnnnnnnnnnnn

SEQ ID NO: 164557 - DNA, 249 bp, Homo sapiens
  misc_feature: GYAE6OF01ALJ8V.30.10.A10.1.454.CMB.1.raw
  modified_base (244)..(249): a, c, t, g, unknown or other
  misc_feature (244)..(249): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggtttgggggaagaggaagactgacggtccccccaggagttcaggtgctgggcacagcggccctgggctgcctggtcaaggactacttccacgtagcgtgctgagcgggctggcaaggcgcatagnnnnnn

SEQ ID NO: 164558 - DNA, 207 bp, Homo sapiens; identical to SEQ ID NO: 164501
  misc_feature: GYAE6OF01CH2KL.30.10.A10.1.454.CMB.1.raw
  modified_base (203)..(207): a, c, t, g, unknown or other
  misc_feature (203)..(207): n is a, c, g, or t

SEQ ID NO: 164559 - DNA, 242 bp, Homo sapiens
  misc_feature: GYAE6OF01A88F1.30.10.A10.1.454.CMB.1.raw
  modified_base (205)..(242): a, c, t, g, unknown or other
  misc_feature (205)..(242): n is a, c, g, or t
tcagcacgctacgtcacgaccggtgctcgatttagcgtcgatctcaggggtccgggaggatcatgagggtgtccttgggtttgggggaagaggaagactgacggttccccccaggagttcaggtgctgggcacagcggccctgggctgcctggtcaaggactacttccacgtagcgtgctgagcgggctggcgaaggcgcatagnnnnnnnnnnnnnnnnnnnnnnnnnnnnnnnnnnnnnn

SEQ ID NO: 164560 - DNA, 213 bp, Homo sapiens
  misc_feature: GYAE6OF01CG2NF.30.10.A10.1.454.CMB.1.raw
  modified_base (204)..(213): a, c, t, g, unknown or other
  misc_feature (204)..(213): n is a, c, g, or t
tcagcacgctacgtcacgaccggtgctcgatttagcgtcgatctcaggggtccgggagatcatgagggtgtccgttgggttttgggggaagaggaagactgaccggtccccccaggagttcaggtgctggcacagcggccctgggctgcctggtcaaggactacttccacgtagcgtgctgagcgggctggcaaggcgcatagnnnnnnnnnn

SEQ ID NO: 164561 - DNA, 204 bp, Homo sapiens; identical to SEQ ID NO: 164356
  misc_feature: GYAE6OF01DN90E.30.10.A10.1.454.CMB.1.raw
  modified_base (200)..(204): a, c, t, g, unknown or other
  misc_feature (200)..(204): n is a, c, g, or t

SEQ ID NO: 164562 - DNA, 249 bp, Homo sapiens; identical to SEQ ID NO: 164557
  misc_feature: GYAE6OF01A20T3.30.10.A10.1.454.CMB.1.raw
  modified_base (244)..(249): a, c, t, g, unknown or other
  misc_feature (244)..(249): n is a, c, g, or t

SEQ ID NO: 164563 - DNA, 248 bp, Homo sapiens
  misc_feature: GYAE6OF01ADH2C.30.10.A10.1.454.CMB.1.raw
  modified_base (246)..(248): a, c, t, g, unknown or other
  misc_feature (246)..(248): n is a, c, g, or t
tcagcacgctacgtcacgaccggtgctcgatttagcgtcgatctcgaagggtcttcgtggctcacgtccaccaccacgcatgtgacctcaggggtccgggagatcatgagggtgtccttgggtttgggggaagaggaagactgacggtccccccaggagttcaggtgctgggcacagcggccctgggctgcctggtcaaggactacttccacgtagcgtgctgagcgggctggcaaggcgcatagnnn

SEQ ID NO: 164564 - DNA, 250 bp, Homo sapiens
  misc_feature: GYAE6OF01DRWCL.30.10.A10.1.454.CMB.1.raw
  modified_base (245)..(250): a, c, t, g, unknown or other
  misc_feature (245)..(250): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttggggggaagaggaagactgacggtccccccaggagttcaggtgctgggcacagcggcctgggctgcctggtcaaggactacttccacgtagcgtgctgagcgggctggcaaggcgcatagnnnnnn

SEQ ID NO: 164565 - DNA, 262 bp, Homo sapiens
  misc_feature: GYAE6OF01ENTZY.30.10.A10.1.454.CMB.1.raw
  modified_base (248)..(262): a, c, t, g, unknown or other
  misc_feature (248)..(262): n is a, c, g, or t
tcagcacgctacgtcacgaccggtgctcgatttagcgtcgatctcagggtcgttcgtggctcacgtccaccaccacgcatgtgacctcaggggtccgggagatcatgagggtgtcccttgggtttggggggaagaggaagactgacggtccccccaggagttcaggtgctgggcacagcggccctgggctgcctggtcaaggactacttccacgtacgcgtgctgagcgggctggcaaggcgcatagnnnnnnnnnnnnnnn

SEQ ID NO: 164566 - DNA, 204 bp, Homo sapiens; identical to SEQ ID NO: 164470
  misc_feature: GYAE6OF01BT3DB.30.10.A10.1.454.CMB.1.raw
  modified_base (203)..(204): a, c, t, g, unknown or other
  misc_feature (203)..(204): n is a, c, g, or t

SEQ ID NO: 164567 - DNA, 246 bp, Homo sapiens
  misc_feature: GYAE6OF01BVZ4B.30.10.A10.1.454.CMB.1.raw
  modified_base (242)..(246): a, c, t, g, unknown or other
  misc_feature (242)..(246): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggtttgggggaagaggaagactgacggtcccccaggagttcaggtgctgggcacagcggccctgggctgcctggtcaaggactacttccacgtagcgtgctgagcggctggcaaggcgcatagnnnnn

SEQ ID NO: 164568 - DNA, 246 bp, Homo sapiens; identical to SEQ ID NO: 164347
  misc_feature: GYAE6OF01BIBKB.30.10.A10.1.454.CMB.1.raw
  modified_base (243)..(246): a, c, t, g, unknown or other
  misc_feature (243)..(246): n is a, c, g, or t

SEQ ID NO: 164569 - DNA, 249 bp, Homo sapiens; identical to SEQ ID NO: 164366
  misc_feature: GYAE6OF01DAHOZ.30.10.A10.1.454.CMB.1.raw
  modified_base (244)..(249): a, c, t, g, unknown or other
  misc_feature (244)..(249): n is a, c, g, or t

SEQ ID NO: 164570 - DNA, 205 bp, Homo sapiens; identical to SEQ ID NO: 164440
  misc_feature: GYAE6OF01AN1DX.30.10.A10.1.454.CMB.1.raw
  modified_base (203)..(205): a, c, t, g, unknown or other
  misc_feature (203)..(205): n is a, c, g, or t

SEQ ID NO: 164571 - DNA, 206 bp, Homo sapiens; identical to SEQ ID NO: 164461
  misc_feature: GYAE6OF01A01UG.30.10.A10.1.454.CMB.1.raw
  modified_base (203)..(206): a, c, t, g, unknown or other
  misc_feature (203)..(206): n is a, c, g, or t

SEQ ID NO: 164572 - DNA, 246 bp, Homo sapiens; identical to SEQ ID NO: 164495
  misc_feature: GYAE6OF01BS3FO.30.10.A10.1.454.CMB.1.raw
  modified_base (244)..(246): a, c, t, g, unknown or other
  misc_feature (244)..(246): n is a, c, g, or t

SEQ ID NO: 164573 - DNA, 248 bp, Homo sapiens
  misc_feature: GYAE6OF01EE3Q7.30.10.A10.1.454.CMB.1.raw
  modified_base (244)..(248): a, c, t, g, unknown or other
  misc_feature (244)..(248): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggtttgggggaagaggaagactgacggtccccccaggagttcaggtgctgggcacagcggccctgggctgcctggtcaaggactacttccacgtagcgtgctgagcgggctggcaaggcgcatagnnnnn

SEQ ID NO: 164574 - DNA, 291 bp, Homo sapiens
  misc_feature: GYAE6OF01DKPW5.30.10.A10.1.454.CMB.1.raw
  modified_base (244)..(244): a, c, t, g, unknown or other
  misc_feature (244)..(244): n is a, c, g, or t
  modified_base (250)..(291): a, c, t, g, unknown or other
  misc_feature (250)..(291): n is a, c, g, or t
tcagcacgctacgtcacgaccggtgctcgatttagcgtcgatctcgagggtcttcgtggctcacgtccaccaccacgcatgtgacctcaggggtccgggagactcatgagggtgtccgttgggttttgggggagaggaagactgaccggtccccccaggagttcaggtgctgggcacagcggccctgggcctgcctggtcaaggacctacttccacgtagcgtgctgagcgggctggcaaggcncatagnnnnnnnnnnnnnnnnnnnnnnnnnnnnnnnnnnnnnnnnnn

SEQ ID NO: 164575 - DNA, 285 bp, Homo sapiens
  misc_feature: GYAE6OF01BVG31.30.10.A10.1.454.CMB.1.raw
  modified_base (248)..(249): a, c, t, g, unknown or other
  misc_feature (248)..(249): n is a, c, g, or t
  modified_base (252)..(285): a, c, t, g, unknown or other
  misc_feature (252)..(285): n is a, c, g, or t
tcagcacgctacgtcacgaccggtgctcgatttagcgtcgatctcgagggttcggttcgtggctcacgtccaccaccacgcatgtgacctcaggggtccgggagatcatgagggtgtccttgggtttggggggaagaggaagactgacggtccccccagggagttcaggtgctgggcacagcggccctgggctgcctggtcaaggactactcacgtagcgtgctgagcgggctggcaaggcgcatagnngannnnnnnnnnnnnnnnnnnnnnnnnnnnnnnnnn

SEQ ID NO: 164576 - DNA, 292 bp, Homo sapiens
  misc_feature: GYAE6OF01DPERS.30.10.A10.1.454.CMB.1.raw
  modified_base (248)..(254): a, c, t, g, unknown or other
  misc_feature (248)..(254): n is a, c, g, or t
  modified_base (260)..(292): a, c, t, g, unknown or other
  misc_feature (260)..(292): n is a, c, g, or t
tcagcacgctacgtcacgaccggtgctcgatttagcgtcgatctcgagggtcttcgtggctcacgtccaccaccacgcatgtgacctcaggggtcccgggagatcatgaggggtgtccttgggttttgggggaagaggaagactgaccggtccccccaggagttcaggtgctgggcacagcggccctgggctgcctggtcaaggctacttccacgtagcgtgctgagcgggctggcaaggcgcatagnnnnnnntgctgnnnnnnnnnnnnnnnnnnnnnnnnnnnnnnnnn

SEQ ID NO: 164577 - DNA, 247 bp, Homo sapiens; identical to SEQ ID NO: 164369
  misc_feature: GYAE6OF01D6W46.30.10.A10.1.454.CMB.1.raw
  modified_base (243)..(247): a, c, t, g, unknown or other
  misc_feature (243)..(247): n is a, c, g, or t

SEQ ID NO: 164578 - DNA, 203 bp, Homo sapiens
  misc_feature: GYAE6OF01ESROE.30.10.A10.1.454.CMB.1.raw
  modified_base (203)..(203): a, c, t, g, unknown or other
  misc_feature (203)..(203): n is a, c, g, or t
tcagcacgctacgtcacgaccggtgctcgatttagcgtcgatctcaggggtccgggagatcatgagggtgtccttgggttttgggggaagaggaagactgacggtccccccaggagttcaggtgctgggcacagcggccctgggctgcctggtcaaggactacttccacgtagcgtgctgagcgggctggcaaggcgcatagn

SEQ ID NO: 164579 - DNA, 204 bp, Homo sapiens
  misc_feature: GYAE6OF01CO406.30.10.A10.1.454.CMB.1.raw
  modified_base (199)..(204): a, c, t, g, unknown or other
  misc_feature (199)..(204): n is a, c, g, or t
tcagcacgctacgtcacgaccggtgctcgatttagcgtcgatctcaggggtccgggagatcatgagggtgtccttgggtttgggggaagaggaagactgacggtcccccaggagttcaggtgctgggcacagcggcctgggctgcctggtcaaggctacttccacgtagcgtgctgagcgggctggcaaggcgcatagnnnnnn

SEQ ID NO: 164580 - DNA, 250 bp, Homo sapiens
  misc_feature: GYAE6OF01AY959.30.10.A10.1.454.CMB.1.raw
  modified_base (245)..(250): a, c, t, g, unknown or other
  misc_feature (245)..(250): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttgggggaagaggaagactgacggtccccccaggagttcaggtgctgggcacagcggccctgggctgcctggtcaaggactacttccacgtagcgtgctgagcgggctggcaaggcgcatagnnnnnn

SEQ ID NO: 164581 - DNA, 249 bp, Homo sapiens
  misc_feature: GYAE6OF01DP7Z2.30.10.A10.1.454.CMB.1.raw
  modified_base (242)..(249): a, c, t, g, unknown or other
  misc_feature (242)..(249): n is a, c, g, or t
tcagcacgctacgtcacgaccggtgctcgatttagcgtcgatctcagggtcttcgtggctcacgtccaccaccacgcatgtgacctcaggggtccggagatcatgagggtgtccttgggtttgggggaagaggaagactgacggtccccccaggagttcaggtgctgggcacagcggccctgggctgcctggtcaaggctacttccacgtagcgtgctgagcgggctggcaaggcgcatagnnnnnnnn

SEQ ID NO: 164582 - DNA, 249 bp, Homo sapiens; identical to SEQ ID NO: 164366
  misc_feature: GYAE6OF01CDNDZ.30.10.A10.1.454.CMB.1.raw
  modified_base (244)..(249): a, c, t, g, unknown or other
  misc_feature (244)..(249): n is a, c, g, or t

SEQ ID NO: 164583 - DNA, 250 bp, Homo sapiens
  misc_feature: GYAE6OF01C3WB5.30.10.A10.1.454.CMB.1.raw
  modified_base (245)..(250): a, c, t, g, unknown or other
  misc_feature (245)..(250): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttggggggaagaggaagactgacggtcccccaggagttcaggtgctgggcacagcggccctgggctgcctggtcaaggactacttccacgtagcgtgctgagcgggctggcaaggcgcatagnnnnnn

SEQ ID NO: 164584 - DNA, 235 bp, Homo sapiens
  misc_feature: GYAE6OF01BCCGB.30.10.A10.1.454.CMB.1.raw
  modified_base (200)..(200): a, c, t, g, unknown or other
  misc_feature (200)..(200): n is a, c, g, or t
  modified_base (206)..(208): a, c, t, g, unknown or other
  misc_feature (206)..(208): n is a, c, g, or t
  modified_base (210)..(211): a, c, t, g, unknown or other
  misc_feature (210)..(211): n is a, c, g, or t
  modified_base (213)..(235): a, c, t, g, unknown or other
  misc_feature (213)..(235): n is a, c, g, or t
tcagcacgctacgtcacgaccggtgctcgatttagcgtcgatctcgaggggtccgggagatcatgagggtgtccttggggttttggggggaagaggaagactgacggtccccccaggagttcaggtgctgggcacagcggccctgggctgcctggtcaaggctacttccacgtagcgtgctggagcgggctggcaaggcncatagnnntnngnnnnnnnnnnnnnnnnnnnnnnn

SEQ ID NO: 164585 - DNA, 248 bp, Homo sapiens; identical to SEQ ID NO: 164551
  misc_feature: GYAE6OF01CQCBZ.30.10.A10.1.454.CMB.1.raw
  modified_base (245)..(248): a, c, t, g, unknown or other
  misc_feature (245)..(248): n is a, c, g, or t

SEQ ID NO: 164586 - DNA, 206 bp, Homo sapiens; identical to SEQ ID NO: 164461
  misc_feature: GYAE6OF01CBNUW.30.10.A10.1.454.CMB.1.raw
  modified_base (203)..(206): a, c, t, g, unknown or other
  misc_feature (203)..(206): n is a, c, g, or t

SEQ ID NO: 164587 - DNA, 204 bp, Homo sapiens; identical to SEQ ID NO: 164470
  misc_feature: GYAE6OF01AH2SY.30.10.A10.1.454.CMB.1.raw
  modified_base (203)..(204): a, c, t, g, unknown or other
  misc_feature (203)..(204): n is a, c, g, or t

SEQ ID NO: 164588 - DNA, 206 bp, Homo sapiens
  misc_feature: GYAE6OF01AMGMB.30.10.A10.1.454.CMB.1.raw
  modified_base (202)..(206): a, c, t, g, unknown or other
  misc_feature (202)..(206): n is a, c, g, or t
tcagcacgctacgtcacgaccggtgctcgatttagcgtcgatctcagggtccgggagatcatgagggtgtccttgggttttgggggaagaggaagactgacggtccccccaggagttcaggtgctgggcacagcggccctgggctgcctggtcaaggactacttccacgtagcgtgctgagcgggctggcaaggcgcatagnnnnn

SEQ ID NO: 164589 - DNA, 216 bp, Homo sapiens
  misc_feature: GYAE6OF01A8D7D.30.10.A10.1.454.CMB.1.raw
  modified_base (202)..(216): a, c, t, g, unknown or other
  misc_feature (202)..(216): n is a, c, g, or t
tcagcacgctacgtcacgaccggtgctcgatttagcgtcgatctcaggggtccgggagatcatgagggtgtccttgggtttgggggaagaggaagactgacggtccccccaggagttcaggtgctgggcacagcggccctgggctgcctggtcaaggactacttccacgtagcgtgctgagcgggctggcaaggcgcatagnnnnnnnnnnnnnnn

SEQ ID NO: 164590 - DNA, 207 bp, Homo sapiens; identical to SEQ ID NO: 164501
  misc_feature: GYAE6OF01ECVLC.30.10.A10.1.454.CMB.1.raw
  modified_base (203)..(207): a, c, t, g, unknown or other
  misc_feature (203)..(207): n is a, c, g, or t

SEQ ID NO: 164591 - DNA, 264 bp, Homo sapiens
  misc_feature: GYAE6OF01B7B9I.30.10.A10.1.454.CMB.1.raw
  modified_base (246)..(264): a, c, t, g, unknown or other
  misc_feature (246)..(264): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttggggggaagaggaagactgacggtccccccaggagttcaggtgctgggcacagcggccctgggctgcctggtcaaggactacttccacgtagcgtgctgagcgggctggcaaggcgcatagnnnnnnnnnnnnnnnnnnn

SEQ ID NO: 164592 - DNA, 206 bp, Homo sapiens
  misc_feature: GYAE6OF01CVEAH.30.10.A10.1.454.CMB.1.raw
  modified_base (203)..(206): a, c, t, g, unknown or other
  misc_feature (203)..(206): n is a, c, g, or t
tcagcacgctacgtcacgaccggtgctcgatttagcgtcgatctcaggggtccgggagatcatgatggtgtccttgggttttgggggaagaggaagactgacggtccccccaggagttcaggtgctgggcacagcggccctgggctgcctggtcaaggactacttccacgtagcgtgctgagcgggctggcaaggcgcatagnnnn

SEQ ID NO: 164593 - DNA, 270 bp, Homo sapiens
  misc_feature: GYAE6OF01CKCTH.30.10.A10.1.454.CMB.1.raw
  modified_base (247)..(270): a, c, t, g, unknown or other
  misc_feature (247)..(270): n is a, c, g, or t
tcagcacgctacgtcacgaccggtgctcgatttagcgtcgatctcgagggtcggttcgtggctcacgtccaccaccacgcatgtgacctcaggggtccgggagatcatgagggtgtccttgggttttggggggaagaggaagactgacggtcccccaggagttcaggtgctgggcacagcggccctgggctgcctggtcaaggactactccacgtagcgtgctgagcgggctggcaaggcgcatagnnnnnnnnnnnnnnnnnnnnnnnn

SEQ ID NO: 164594 - DNA, 252 bp, Homo sapiens
  misc_feature: GYAE6OF01AMJUF.30.10.A10.1.454.CMB.1.raw
  modified_base (191)..(191): a, c, t, g, unknown or other
  misc_feature (191)..(191): n is a, c, g, or t
  modified_base (209)..(252): a, c, t, g, unknown or other
  misc_feature (209)..(252): n is a, c, g, or t
tcagcacgctacgtcacgaccggtgctcgatttagcgtcgatctcgagggtccggggagatcatgagggtgtcccttgggtttggggggaagaggaagactcgacggtccccccaggagttcaggtgctgggcacagcggcctgggcctgcctggtcaaggactacttccacgtagcgtgctgacgcgggntggcaaggcgcgaatagnnnnnnnnnnnnnnnnnnnnnnnnnnnnnnnnnnnnnnnnnnnn

SEQ ID NO: 164595 - DNA, 205 bp, Homo sapiens; identical to SEQ ID NO: 164440
  misc_feature: GYAE6OF01AP5VI.30.10.A10.1.454.CMB.1.raw
  modified_base (203)..(205): a, c, t, g, unknown or other
  misc_feature (203)..(205): n is a, c, g, or t

SEQ ID NO: 164596 - DNA, 256 bp, Homo sapiens
  misc_feature: GYAE6OF01CA21X.30.10.A10.1.454.CMB.1.raw
  modified_base (247)..(256): a, c, t, g, unknown or other
  misc_feature (247)..(256): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttgggggaagaggaagactgacggtccccccaggagttcaggtgctgggcacagcggccctgggctgcctggtcaaggactacttccacgtagcgtgctggagcgggctggccaaggcgcatagnnnnnnnnnn

SEQ ID NO: 164597 - DNA, 244 bp, Homo sapiens
  misc_feature: GYAE6OF01EYOUL.30.10.A10.1.454.CMB.1.raw
  modified_base (243)..(244): a, c, t, g, unknown or other
  misc_feature (243)..(244): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggtttggggggagaggaagactgacggtcccccaggagttcaggtgctgggcacagcggccctgggctgcctggtcaaggactacttccacgtagcgtgctgagcgggctggcaaggcgcatagnn

SEQ ID NO: 164598 - DNA, 259 bp, Homo sapiens
  misc_feature: GYAE6OF01CLY4J.30.10.A10.1.454.CMB.1.raw
  modified_base (246)..(247): a, c, t, g, unknown or other
  misc_feature (246)..(247): n is a, c, g, or t
  modified_base (249)..(259): a, c, t, g, unknown or other
  misc_feature (249)..(259): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttggggggaagaggaagactgacggtccccccaggagttcaggtgctgggcacagcggccctgggctgcctggtcaaggactacttccacgtagcgtgctgagcgggctggcaaggcgcatagnngnnnnnnnnnnn

SEQ ID NO: 164599 - DNA, 250 bp, Homo sapiens
  misc_feature: GYAE6OF01EF0FG.30.10.A10.1.454.CMB.1.raw
  modified_base (244)..(250): a, c, t, g, unknown or other
  misc_feature (244)..(250): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttgggggaagaggaagactgacggtcccccaggagttcaggtgctgggcacagcggccctgggctgcctggtcaaggactacttccacgtagcgtgctgagcgggctggcaaggcgcatagnnnnnnn

SEQ ID NO: 164600 - DNA, 208 bp, Homo sapiens; identical to SEQ ID NO: 164467
  misc_feature: GYAE6OF01BFHP5.30.10.A10.1.454.CMB.1.raw
  modified_base (203)..(208): a, c, t, g, unknown or other
  misc_feature (203)..(208): n is a, c, g, or t

SEQ ID NO: 164601 - DNA, 247 bp, Homo sapiens; identical to SEQ ID NO: 164369
  misc_feature: GYAE6OF01CAJRL.30.10.A10.1.454.CMB.1.raw
  modified_base (243)..(247): a, c, t, g, unknown or other
  misc_feature (243)..(247): n is a, c, g, or t

SEQ ID NO: 164602 - DNA, 206 bp, Homo sapiens; identical to SEQ ID NO: 164461
  misc_feature: GYAE6OF01A0ALO.30.10.A10.1.454.CMB.1.raw
  modified_base (203)..(206): a, c, t, g, unknown or other
  misc_feature (203)..(206): n is a, c, g, or t

SEQ ID NO: 164603 - DNA, 205 bp, Homo sapiens
  misc_feature: GYAE6OF01DJWKM.30.10.A10.1.454.CMB.1.raw
  modified_base (204)..(205): a, c, t, g, unknown or other
  misc_feature (204)..(205): n is a, c, g, or t
tcagcacgctacgtcacgaccggtgctcgatttagcgtcgatctcaggggtccgggagatcatgagggtgtccttgggttttggggggaagaggaagactgacggtccccccaggagttcaggtgctgggcacagcggccctgggctgcctggtcaaggactacttccacgtagcgtgctgagcgggctggcaaggcgcatagnn

SEQ ID NO: 164604 - DNA, 204 bp, Homo sapiens
  misc_feature: GYAE6OF01CLFX8.30.10.A10.1.454.CMB.1.raw
  modified_base (201)..(204): a, c, t, g, unknown or other
  misc_feature (201)..(204): n is a, c, g, or t
tcagcacgctacgtcacgaccggtgctcgatttagcgtcgatctcaggggtccgggagatcatgaggtgtccttgggtttggggggaagaggaagactgacggtcccccaggagttcaggtgctgtgcacagcggccctgggctgcctggtcaaggactacttccacgtagcgtgctgagcgggctggcaaggcgcatagnnnn

SEQ ID NO: 164605 - DNA, 253 bp, Homo sapiens
  misc_feature: GYAE6OF01BGX15.30.10.A10.1.454.CMB.1.raw
  modified_base (215)..(253): a, c, t, g, unknown or other
  misc_feature (215)..(253): n is a, c, g, or t
tcagcacgctacgtcacgaccggtgctcgatttagcgtcgatctcagggggtaccggggagatcagtgagggtgtccttggggttttggggggaagaggaagactggaccggtccccccaggacgttcaggttgcctgggcacagcggccctgggctggcctggtcaaggctacttccacgtagcgtgctgagcgggctgggcaaggcgcatagnnnnnnnnnnnnnnnnnnnnnnnnnnnnnnnnnnnnnnn

SEQ ID NO: 164606 - DNA, 206 bp, Homo sapiens
  misc_feature: GYAE6OF01C6H4U.30.10.A10.1.454.CMB.1.raw
  modified_base (200)..(200): a, c, t, g, unknown or other
  misc_feature (200)..(200): n is a, c, g, or t
  modified_base (203)..(206): a, c, t, g, unknown or other
  misc_feature (203)..(206): n is a, c, g, or t
tcagcacgctacgtcacgaccggtgctcgatttagcgtcgatctcaggggtccgggagatcatgagggtgtccttgggttttggggggaagaggaagactgacggtccccccaggagttcaggtgctgggcacagcggccctgggctgcctggtcaaggactacttccacgtagcgtgctgagcggctggcaaggcgcanagnnnn

SEQ ID NO: 164607 - DNA, 212 bp, Homo sapiens
  misc_feature: GYAE6OF01A6ZJN.30.10.A10.1.454.CMB.1.raw
  modified_base (207)..(212): a, c, t, g, unknown or other
  misc_feature (207)..(212): n is a, c, g, or t
tcagcacgctacgtcacgaccggtgctcgatttagcgtcgatctcaggggtccgggagatcatgagggtcgtccgttgggttttggggggaagaggaagacgtgacggtccccccaggagttcaggtgctgggcacagcggccctgggctgcctggtcaaggactacttccacgtagcgtgctgagcgggctggcaaggcgcatagnnnnnn

SEQ ID NO: 164608 - DNA, 252 bp, Homo sapiens
  misc_feature: GYAE6OF01D4KMG.30.10.A10.1.454.CMB.1.raw
  modified_base (244)..(252): a, c, t, g, unknown or other
  misc_feature (244)..(252): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggtttgggggaagaggaagactgacggtccccccaggagttcaggtgctgggcacagcggcctgggctgcctggtcaaggactacttccacgtagcgtgctgagcgggctgggcaaggcgcatagnnnnnnnnn

SEQ ID NO: 164609 - DNA, 282 bp, Homo sapiens
  misc_feature: GYAE6OF01D41OT.30.10.A10.1.454.CMB.1.raw
  modified_base (253)..(282): a, c, t, g, unknown or other
  misc_feature (253)..(282): n is a, c, g, or t
tcagcacgctacgtcacgaccggtgctcgatttagcgtcgatctcagggtcgttcgtggctcacgtccaccaccacgcatgtgacctcaggggtcccgggagatcatgaggggtgtcctttggggttttggggggaagaggaagactggaccggtccccccaggagttcagggtgctgggcacggcggccctgggctgcctggtcaaggactactccacgtagcgtgctgagcgggctggcaaggcgcatagnnnnnnnnnnnnnnnnnnnnnnnnnnnnnn

SEQ ID NO: 164610 - DNA, 249 bp, Homo sapiens
  misc_feature: GYAE6OF01DM1FX.30.10.A10.1.454.CMB.1.raw
  modified_base (246)..(249): a, c, t, g, unknown or other
  misc_feature (246)..(249): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttggggttttggggggaagaggaagactgacggtccccccaggagttcaggtgctgggcacagcggcctgggctgcctggtcaaggactacttccacgtagcgtgctgagcgggctggcaaggcgcatagnnnn

SEQ ID NO: 164611 - DNA, 246 bp, Homo sapiens
  misc_feature: GYAE6OF01CII0K.30.10.A10.1.454.CMB.1.raw
  modified_base (238)..(238): a, c, t, g, unknown or other
  misc_feature (238)..(238): n is a, c, g, or t
  modified_base (241)..(246): a, c, t, g, unknown or other
  misc_feature (241)..(246): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggtttgggggaagaggaagactgacggtcccccaggagttcaggtgctgggcacagcggccctgggctgcctggtcaaggactacttcacgtagcgtgctgagcggctggcaaggcgcanagnnnnnn

SEQ ID NO: 164612 - DNA, 208 bp, Homo sapiens
  misc_feature: GYAE6OF01APRLI.30.10.A10.1.454.CMB.1.raw
  modified_base (202)..(208): a, c, t, g, unknown or other
  misc_feature (202)..(208): n is a, c, g, or t
tcagcacgctacgtcacgaccggtgctcgatttagcgtcgatctcaggggtccgggagatcatgagggtgtccttgggttttgggggaagaggaagactgacggtcccccaggagttcaggtgctgggcacagcggccctgggctgcctggtcaaggactacttccacgtagcgtgctgagcgggctggcaaggcgcatagnnnnnnn

SEQ ID NO: 164613 - DNA, 250 bp, Homo sapiens; identical to SEQ ID NO: 164580
  misc_feature: GYAE6OF01CJC3V.30.10.A10.1.454.CMB.1.raw
  modified_base (245)..(250): a, c, t, g, unknown or other
  misc_feature (245)..(250): n is a, c, g, or t

SEQ ID NO: 164614 - DNA, 262 bp, Homo sapiens
  misc_feature: GYAE6OF01C6ULL.30.10.A10.1.454.CMB.1.raw
  modified_base (248)..(262): a, c, t, g, unknown or other
  misc_feature (248)..(262): n is a, c, g, or t
tcagcacgctacgtcacgaccggtgctcgatttagcgtcgatctcagggtcttcggtggctcacgtccaccaccacgcatgtgacctcaggggtccgggagatcatgagggtgtccttggggtttgggggaagaggaagactgacggtcccccaggagttcaggtgcgtgggcacagccggccctgggctgcctggtcaaggactacttccacgtagcgtgctgaggcgggctggcaaggcgcatagnnnnnnnnnnnnnnn

SEQ ID NO: 164615 - DNA, 241 bp, Homo sapiens
  misc_feature: GYAE6OF01C3WDT.30.10.A10.1.454.CMB.1.raw
  modified_base (215)..(241): a, c, t, g, unknown or other
  misc_feature (215)..(241): n is a, c, g, or t
tcagcacgctacgtcacgaccggtgctcgatttagcgtcgatctcaggggtccgggagatcatgagggtgtccttgggtttggggggaagaggaagactgacggtccccccaggattcaggtgtcgtggcacaggccggtcccgtgggctcgcctggtcaaggaccttacttccacgtagcgtgctgaggcgggctggacaaggcgactaagtgnnnnnnnnnnnnnnnnnnnnnnnnnnn

SEQ ID NO: 164616 - DNA, 251 bp, Homo sapiens; identical to SEQ ID NO: 164548
  misc_feature: GYAE6OF01BDRJI.30.10.A10.1.454.CMB.1.raw
  modified_base (243)..(251): a, c, t, g, unknown or other
  misc_feature (243)..(251): n is a, c, g, or t

SEQ ID NO: 164617 - DNA, 248 bp, Homo sapiens
  misc_feature: GYAE6OF01BYAE4.30.10.A10.1.454.CMB.1.raw
  modified_base (244)..(248): a, c, t, g, unknown or other
  misc_feature (244)..(248): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttgggggaagaggaagactgaggtccccccaggagttcaggtgctgggcacagcggccctgggctgcctggtcaaggactacttccacgtagcgtgctgagcgggctggcaaggcgcatagnnnnn

SEQ ID NO: 164618 - DNA, 246 bp, Homo sapiens; identical to SEQ ID NO: 164347
  misc_feature: GYAE6OF01C8B9Q.30.10.A10.1.454.CMB.1.raw
  modified_base (243)..(246): a, c, t, g, unknown or other
  misc_feature (243)..(246): n is a, c, g, or t

SEQ ID NO: 164619 - DNA, 253 bp, Homo sapiens
  misc_feature: GYAE6OF01E0D71.30.10.A10.1.454.CMB.1.raw
  modified_base (247)..(253): a, c, t, g, unknown or other
  misc_feature (247)..(253): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttggggggaagaggaagactgacggtccccccaggagttcaggtgctgggcacagcggccctggggctgcctggtcaaggactacttccacgtagcgtgctgagcgggctggcaaggcgcatagnnnnnnn

SEQ ID NO: 164620 - DNA, 208 bp, Homo sapiens
  misc_feature: GYAE6OF01CN620.30.10.A10.1.454.CMB.1.raw
  modified_base (202)..(208): a, c, t, g, unknown or other
  misc_feature (202)..(208): n is a, c, g, or t
tcagcacgctacgtcacgaccggtgctcgatttagcgtcgatctcaggggtccgggagatcatgagggtgtccttgggttttgggggaagaggaagactgacggtccccccaggagttcaggtgctggcacagcggccctgggctgcctggtcaaggactacttccacgtagcgtgctgagcgggctggcaaggcgcatagnnnnnnn

SEQ ID NO: 164621 - DNA, 570 bp, Homo sapiens
  misc_feature: GYAE6OF01ANMIZ.30.10.A10.1.454.CMB.1.raw
  modified_base (210)..(210): a, c, t, g, unknown or other
  misc_feature (210)..(210): n is a, c, g, or t
  modified_base (214)..(214): a, c, t, g, unknown or other
  misc_feature (214)..(214): n is a, c, g, or t
  modified_base (217)..(217): a, c, t, g, unknown or other
  misc_feature (217)..(217): n is a, c, g, or t
  modified_base (219)..(219): a, c, t, g, unknown or other
  misc_feature (219)..(219): n is a, c, g, or t
  modified_base (226)..(227): a, c, t, g, unknown or other
  misc_feature (226)..(227): n is a, c, g, or t
  modified_base (231)..(231): a, c, t, g, unknown or other
  misc_feature (231)..(231): n is a, c, g, or t
  modified_base (234)..(234): a, c, t, g, unknown or other
  misc_feature (234)..(234): n is a, c, g, or t
  modified_base (236)..(236): a, c, t, g, unknown or other
  misc_feature (236)..(236): n is a, c, g, or t
  modified_base (244)..(245): a, c, t, g, unknown or other
  misc_feature (244)..(245): n is a, c, g, or t
  modified_base (258)..(258): a, c, t, g, unknown or other
  misc_feature (258)..(258): n is a, c, g, or t
  modified_base (272)..(272): a, c, t, g, unknown or other
  misc_feature (272)..(272): n is a, c, g, or t
  modified_base (275)..(275): a, c, t, g, unknown or other
  misc_feature (275)..(275): n is a, c, g, or t
tcagcacgctacgtcacgaccggtgctcgatttagcgtcgatctcagggggtccgggagatcgagtgagggtgtccttgggttttggggggaagaggaagacctagacggtccccccaggacgttcacggtgctcggcacagcggccctggctgcctggtcaaggcctacttccacgtagcgtgctgagcggctggcaaggcgcactagnacgnagntnacgcgcnngcangcncncagatacnntgagacagagacncgagcagcctgtanagngacacgtagacgcactagacgtacgacacagacactacgtacgacgacgtacgtcgtctacgctctacgtccgacgacgacgtcgacgtacgtactcgtacgactacgtacgatacgtacgacgtacggacaacggagttacgacggcgttagacgtacgtcgtactaataccgagtagagacgtaggacgtacgtgtacggttgacgttacggacggtacgtaccggaggtccgtacggacccgttacgacgtaccgacgtacccgtacggtaccaccggcccgttcgcgtacg

SEQ ID NO: 164622 - DNA, 237 bp, Homo sapiens
  misc_feature: GYAE6OF01C56CX.30.10.A10.1.454.CMB.1.raw
  modified_base (206)..(237): a, c, t, g, unknown or other
  misc_feature (206)..(237): n is a, c, g, or t
tcagcacgctacgtcacgaccggtgctcgatttagcgtcgatctcaggggtccgggaggatcatgagggtgtccttgggttttggggggaagaggaagactgacggtccccccaggagttcaggtgctggcacagccggccctgggctgcctggtcaaggactacttccacgttagcgtgctgagcgggctggcaaggcgcatagnnnnnnnnnnnnnnnnnnnnnnnnnnnnnnnn

SEQ ID NO: 164623 - DNA, 249 bp, Homo sapiens
  misc_feature: GYAE6OF01B6XNQ.30.10.A10.1.454.CMB.1.raw
  modified_base (245)..(249): a, c, t, g, unknown or other
  misc_feature (245)..(249): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttgggggaagaggaagactgacggtccccccaggagttcaggtgctgggcacagcggccctgggctgcctggtcaaggactacttccacgtagcgtgctgagcgggctggcaaggcgcatagnnnnn

SEQ ID NO: 164624 - DNA, 252 bp, Homo sapiens; identical to SEQ ID NO: 164535
  misc_feature: GYAE6OF01CS405.30.10.A10.1.454.CMB.1.raw
  modified_base (246)..(252): a, c, t, g, unknown or other
  misc_feature (246)..(252): n is a, c, g, or t

SEQ ID NO: 164625 - DNA, 206 bp, Homo sapiens
  misc_feature: GYAE6OF01DHE6H.30.10.A10.1.454.CMB.1.raw
  modified_base (203)..(206): a, c, t, g, unknown or other
  misc_feature (203)..(206): n is a, c, g, or t
tcagcacgctacgtcacgaccggtgctcgatttagcgtcgatctcaggggtccgggagatcatgagggtgtccttgggttttggggggaagaggaagactgacggtccccccaggagttcaggtgctggcacagcggccctgggctgcctggtcaaggactacttccacgtagcgtgctgagcgggctggcaaggcgcatagnnnn

SEQ ID NO: 164626 - DNA, 206 bp, Homo sapiens; identical to SEQ ID NO: 164538
  misc_feature: GYAE6OF01B6Z8P.30.10.A10.1.454.CMB.1.raw
  modified_base (202)..(206): a, c, t, g, unknown or other
  misc_feature (202)..(206): n is a, c, g, or t

SEQ ID NO: 164627 - DNA, 208 bp, Homo sapiens
  misc_feature: GYAE6OF01A6TS7.30.10.A10.1.454.CMB.1.raw
  modified_base (200)..(208): a, c, t, g, unknown or other
  misc_feature (200)..(208): n is a, c, g, or t
tcagcacgctacgtcacgaccggtgctcgatttagcgtcgatctcaggggtccgggagatcatgagggtgtccttgggtttgggggaagaggaagactgacggtcccccaggagttcaggtgctggcacagcggccctgggctgcctggtcaaggactacttccacgtagcgtgctgagcgggctggcaaggcgcatagnnnnnnnnn

SEQ ID NO: 164628 - DNA, 205 bp, Homo sapiens
  misc_feature: GYAE6OF01DFT71.30.10.A10.1.454.CMB.1.raw
  modified_base (197)..(197): a, c, t, g, unknown or other
  misc_feature (197)..(197): n is a, c, g, or t
  modified_base (203)..(205): a, c, t, g, unknown or other
  misc_feature (203)..(205): n is a, c, g, or t
tcagcacgctacgtcacgaccggtgctcgatttagcgtcgatctcaggggtccgggagatcatgagggtgtccttgggttttggggggaagaggaagactgacggtccccccaggagttcaggtgctggcacagcggccctgggctgcctggtcaaggactacttccacgtagcgtgctgagcgggctggcaaggcncatagnnn

SEQ ID NO: 164629 - DNA, 252 bp, Homo sapiens
  misc_feature: GYAE6OF01DLAXD.30.10.A10.1.454.CMB.1.raw
  modified_base (245)..(252): a, c, t, g, unknown or other
  misc_feature (245)..(252): n is a, c, g, or t
tcagcacgctacgtcacgaccggtgctcgatttagcgtcgatctcagggtcttcgtggctcacgtccaccaccacgcatgtgacctcagggtccgggagatcatgagggtgtccttgggttttggggggaagaggaagactgacggtccccccaggagttcaggtgctgggcacagcggccctgggctgcctggtcaaggactacttccacgtagcgtgctgagcgggctggcaaggcgcatagnnnnnnnn

SEQ ID NO: 164630 - DNA, 210 bp, Homo sapiens
  misc_feature: GYAE6OF01DSW23.30.10.A10.1.454.CMB.1.raw
  modified_base (202)..(210): a, c, t, g, unknown or other
  misc_feature (202)..(210): n is a, c, g, or t
tcagcacgctacgtcacgaccggtgctcgatttagcgtcgatctcaggggtccgggagatcatgagggtgtccttgggttttgggggaagaggaagactgacggtccccccaggagttcaggtgctgggcacagcggccctgggctgcctggtcaaggactacttccacgtagcgtgctgagcggctggcaaggcgcatagnnnnnnnnn

SEQ ID NO: 164631 - DNA, 258 bp, Homo sapiens
  misc_feature: GYAE6OF01EKOO5.30.10.A10.1.454.CMB.1.raw
  modified_base (244)..(258): a, c, t, g, unknown or other
  misc_feature (244)..(258): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggtttggggggaagaggaagactgacggtccccccaggagttcaggtgctgggcacagcggccctgggctgcctggtcaaggactacttccacgtagcgtgctgagcggctggcaaggcgcatagnnnnnnnnnnnnnnn

SEQ ID NO: 164632 - DNA, 204 bp, Homo sapiens
  misc_feature: GYAE6OF01BOS6L.30.10.A10.1.454.CMB.1.raw
  modified_base (203)..(204): a, c, t, g, unknown or other
  misc_feature (203)..(204): n is a, c, g, or t
tcagcacgctacgtcacgaccggtgctcgatttagcgtcgatctcaggggtccgggagatcatgagggtgtccttgggttttgggggaagaggaagactgacggtccccccaggagttcaggtgctgggcacagtggccctgggctgcctggtcaaggactacttccacgtagcgtgctgagcgggctggcaaggcgcatagnn

SEQ ID NO: 164633 - DNA, 247 bp, Homo sapiens; identical to SEQ ID NO: 164428
  misc_feature: GYAE6OF01BRN7S.30.10.A10.1.454.CMB.1.raw
  modified_base (242)..(247): a, c, t, g, unknown or other
  misc_feature (242)..(247): n is a, c, g, or t

SEQ ID NO: 164634 - DNA, 207 bp, Homo sapiens
  misc_feature: GYAE6OF01CCJ95.30.10.A10.1.454.CMB.1.raw
  modified_base (200)..(207): a, c, t, g, unknown or other
  misc_feature (200)..(207): n is a, c, g, or t
tcagcacgctacgtcacgaccggtgctcgatttagcgtcgatctcagggtccgggagatcatgagggtgtccttgggtttgggggaagaggaagactgacggtcccccaggagttcaggtgctgggcacagcggccctgggctgcctggtcaaggactacttccacgtagcgtgctgagcgggctggcaaggcgcatagnnnnnnnn

SEQ ID NO: 164635 - DNA, 253 bp, Homo sapiens
  misc_feature: GYAE6OF01DP3TB.30.10.A10.1.454.CMB.1.raw
  modified_base (246)..(253): a, c, t, g, unknown or other
  misc_feature (246)..(253): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttggggttttggggggaagaggaagactgacggtccccccaggagttcaggtgctgggcacagcggccctgggctgcctggtcaaggactacttccacgtagcgtgctgagcggctggcaaggcgcatagnnnnnnnn

SEQ ID NO: 164636 - DNA, 209 bp, Homo sapiens; identical to SEQ ID NO: 164502
  misc_feature: GYAE6OF01BRH28.30.10.A10.1.454.CMB.1.raw
  modified_base (203)..(209): a, c, t, g, unknown or other
  misc_feature (203)..(209): n is a, c, g, or t

SEQ ID NO: 164637 - DNA, 206 bp, Homo sapiens; identical to SEQ ID NO: 164461
  misc_feature: GYAE6OF01CE5JZ.30.10.A10.1.454.CMB.1.raw
  modified_base (203)..(206): a, c, t, g, unknown or other
  misc_feature (203)..(206): n is a, c, g, or t

SEQ ID NO: 164638 - DNA, 249 bp, Homo sapiens
  misc_feature: GYAE6OF01ESN86.30.10.A10.1.454.CMB.1.raw
  modified_base (246)..(249): a, c, t, g, unknown or other
  misc_feature (246)..(249): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttggggggaagaggaagactgacggtccccccaggagttcaggtgctgggcacagcggccctgggctgcctggtcaaggactacttccacgtagcgtgctgagcgggctggcaaggcgcatagnnnn

SEQ ID NO: 164639 - DNA, 248 bp, Homo sapiens
  misc_feature: GYAE6OF01B4PVY.30.10.A10.1.454.CMB.1.raw
  modified_base (244)..(248): a, c, t, g, unknown or other
  misc_feature (244)..(248): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggtttggggggaagaggaagactgacggtcccccaggagttcaggtgctgggcacagcggccctgggctgcctggtcaaggactacttccacgtagcgtgctgagcgggctggcaaggcgcatagnnnnn

SEQ ID NO: 164640 - DNA, 323 bp, Homo sapiens
  misc_feature: GYAE6OF01BD56C.30.10.A10.1.454.CMB.1.raw
  modified_base (242)..(242): a, c, t, g, unknown or other
  misc_feature (242)..(242): n is a, c, g, or t
  modified_base (249)..(254): a, c, t, g, unknown or other
  misc_feature (249)..(254): n is a, c, g, or t
  modified_base (256)..(256): a, c, t, g, unknown or other
  misc_feature (256)..(256): n is a, c, g, or t
  modified_base (260)..(323): a, c, t, g, unknown or other
  misc_feature (260)..(323): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttggggggaagaggaagactgacggtccccccaggagttcaggtgctgggcacagcggccctgggctgcctggtcaaggactacttccacgtagcgtgctggagcgggactggcaaggcncaatagnnnnnntncgannnnnnnnnnnnnnnnnnnnnnnnnnnnnnnnnnnnnnnnnnnnnnnnnnnnnnnnnnnnnnnn

SEQ ID NO: 164641 - DNA, 253 bp, Homo sapiens
  misc_feature: GYAE6OF01E5G0P.30.10.A10.1.454.CMB.1.raw
  modified_base (246)..(253): a, c, t, g, unknown or other
  misc_feature (246)..(253): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttggggggaagaggaagactgacggtccccccaggagttcaggtgctgggcacagcggccctgggctgcctggtcaaggactacttccacgtagcgtgctgagcgggctggcaaggcgcatagnnnnnnnn

SEQ ID NO: 164642 - DNA, 259 bp, Homo sapiens
  misc_feature: GYAE6OF01CTTP1.30.10.A10.1.454.CMB.1.raw
  modified_base (91)..(91): a, c, t, g, unknown or other
  misc_feature (91)..(91): n is a, c, g, or t
  modified_base (207)..(259): a, c, t, g, unknown or other
  misc_feature (207)..(259): n is a, c, g, or t
tcagcacgctacgtcacgaccggtgctcgatttagcgtcgatctcaggggtccgggagatcatgagggtgtccttgggttttgggggaagnggaagacttgacggtcccccctaggagttcaggtgctgggcacagcggccctgggctgcctggtcaaggctacttccacgtagcgtgctgagcgggctgggcaacggcgacatagnnnnnnnnnnnnnnnnnnnnnnnnnnnnnnnnnnnnnnnnnnnnnnnnnnnnn

SEQ ID NO: 164643 - DNA, 260 bp, Homo sapiens
  misc_feature: GYAE6OF01C50YP.30.10.A10.1.454.CMB.1.raw
  modified_base (247)..(260): a, c, t, g, unknown or other
  misc_feature (247)..(260): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttggggggaagagggaagactgacggtccccccaggagttcaggtgctgggcacagcggccctgggctgcctggtcaaggactacttccacgtagcgtgctgagcgggctggcaaggcgcatagnnnnnnnnnnnnnn

SEQ ID NO: 164644 - DNA, 210 bp, Homo sapiens
  misc_feature: GYAE6OF01B2952.30.10.A10.1.454.CMB.1.raw
  modified_base (203)..(210): a, c, t, g, unknown or other
  misc_feature (203)..(210): n is a, c, g, or t
tcagcacgctacgtcacgaccggtgctcgatttagcgtcgatctcaggggtccgggagatcatgagggtgtccttgggttttggggggaagaggaagactgacggtccccccaggagttcaggtgctgggcacagcggccctgggctgcctggtcaaggactacttccacgtagcgtgctgagcggctggcaaggcgcatagnnnnnnnn

SEQ ID NO: 164645 - DNA, 207 bp, Homo sapiens; identical to SEQ ID NO: 164501
  misc_feature: GYAE6OF01DZHZO.30.10.A10.1.454.CMB.1.raw
  modified_base (203)..(207): a, c, t, g, unknown or other
  misc_feature (203)..(207): n is a, c, g, or t

SEQ ID NO: 164646 - DNA, 253 bp, Homo sapiens
  misc_feature: GYAE6OF01DD0HC.30.10.A10.1.454.CMB.1.raw
  modified_base (248)..(253): a, c, t, g, unknown or other
  misc_feature (248)..(253): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttggggttttggggggaagaggaagactgaccggtccccccaggagttcaggtgctgggcacagcggccctgggctgcctggtcaaggactacttccacgtagcgtgctgagcgggctggcaaggcgcatagnnnnnn

SEQ ID NO: 164647 - DNA, 249 bp, Homo sapiens
  misc_feature: GYAE6OF01A8FBI.30.10.A10.1.454.CMB.1.raw
  modified_base (245)..(249): a, c, t, g, unknown or other
  misc_feature (245)..(249): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggtttggggggaagaggaagactgacggtccccccaggagttcaggtgctgggcacagcggccctgggctgcctggtcaaggactacttccacgtagcgtgctgagcgggctggcaaggcgcatagnnnnn

SEQ ID NO: 164648 - DNA, 207 bp, Homo sapiens
  misc_feature: GYAE6OF01AI0PN.30.10.A10.1.454.CMB.1.raw
  modified_base (202)..(207): a, c, t, g, unknown or other
  misc_feature (202)..(207): n is a, c, g, or t
tcagcacgctacgtcacgaccggtgctcgatttagcgtcgatctcaggggtccgggagatcatgagggtgtccttgggttttgggggaagaggaagactgacggtccccccaggagttcaggtgctgggcacagcggccctgggctgcctggtcaaggactactccacgtagcgtgctgagcgggctggcaaggcgcatagnnnnnn

SEQ ID NO: 164649 - DNA, 208 bp, Homo sapiens
  misc_feature: GYAE6OF01D8GQN.30.10.A10.1.454.CMB.1.raw
  modified_base (202)..(208): a, c, t, g, unknown or other
  misc_feature (202)..(208): n is a, c, g, or t
tcagcacgctacgtcacgaccggtgctcgatttagcgtcgatctcaggggtccggagatcatgagggtgtccttgggttttgggggaagaggaagactgacggtccccccaggagttcaggtgctgggcacagcggccctgggctgcctggtcaaggactacttccacgtagcgtgctgagcgggctggcaaggcgcatagnnnnnnn

SEQ ID NO: 164650 - DNA, 214 bp, Homo sapiens
  misc_feature: GYAE6OF01A65WY.30.10.A10.1.454.CMB.1.raw
  modified_base (204)..(214): a, c, t, g, unknown or other
  misc_feature (204)..(214): n is a, c, g, or t
tcagcacgctacgtcacgaccggtgctcgatttagcgtcgatctcaggggtccgggagatcatggagggtgtccttgggttttggggggaagaggaagactgacggtccccccaggagttcaggtgctgggcacagcggccctgggctgcctggtcaaggctacttccacgtagcgtgctgagcgggctggcaaggcgcatagnnnnnnnnnnn

SEQ ID NO: 164651 - DNA, 211 bp, Homo sapiens
  misc_feature: GYAE6OF01BM3F9.30.10.A10.1.454.CMB.1.raw
  modified_base (204)..(211): a, c, t, g, unknown or other
  misc_feature (204)..(211): n is a, c, g, or t
tcagcacgctacgtcacgaccggtgctcgatttagcgtcgatctcaggggtccgggagatcatgagggtgtccttgggttttgggggaagaggaagactgacggtccccccaggagttcaggtgctgggcacagcggccctgggctgcctggtcaaggactacttccacgtagcgtgctgagcgggctggcaagggcgcatagnnnnnnnn

SEQ ID NO: 164652 - DNA, 208 bp, Homo sapiens
  misc_feature: GYAE6OF01AEPU7.30.10.A10.1.454.CMB.1.raw
  modified_base (203)..(208): a, c, t, g, unknown or other
  misc_feature (203)..(208): n is a, c, g, or t
tcagcacgctacgtcacgaccggtgctcgatttagcgtcgatctcaggggtccgggagatcatgagggtgtccttgggttttggggggaagaggaagactgacggtcccccaggagttcaggtgctgggcacagcggccctgggctgcctggtcaaggactacttccacgtagcgtgctgagcgggctggcaaggcgcatagnnnnnn

SEQ ID NO: 164653 - DNA, 263 bp, Homo sapiens
  misc_feature: GYAE6OF01DBGP8.30.10.A10.1.454.CMB.1.raw
  modified_base (251)..(263): a, c, t, g, unknown or other
  misc_feature (251)..(263): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccgttggggttttggggggaagaggaagactgaccggtccccccaggagttcaggtgctgggcacacgcggccctgggctgcctggtcaaggactacttccacgtagcgtgctgagcgggctggcaaggcgacatagnnnnnnnnnnnnn

SEQ ID NO: 164654 - DNA, 246 bp, Homo sapiens; identical to SEQ ID NO: 164567
  misc_feature: GYAE6OF01AWIUS.30.10.A10.1.454.CMB.1.raw
  modified_base (242)..(246): a, c, t, g, unknown or other
  misc_feature (242)..(246): n is a, c, g, or t

SEQ ID NO: 164655 - DNA, 209 bp, Homo sapiens
  misc_feature: GYAE6OF01C1IIL.30.10.A10.1.454.CMB.1.raw
  modified_base (204)..(209): a, c, t, g, unknown or other
  misc_feature (204)..(209): n is a, c, g, or t
tcagcacgctacgtcacgaccggtgctcgatttagcgtcgatctcaggggtccgggagatcatgagggtgtccttgggttttggggggaagaggaagactgacggtccccccaggagttcaggtgctgggcacagcggccctgggctgcctggtcaaggactacttccacgtagcgtgctgagcgggctggcaaggcgcatagnnnnnn

SEQ ID NO: 164656 - DNA, 253 bp, Homo sapiens; identical to SEQ ID NO: 164641
  misc_feature: GYAE6OF01B0CBC.30.10.A10.1.454.CMB.1.raw
  modified_base (246)..(253): a, c, t, g, unknown or other
  misc_feature (246)..(253): n is a, c, g, or t

SEQ ID NO: 164657 - DNA, 217 bp, Homo sapiens
  misc_feature: GYAE6OF01DSXPB.30.10.A10.1.454.CMB.1.raw
  modified_base (202)..(217): a, c, t, g, unknown or other
  misc_feature (202)..(217): n is a, c, g, or t
tcagcacgctacgtcacgaccggtgctcgatttagcgtcgatctcagggtccgggaggatcatgagggtgtccttgggttttggggggaagaggaagactgacggtccccccaggagttcaggtgctggcacagcggccctggctgcctggtcaaggactacttccacgtagcgtgctgagcgggctggcaaggcgcatagnnnnnnnnnnnnnnnn

SEQ ID NO: 164658 - DNA, 204 bp, Homo sapiens
  misc_feature: GYAE6OF01DPIVX.30.10.A10.1.454.CMB.1.raw
  modified_base (203)..(204): a, c, t, g, unknown or other
  misc_feature (203)..(204): n is a, c, g, or t
tcagcacgctacgtcacgaccggtgctcgatttagcgtcgatctcaggggtccgggagatcatgagggtgtccttgggttttggggggaagaggaagactgacggtccccccaggagttcaggtgctgggcacagcggccctgggctgcctggtcaaggactacttccacgtagcgtgcgagcgggctggcaaggcgcatagnn

SEQ ID NO: 164659 - DNA, 248 bp, Homo sapiens
  misc_feature: GYAE6OF01A951D.30.10.A10.1.454.CMB.1.raw
  modified_base (245)..(248): a, c, t, g, unknown or other
  misc_feature (245)..(248): n is a, c, g, or t
tcagcacgctacgtcacgaccggtgctcgatttagcgtcgatctcagggtcttcgtggctcacgtccaccaccacgcatcgtgacctcaggggtccgggagatcatgagggtgtccttgggtttgggggaagaggaagactgacggtccccccaggagttcaggtgctgggcacagcggccctgggctgcctggtcaaggactacttccacgtagcgtgctgagcgggctggcaaggcgcatagnnnn

SEQ ID NO: 164660 - DNA, 210 bp, Homo sapiens
  misc_feature: GYAE6OF01ALE3P.30.10.A10.1.454.CMB.1.raw
  modified_base (202)..(210): a, c, t, g, unknown or other
  misc_feature (202)..(210): n is a, c, g, or t
tcagcacgctacgtcacgaccggtgctcgatttagcgtcgatctcaggggtccgggagatcatgagggtgtccttgggtttgggggaagaggaagactgacggtccccccaggagttcaggtgctgggcacagcggccctgggctgcctggtcaaggactacttccacgtagcgtgctgagcgggctggcaaggcgcatagnnnnnnnnn

SEQ ID NO: 164661 - DNA, 210 bp, Homo sapiens
  misc_feature: GYAE6OF01BB8BL.30.10.A10.1.454.CMB.1.raw
  modified_base (204)..(210): a, c, t, g, unknown or other
  misc_feature (204)..(210): n is a, c, g, or t
tcagcacgctacgtcacgaccggtgctcgatttagcgtcgatctcaggggtccgggagatcatgagggtgtccttgggttttggggggaagaggaagactgacggtccccccaggagttcaggtgctgggcacagcggccctgggctgcctggtcaaggactacttccacgtagcgtgctgagcgggctggcaaggcgcatagnnnnnnn

SEQ ID NO: 164662 - DNA, 223 bp, Homo sapiens
  misc_feature: GYAE6OF01BI5XP.30.10.A10.1.454.CMB.1.raw
  modified_base (204)..(223): a, c, t, g, unknown or other
  misc_feature (204)..(223): n is a, c, g, or t
tcagcacgctacgtcacgaccggtgctcgatttagcgtcgatctcaggggtccgggagatcatgagggtgtccttgggttttgggggaagaggaagactgaccggtccccccaggagttcaggtgctgggcacagcggccctgggctgcctggtcaaggactacttccacgtagcgtgctgagcgggctggcaaggcgcatagnnnnnnnnnnnnnnnnnnnn

SEQ ID NO: 164663 - DNA, 248 bp, Homo sapiens
  misc_feature: GYAE6OF01EKBSJ.30.10.A10.1.454.CMB.1.raw
  modified_base (211)..(248): a, c, t, g, unknown or other
  misc_feature (211)..(248): n is a, c, g, or t
tcagcacgctacgtcacgaccggtgctcgattttagcgtcgatctcagggggtccgggagatcatgacgggtgtccttgggttttggggggaagaggaacgactgaccggtccccccaggtagttcaggtgctgggcacagccggccctgggctgcctggtcaaggactacttccacgtagcgtgctgagcgggctggcaaggcgcatagnnnnnnnnnnnnnnnnnnnnnnnnnnnnnnnnnnnnnn

SEQ ID NO: 164664 - DNA, 324 bp, Homo sapiens
  misc_feature: GYAE6OF01BVHEK.30.10.A10.1.454.CMB.1.raw
  modified_base (268)..(278): a, c, t, g, unknown or other
  misc_feature (268)..(278): n is a, c, g, or t
  modified_base (280)..(324): a, c, t, g, unknown or other
  misc_feature (280)..(324): n is a, c, g, or t
tcagcacgctacgtcacgaccggtgctcgattttagcgtcgatctctaggggttcgttcgttggcgtcaccgtccaccaccacgcatgtgacctcaggggtccgggagatcatcgagggtgtccttgggttttggggggaagaggaagacctcgacggtccccccagggagttcaggtgctgggcacagcggccctgggctgcctggtacaaggactactccagtagcgttagctgagacgggctggccaaagggccgaccaatacgnnnnnnnnnnngnnnnnnnnnnnnnnnnnnnnnnnnnnnnnnnnnnnnnnnnnnnnn

SEQ ID NO: 164665 - DNA, 227 bp, Homo sapiens
  misc_feature: GYAE6OF01BKH8G.30.10.A10.1.454.CMB.1.raw
  modified_base (206)..(227): a, c, t, g, unknown or other
  misc_feature (206)..(227): n is a, c, g, or t
tcagcacgctacgtcacgaccggtgctcgatttagcgtcgatctcagggggtccgggagatcatgagggtgtccttgggttttggggggaagaggaagactgaccggtccccccaggagttcaggtgctgggcacagcggccctgggctgcctggtcaaggactacttccacgtagcgtgctgagcgggctggcaaggcgcatagnnnnnnnnnnnnnnnnnnnnnn

SEQ ID NO: 164666 - DNA, 213 bp, Homo sapiens
  misc_feature: GYAE6OF01CMP8R.30.10.A10.1.454.CMB.1.raw
  modified_base (203)..(213): a, c, t, g, unknown or other
  misc_feature (203)..(213): n is a, c, g, or t
tcagcacgctacgtcacgaccggtgctcgatttagcgtcgatctcaggggtccgggagatcatgagggtgtccttgggttttgggggaagaggaagactgacggtccccccaggagttcaggtgctgggcacagcggccctgggctgcctggtcaaggactacttccacgtagcgtgctgagcgggctggcaaggcgcatagnnnnnnnnnnn

SEQ ID NO: 164667 - DNA, 252 bp, Homo sapiens
  misc_feature: GYAE6OF01DSUCD.30.10.A10.1.454.CMB.1.raw
  modified_base (243)..(252): a, c, t, g, unknown or other
  misc_feature (243)..(252): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttgggggaagaggaagactgacggtcccccaggagttcaggtgctgggcacagcggccctggctgcctggtcaaggactacttccacgtagcgtgctgagcgggctggcaaggcgcatagnnnnnnnnnn

SEQ ID NO: 164668 - DNA, 204 bp, Homo sapiens; identical to SEQ ID NO: 164470
  misc_feature: GYAE6OF01D1Y6Z.30.10.A10.1.454.CMB.1.raw
  modified_base (203)..(204): a, c, t, g, unknown or other
  misc_feature (203)..(204): n is a, c, g, or t

SEQ ID NO: 164669 - DNA, 280 bp, Homo sapiens
  misc_feature: GYAE6OF01E2B36.30.10.A10.1.454.CMB.1.raw
  modified_base (133)..(133): a, c, t, g, unknown or other
  misc_feature (133)..(133): n is a, c, g, or t
  modified_base (240)..(240): a, c, t, g, unknown or other
  misc_feature (240)..(240): n is a, c, g, or t
  modified_base (246)..(280): a, c, t, g, unknown or other
  misc_feature (246)..(280): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttggggggaanaggaagactgacggtccccccaggagttcaggtgctgggcacagcggccctgggctgcctggtcaaggactacttccacgtagcgtgctgagcgggctggcaaggcncatagnnnnnnnnnnnnnnnnnnnnnnnnnnnnnnnnnnn

SEQ ID NO: 164670 - DNA, 216 bp, Homo sapiens
  misc_feature: GYAE6OF01D93FC.30.10.A10.1.454.CMB.1.raw
  modified_base (206)..(216): a, c, t, g, unknown or other
  misc_feature (206)..(216): n is a, c, g, or t
tcagcacgctacgtcacgaccggtgctcgatttagcgtcgatctcaggggtccgggagatcatgagggtgtccgttgggttttggggggaagaggaagactgaccggtcccccaggagttcaggtgctgggcacagcggccctgggctgccgtggtcaaggactacttccacgtagcgtgctgagcgggctggcaaggcgcatagnnnnnnnnnnn

SEQ ID NO: 164671 - DNA, 212 bp, Homo sapiens
  misc_feature: GYAE6OF01ANI7F.30.10.A10.1.454.CMB.1.raw
  modified_base (204)..(212): a, c, t, g, unknown or other
  misc_feature (204)..(212): n is a, c, g, or t
tcagcacgctacgtcacgaccggtgctcgatttagcgtcgatctcaggggtccgggagatcatgagggtgtccttgggttttggggggaagaggaagactgacggtccccccaggagttcaggtgctgggcacagcggccctgggctgcctggtcaaggactacttccacgtagcgtgctgagcgggctggcaaggcgcatagnnnnnnnnn

SEQ ID NO: 164672 - DNA, 249 bp, Homo sapiens
  misc_feature: GYAE6OF01D5RRQ.30.10.A10.1.454.CMB.1.raw
  modified_base (245)..(249): a, c, t, g, unknown or other
  misc_feature (245)..(249): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttggggggaagaggaagactgacggtccccccaggagttcaggtgctgggcacagcggccctgggctgcctggtcaaggactacttccacgtagcgtgctgagcggctggcaaggcgcatagnnnnn

SEQ ID NO: 164673 - DNA, 294 bp, Homo sapiens
  misc_feature: GYAE6OF01CMB5X.30.10.A10.1.454.CMB.1.raw
  modified_base (277)..(294): a, c, t, g, unknown or other
  misc_feature (277)..(294): n is a, c, g, or t
tcagcacgctacgtcacgaccggtgctcgatttagcgtcgatctcagggtcttcgtggctcacgtccaccaccacgcatgtgacctcaggggtccgggagatcagtgagggtgtccttggggtttggggggaagaggaagacgtcgaccggtccccccgaggagttcaggtgcgtgggcacgaggccggcccgtgggctcgccgtaggtacgaacggtacttacttccacggtagcggtcgcgtggacggcgggtcgtggacgaaggcgtcaagtgnnnnnnnnnnnnnnnnnn

SEQ ID NO: 164674 - DNA, 213 bp, Homo sapiens
  misc_feature: GYAE6OF01BAZHU.30.10.A10.1.454.CMB.1.raw
  modified_base (196)..(196): a, c, t, g, unknown or other
  misc_feature (196)..(196): n is a, c, g, or t
  modified_base (200)..(200): a, c, t, g, unknown or other
  misc_feature (200)..(200): n is a, c, g, or t
  modified_base (203)..(213): a, c, t, g, unknown or other
  misc_feature (203)..(213): n is a, c, g, or t
tcagcacgctacgtcacgaccggtgctcgatttagcgtcgatctcaggggtccgggagatcatgaggtgtccttgggttttgggggaagaggaagactgaccggtcccccaggagttcaggtgctgggcacagcggccctgggctgcctgtacaaggactacttccacgtagcgtagctgagcggctggcaaggcnctanagnnnnnnnnnnn

SEQ ID NO: 164675 - DNA, 212 bp, Homo sapiens
  misc_feature: GYAE6OF01DM8SK.30.10.A10.1.454.CMB.1.raw
  modified_base (205)..(212): a, c, t, g, unknown or other
  misc_feature (205)..(212): n is a, c, g, or t
tcagcacgctacgtcacgaccggtgctcgatttagcgtcgatctcaggggtccgggagatcatgagggtgtccttgggttttggggggaagaggaagactgacggtccccccaggagttcaggtgcgtgggcacagcggccctgggctgcctggtcaaggactacttccacgtagcgtgctgagcgggctggcaaggcgcatagnnnnnnnn

SEQ ID NO: 164676 - DNA, 320 bp, Homo sapiens
  misc_feature: GYAE6OF01CR4JH.30.10.A10.1.454.CMB.1.raw
  modified_base (288)..(320): a, c, t, g, unknown or other
  misc_feature (288)..(320): n is a, c, g, or t
tcagcacgctacgtcacgaccggtgctcgatttagcgtcgatctcagggtcttcgtggctcacgtccaccaccacgcatgtgacctcaggggtccgggagatcatggagggtgtccgtttgggggttttgggggggaagaggaagacgtggaccggtcccccccaggagttcgaggtgccgtgggccacaggccggcccgtgggctgcccgtggtacgaaaggacttaccttccgacgttagccgtgccgtgacggccgggcgtacggcgaaacgggccgacaatggnnnnnnnnnnnnnnnnnnnnnnnnnnnnnnnnn

SEQ ID NO: 164677 - DNA, 254 bp, Homo sapiens
  misc_feature: GYAE6OF01DQ1M6.30.10.A10.1.454.CMB.1.raw
  modified_base (243)..(254): a, c, t, g, unknown or other
  misc_feature (243)..(254): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttggggttttggggggaagaggaagactgacggtccccccaggagttcaggtgctgggcacagcggcctggctgcctggtcaaggctactccacgtagcgtgctggagcgggctggcaaggcacatannnnnnnnnnnn

SEQ ID NO: 164678 - DNA, 284 bp, Homo sapiens
  misc_feature: GYAE6OF01CXHIA.30.10.A10.1.454.CMB.1.raw
  modified_base (241)..(241): a, c, t, g, unknown or other
  misc_feature (241)..(241): n is a, c, g, or t
  modified_base (260)..(260): a, c, t, g, unknown or other
  misc_feature (260)..(260): n is a, c, g, or t
  modified_base (268)..(284): a, c, t, g, unknown or other
  misc_feature (268)..(284): n is a, c, g, or t
tcagcacgctacgtcacgaccggtgctcgatttagcgtcgatctcagggtcttcgtggctcacgtccaccaccacgcatgtgacctcaggggtccgggagatcatgaggtgtccgttggggttttggggggaagaggaagacgtcgaccggtccccccaggtagttcaggtgctgggacacgagccggccgtgggctcgtccgtggtcaaaggtactaccttccgacgttagcgtgctagnggcggcgtggcgaagggcncgagtagnnnnnnnnnnnnnnnnn

SEQ ID NO: 164679 - DNA, 270 bp, Homo sapiens
  misc_feature: GYAE6OF01CCC5K.30.10.A10.1.454.CMB.1.raw
  modified_base (262)..(270): a, c, t, g, unknown or other
  misc_feature (262)..(270): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccgttggggttttggggggaagaggaagactgacggtccccccaggagttcagggtgcgtgggcacagccggcccgtgggctgccgtggtcaaggacttacttccacgtaggcgtgctgaggcgggcgtggccgaagggcgacagtagnnnnnnnnn

SEQ ID NO: 164680 - DNA, 206 bp, Homo sapiens
  misc_feature: GYAE6OF01D79XC.30.10.A10.1.454.CMB.1.raw
  modified_base (204)..(206): a, c, t, g, unknown or other
  misc_feature (204)..(206): n is a, c, g, or t
tcagcacgctacgtcacgaccggtgctcgatttagcgtcgatctcaggggtccgggagatcatgagggtgtccttgggttttggggggaagaggaagactgacggtccccccaggagttcaggtgctgggcacagcggccctgggctgcctggtcaaggactacttccacgtagcgtgctgagcgggctggcaaggcgcatagnnn

SEQ ID NO: 164681 - DNA, 236 bp, Homo sapiens
  misc_feature: GYAE6OF01DMAD5.30.10.A10.1.454.CMB.1.raw
  modified_base (210)..(210): a, c, t, g, unknown or other
  misc_feature (210)..(210): n is a, c, g, or t
  modified_base (215)..(236): a, c, t, g, unknown or other
  misc_feature (215)..(236): n is a, c, g, or t
tcagcacgctacgtcacgaccggtgctcgatttagcgtcgatctcaggggtccgggagatcatgaggggtgtccgttggggttttaggggggaagaggaagactggaccggtccccccaggagttcaggtgcgtgggccaccgagccggccctgggctcgcctggtcaaaggcctacttccacgtagcgtgctgagcgggctgcaaggcncatgnnnnnnnnnnnnnnnnnnnnnn

SEQ ID NO: 164682 - DNA, 280 bp, Homo sapiens
  misc_feature: GYAE6OF01D30N1.30.10.A10.1.454.CMB.1.raw
  modified_base (250)..(280): a, c, t, g, unknown or other
  misc_feature (250)..(280): n is a, c, g, or t
tcagcacgctacgtcacgaccggtgctcgatttagcgtcgatctcagggtcttcgtggctcacgtccaccaccacgcatgtgacctcagggggtccgggagatcatgagggtgtccttgggtttggggggaagaggaagactggacggtcccccaggagttcaggtgcgtgggcacgagcggccctgggctgcctggtcaaggctacttccacgtagcgtgctgagcgggctggacaaggcgacagtagnnnnnnnnnnnnnnnnnnnnnnnnnnnnnnn

SEQ ID NO: 164683 - DNA, 217 bp, Homo sapiens
  misc_feature: GYAE6OF01DG4Q1.30.10.A10.1.454.CMB.1.raw
  modified_base (206)..(217): a, c, t, g, unknown or other
  misc_feature (206)..(217): n is a, c, g, or t
tcagcacgctacgtcacgaccggtgctcgatttagcgtcgatctcaggggtccgggagatcatgagggtgtccttgggttttggggggaagaggaagactgacggtccccccaggagttcaggtgcgtgggcacagcggccctgggctgcctggtcaaggtactacttccacgtagcgtgctgagcggctggcaaggcgacatagnnnnnnnnnnnn

SEQ ID NO: 164684 - DNA, 237 bp, Homo sapiens
  misc_feature: GYAE6OF01BVLY3.30.10.A10.1.454.CMB.1.raw
  modified_base (208)..(237): a, c, t, g, unknown or other
  misc_feature (208)..(237): n is a, c, g, or t
tcagcacgctacgtcacgaccggtgctcgatttagcgtcgatctcagggggtccgggagatcatgagggtgtccttggggttttggggggaagaggaagactgaccggtcccccccaggagttcaggtgctgggcacagcggccctgggctgcctggtcaaggctactccacgtagcgtgctgagcggggctggacaaggcgcatagnnnnnnnnnnnnnnnnnnnnnnnnnnnnnn

SEQ ID NO: 164685 - DNA, 250 bp, Homo sapiens
  misc_feature: GYAE6OF01A28UO.30.10.A10.1.454.CMB.1.raw
  modified_base (245)..(250): a, c, t, g, unknown or other
  misc_feature (245)..(250): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggtttgggggaagaggaagactgacggtccccccaggagttcaggtgctgggcacagcggccctgggctgcctggtcaaggactacttccacgtagcgtgctgacgcgggctggcaaggcgcatagnnnnnn

SEQ ID NO: 164686 - DNA, 213 bp, Homo sapiens
  misc_feature: GYAE6OF01DXRQH.30.10.A10.1.454.CMB.1.raw
  modified_base (205)..(213): a, c, t, g, unknown or other
  misc_feature (205)..(213): n is a, c, g, or t
tcagcacgctacgtcacgaccggtgctcgatttagcgtcgatctcaggggtccgggagatcatgagggtgtccttgggttttggggggaagaggaagactgacggtccccccaggagttcaggtgctgggcacagcggccctgggctgcctggtcaaggactacttccacgtagcgtgctggagcgggctggcaaggcgcatagnnnnnnnnn

SEQ ID NO: 164687 - DNA, 254 bp, Homo sapiens
  misc_feature: GYAE6OF01BURFS.30.10.A10.1.454.CMB.1.raw
  modified_base (245)..(254): a, c, t, g, unknown or other
  misc_feature (245)..(254): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttggggtttgggggaagaggaagactgacggtccccccaggagttcaggtgctgggcacagcggcctggctgcctggtcaaggactacttccacgtagcgtgctgagcgggctggcgaaggcgcgatagnnnnnnnnnn

SEQ ID NO: 164688 - DNA, 278 bp, Homo sapiens
  misc_feature: GYAE6OF01CX95T.30.10.A10.1.454.CMB.1.raw
  modified_base (255)..(278): a, c, t, g, unknown or other
  misc_feature (255)..(278): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccgttggggttttgggggaagaggagactgaccggtccccccaggagttcaggtgcgtgggcacaggccggcccgtggctgcgtgtcaaggtactacttccgacgtagcgtgcgtgagcgggcgtggcgaaggcgcagtagnnnnnnnnnnnnnnnnnnnnnnnn

SEQ ID NO: 164689 - DNA, 210 bp, Homo sapiens; identical to SEQ ID NO: 164504
  misc_feature: GYAE6OF01ERFTI.30.10.A10.1.454.CMB.1.raw
  modified_base (203)..(210): a, c, t, g, unknown or other
  misc_feature (203)..(210): n is a, c, g, or t

SEQ ID NO: 164690 - DNA, 238 bp, Homo sapiens
  misc_feature: GYAE6OF01AUGG5.30.10.A10.1.454.CMB.1.raw
  modified_base (213)..(238): a, c, t, g, unknown or other
  misc_feature (213)..(238): n is a, c, g, or t
tcagcacgctacgtcacgaccggtgctcgatttagcgtcgatctcaggggtccgggagatcatgagggtgtccttggggttttggggggaagaggaagactgaccggtccccccaggagttcaggtgctgggcacagcggccctgggctgccgtggtacaaggtactacttccacgtagcgtgcgtagaggcggcgtggacgaggcgcatagnnnnnnnnnnnnnnnnnnnnnnnnnn

SEQ ID NO: 164691 - DNA, 257 bp, Homo sapiens
  misc_feature: GYAE6OF01EY5FN.30.10.A10.1.454.CMB.1.raw
  modified_base (220)..(257): a, c, t, g, unknown or other
  misc_feature (220)..(257): n is a, c, g, or t
tcagcacgctacgtcacgaccggtgctcgatttagcgtcgatctcaggggtccgggagatcatgagggtgtccttgggttttggggggaagaggaagactgaccggtccccccgaggagttcaggtgcgtgggcacgaggccggcccgtgggctgccgtggtacaaggacttactccacgtagcgtgcgtgaggcgggcgtcggacgaaggcgacaatgnnnnnnnnnnnnnnnnnnnnnnnnnnnnnnnnnnnnnn

SEQ ID NO: 164692 - DNA, 338 bp, Homo sapiens
  misc_feature: GYAE6OF01AE09T.30.10.A10.1.454.CMB.1.raw
  modified_base (191)..(191): a, c, t, g, unknown or other
  misc_feature (191)..(191): n is a, c, g, or t
  modified_base (281)..(338): a, c, t, g, unknown or other
  misc_feature (281)..(338): n is a, c, g, or t
tcagcacgctacgtcacgaccggtgctcgatttagcgtcgatctcagggtcttcgtggctcacgtccaccaccacgcatgtgacctcgaggggtcgggagatcatggagggtgttcctttggggtttttagggggggaagagggaagacgtggaccgtccccccgaggtagttccgaggtgcgtggcacgngtcggcccgtggctgccgtggtaccaaggtccgtacttccacggtgcgtgtactggacgcgggctagggccgtaaaggcgactagacgtnnnnnnnnnnnnnnnnnnnnnnnnnnnnnnnnnnnnnnnnnnnnnnnnnnnnnnnnnn

SEQ ID NO: 164693 - DNA, 217 bp, Homo sapiens
  misc_feature: GYAE6OF01BDK2W.30.10.A10.1.454.CMB.1.raw
  modified_base (208)..(217): a, c, t, g, unknown or other
  misc_feature (208)..(217): n is a, c, g, or t
tcagcacgctacgtcacgaccggtgctcgatttagcgtcgatctcaggggtccgggagatcatgagggtgtccttgggttttgggggaagaggaagactgaccggtccccccaggagttcaggtgctgggcacagcggccctgggctgcctggtcaaggactacttccacgtagcgtgctgggggagcgggctggcaaggcgcatagnnnnnnnnnn

SEQ ID NO: 164694 - DNA, 214 bp, Homo sapiens
  misc_feature: GYAE6OF01EKUXV.30.10.A10.1.454.CMB.1.raw
  modified_base (199)..(199): a, c, t, g, unknown or other
  misc_feature (199)..(199): n is a, c, g, or t
  modified_base (204)..(214): a, c, t, g, unknown or other
  misc_feature (204)..(214): n is a, c, g, or t
tcagcacgctacgtcacgaccggtgctcgatttagcgtcgatctcaggggtccgggagatcatgagggtgtccttgggttttggggggaagaggaagactgacggtccccccaggagttcaggtgctgggcacagcggccctgggctgcctggtcaaggactacttccacgtagcgtgctgagcgggctggcaaggcgnatagnnnnnnnnnnn

SEQ ID NO: 164695 - DNA, 249 bp, Homo sapiens
  misc_feature: GYAE6OF01B8EYX.30.10.A10.1.454.CMB.1.raw
  modified_base (112)..(112): a, c, t, g, unknown or other
  misc_feature (112)..(112): n is a, c, g, or t
  modified_base (227)..(227): a, c, t, g, unknown or other
  misc_feature (227)..(227): n is a, c, g, or t
  modified_base (237)..(237): a, c, t, g, unknown or other
  misc_feature (237)..(237): n is a, c, g, or t
  modified_base (242)..(249): a, c, t, g, unknown or other
  misc_feature (242)..(249): n is a, c, g, or t
tcagcacgctacgtcacgaccggtgctcgatttagcgtcgatctcaggggtcttcgtggctcacgtccaccaccacgcatgtgacctcaggggtccggagatcatgagggtntccttggggtttgggggaagaggaagactgaccggtccccccaggagttcaggtgctgggcacagccggcctgggctgccgtggtcaaggactactccagtgcgtgctgagcggntggcaggcgnatagnnnnnnnn

SEQ ID NO: 164696 - DNA, 224 bp, Homo sapiens
  misc_feature: GYAE6OF01B4HDL.30.10.A10.1.454.CMB.1.raw
  modified_base (216)..(224): a, c, t, g, unknown or other
  misc_feature (216)..(224): n is a, c, g, or t
tcagcacgctacgtcacgaccggtgctcgatttagcgtcgatctcaggggtccgggagatcatgagggtgtccgttgggtttggggggaagaggaagactgaccggtcccccaggagttcaggtgcgtgggcacgaggccggcccgtgggctcgccgtggtacaaggactaccttccgacgtagcgtgctgagcgggctgggcgaaggcgcatagnnnnnnnnn

SEQ ID NO: 164697 - DNA, 208 bp, Homo sapiens
  misc_feature: GYAE6OF01EY6KT.30.10.A10.1.454.CMB.1.raw
  modified_base (203)..(208): a, c, t, g, unknown or other
  misc_feature (203)..(208): n is a, c, g, or t
tcagcacgctacgtcacgaccggtgctcgatttagcgtcgatctcaggggtccgggagatcatgagggtgtccttgggttttggggggaagaggaagactgacggtccccccaggagttcaggtgctgggcacagcggccctgggctgcctggtcaaggactacttccacgtagcgtgctgagcggctggcaaggcgcatagnnnnnn

SEQ ID NO: 164698 - DNA, 265 bp, Homo sapiens
  misc_feature: GYAE6OF01AY4G7.30.10.A10.1.454.CMB.1.raw
  modified_base (248)..(265): a, c, t, g, unknown or other
  misc_feature (248)..(265): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttggggttttggggggaagaggaagactgacggtccccccaggagttcaggtgctgggcacagcggccctgggctgcctggtcaaggactacttccacgtagcgtgctgagcgggctgggcaaggcgcatagnnnnnnnnnnnnnnnnnn

SEQ ID NO: 164699 - DNA, 217 bp, Homo sapiens
  misc_feature: GYAE6OF01C866L.30.10.A10.1.454.CMB.1.raw
  modified_base (209)..(217): a, c, t, g, unknown or other
  misc_feature (209)..(217): n is a, c, g, or t
tcagcacgctacgtcacgaccggtgctcgatttagcgtcgatctcaggggtccgggagatcatgagggtgtccttgggtttggggggaagaggaagactgacggtccccccaggagttcaggtgcgtgggcacagcggccctgggctgcctggtcaaggactacttccacgtagcgtgctaggaggtcgggctggcgaaggcgcatagnnnnnnnnn

SEQ ID NO: 164700 - DNA, 284 bp, Homo sapiens
  misc_feature: GYAE6OF01AH5Q7.30.10.A10.1.454.CMB.1.raw
  modified_base (252)..(284): a, c, t, g, unknown or other
  misc_feature (252)..(284): n is a, c, g, or t
tcagcacgctacgtcacgaccggtgctcgatttagcgtcgatctcagggtcttcgtggctcacgtccaccaccacgcatgtgacctccaggggtccgggagatcatgagggtgtccttgggtttgggggagaggagactgaccggtcccccaggagttcaggtgctgggcacagcggccgtgggctgctggtcaaggactacttccacgtacgcgtgcgtgacggcgggcgtgggacgaaggcgacgaatgnnnnnnnnnnnnnnnnnnnnnnnnnnnnnnnnn

SEQ ID NO: 164701 - DNA, 257 bp, Homo sapiens
  misc_feature: GYAE6OF01A02OV.30.10.A10.1.454.CMB.1.raw
  modified_base (219)..(219): a, c, t, g, unknown or other
  misc_feature (219)..(219): n is a, c, g, or t
  modified_base (230)..(230): a, c, t, g, unknown or other
  misc_feature (230)..(230): n is a, c, g, or t
  modified_base (238)..(238): a, c, t, g, unknown or other
  misc_feature (238)..(238): n is a, c, g, or t
  modified_base (241)..(241): a, c, t, g, unknown or other
  misc_feature (241)..(241): n is a, c, g, or t
  modified_base (244)..(257): a, c, t, g, unknown or other
  misc_feature (244)..(257): n is a, c, g, or t
tcagcacgctacgtcacgaccggtgctcgatttagcgtcgatctcagggtcttcgtggctcacgtccaccaccacgcatgtgacctcaggggtccgggagatcatgaggtcgtctttgggtttgggggaagaggaagactcgacggtccccccaggtagttcgaggtgctgggcacagtcgccgtggctgcctggtcaaggactactccacgtagcgtnctgagcggtcnggcaggcncanagnnnnnnnnnnnnnn

SEQ ID NO: 164702 - DNA, 245 bp, Homo sapiens
  misc_feature: GYAE6OF01AX9X9.30.10.A10.1.454.CMB.1.raw
  modified_base (212)..(245): a, c, t, g, unknown or other
  misc_feature (212)..(245): n is a, c, g, or t
tcagcacgctacgtcacgaccggtgctcgatttagcgtcgatctcaggggtccgggagatcatgagggtgtccgttgggttttggggggaagaggaagactgaccggtccccccaggagttcaggtgctgggcacagccggccctgggctgcctggtcaaggactacttccacgtgcgtgctgacgcgggctcggcaacggcgctaagtagnnnnnnnnnnnnnnnnnnnnnnnnnnnnnnnnnn

SEQ ID NO: 164703 - DNA, 281 bp, Homo sapiens
  misc_feature: GYAE6OF01A9E1A.30.10.A10.1.454.CMB.1.raw
  modified_base (189)..(189): a, c, t, g, unknown or other
  misc_feature (189)..(189): n is a, c, g, or t
  modified_base (242)..(242): a, c, t, g, unknown or other
  misc_feature (242)..(242): n is a, c, g, or t
  modified_base (254)..(254): a, c, t, g, unknown or other
  misc_feature (254)..(254): n is a, c, g, or t
  modified_base (260)..(281): a, c, t, g, unknown or other
  misc_feature (260)..(281): n is a, c, g, or t
tcagcacgctacgtcacgaccggtgctcgatttagcgtcgatctcagggtcttcgtggctcacgtccaccaccacgcatgtgacctcgaggggtccggagatcatgagggttgttccgtttgggggttttaggggggaagaggaagacgtcggaccggtcccccaggagttcgaggtcgcgtggcacgngcggccgtggctcgcgtgacgagactactccgacgtcgcgtgctggaggcggngtggacgaggcncgatgnnnnnnnnnnnnnnnnnnnnnn

SEQ ID NO: 164704 - DNA, 337 bp, Homo sapiens
  misc_feature: GYAE6OF01BY14C.30.10.A10.1.454.CMB.1.raw
  modified_base (298)..(337): a, c, t, g, unknown or other
  misc_feature (298)..(337): n is a, c, g, or t
tcagcacgctacgtcacgaccggtgctcgatttagcgtcgatctcagggtcttcgtggctcacgtccaccaccacgcatgtgacctcgagggggtccgggagatcagtggtagggtcgttccgttttgggggttttgggggggaagaagggaagacgtcggacccggtccccccgaggtagttcgaggtgccgtgggcacgacggccggcccgtggctcgccgtaggacgaacgtaccttaccgtccgacgtgcgtcgcgtggcggtccggtcgtacgacggaacggcacgagtacgnnnnnnnnnnnnnnnnnnnnnnnnnnnnnnnnnnnnnnnn

SEQ ID NO: 164705 - DNA, 243 bp, Homo sapiens
  misc_feature: GYAE6OF02F4UUY.30.10.A10.1.454.CMB.1.raw
  modified_base (241)..(243): a, c, t, g, unknown or other
  misc_feature (241)..(243): n is a, c, g, or t
tcagcacgctacgtcacgaccggtgctcgatttagcgtcgatctcagggtcttcgtggctcacgtccaccaccacgcatgtgacctcagggtccgggagatcatgagggtgtccttgggtttggggaagaggaagactgacggtcccccaggagttcaggtgctgggcacagcggccctgggctgcctggtcaaggactacttccacgtagcgtgctgagcgggctggcaaggcgcatagnnn

SEQ ID NO: 164706 - DNA, 200 bp, Homo sapiens
  misc_feature: GYAE6OF02GWCF2.30.10.A10.1.454.CMB.1.raw
  modified_base (198)..(200): a, c, t, g, unknown or other
  misc_feature (198)..(200): n is a, c, g, or t
tcagcacgctacgtcacgaccggtgctcgatttagcgtcgatctcagggtccgggagatcatgagggtgtccttgggtttggggaagaggaagactgacggtccccaggagttcaggtgctgggcacagcggccctgggctgcctggtcaaggactacttccacgtagcgtgctgagcgggctggcaaggcgcatagnnn

SEQ ID NO: 164707 - DNA, 200 bp, Homo sapiens; identical to SEQ ID NO: 164339
  misc_feature: GYAE6OF02F61RY.30.10.A10.1.454.CMB.1.raw
  modified_base (199)..(200): a, c, t, g, unknown or other
  misc_feature (199)..(200): n is a, c, g, or t

SEQ ID NO: 164708 - DNA, 204 bp, Homo sapiens
  misc_feature: GYAE6OF02IAJJE.30.10.A10.1.454.CMB.1.raw
  modified_base (198)..(204): a, c, t, g, unknown or other
  misc_feature (198)..(204): n is a, c, g, or t
tcagcacgctacgtcacgaccggtgctcgatttagcgtcgatctcagggtccgggagatcatgagggtgtccttgggtttggggaagaggaagactgacggtccccaggagttcaggtgctgggcacagcggccctgggctgcctggtcaaggactacttccacgtagcgtgctgagcgggctggcaaggcgcatagnnnnnnn

SEQ ID NO: 164709 - DNA, 201 bp, Homo sapiens
  misc_feature: GYAE6OF02HWKDU.30.10.A10.1.454.CMB.1.raw
  modified_base (199)..(201): a, c, t, g, unknown or other
  misc_feature (199)..(201): n is a, c, g, or t
tcagcacgctacgtcacgaccggtgctcgatttagcgtcgatctcagggtccgggagatcatgagggtgtccttgggttttggggaagaggaagactgacggtcccccaggagttcaggtgctgggcacagcggcctgggctgcctggtcaaggactacttccacgtagcgtgctgagcgggctggcaaggcgcatagnnn

SEQ ID NO: 164710 - DNA, 196 bp, Homo sapiens
  misc_feature: GYAE6OF02F7FJO.30.10.A10.1.454.CMB.1.raw
  modified_base (196)..(196): a, c, t, g, unknown or other
  misc_feature (196)..(196): n is a, c, g, or t
tcagcacgctacgtcacgaccggtgctcgatttagcgtcgatctcagggtccggagatcatgaggtgtccttgggtttggggaagaggaagactgacggtccccaggagttcaggtgctgggcacagcggccctgggctgcctggtcaaggactacttccacgtagcgtgctgagcgggctggcaaggcgcatagn

SEQ ID NO: 164711 - DNA, 243 bp, Homo sapiens
  misc_feature: GYAE6OF02HQH5I.30.10.A10.1.454.CMB.1.raw
  modified_base (239)..(243): a, c, t, g, unknown or other
  misc_feature (239)..(243): n is a, c, g, or t
tcagcacgctacgtcacgaccggtgctcgatttagcgtcgatctcagggtcttcgtggctcacgtccaccaccacgcatgtgacctcagggtccgggagatcatgaggtgtccttgggtttggggaagaggaagactgacggtccccaggagttcaggtgctgggcacagcggccctgggctgcctggtcaaggactacttccacgtagcgtgctgagcgggctggcaaggcgcatagnnnnn

SEQ ID NO: 164712 - DNA, 200 bp, Homo sapiens; identical to SEQ ID NO: 164706
  misc_feature: GYAE6OF02GMG7Y.30.10.A10.1.454.CMB.1.raw
  modified_base (198)..(200): a, c, t, g, unknown or other
  misc_feature (198)..(200): n is a, c, g, or t

SEQ ID NO: 164713 - DNA, 199 bp, Homo sapiens
  misc_feature: GYAE6OF02IVP93.30.10.A10.1.454.CMB.1.raw
  modified_base (199)..(199): a, c, t, g, unknown or other
  misc_feature (199)..(199): n is a, c, g, or t
tcagcacgctacgtcacgaccggtgctcgatttagcgtcgatctcagggtccgggagatcatgagggtgttccttgggtttggggaagaggaagactgacggtccccaggagttcaggtgctgggcacagcggccctgggctgcctggtcaaggactacttccacgtagcgtgctgagcgggctggcaaggcgcatagn

SEQ ID NO: 164714 - DNA, 244 bp, Homo sapiens
  misc_feature: GYAE6OF02H09VO.30.10.A10.1.454.CMB.1.raw
  modified_base (241)..(244): a, c, t, g, unknown or other
  misc_feature (241)..(244): n is a, c, g, or t
tcagcacgctacgtcacgaccggtgctcgatttagcgtcgatctcagggtcttcgtggctcacgtccaccaccacgcatgtgacctcagggtccgggagatcatgagggtgtccttgggtttggggaagaggaagactgacggtcccccaggagttcaggtgctgggcacagcggccctgggctgcctggtcaaggactacttccacgtagcgtgctgagcgggctggcaaggcgcatagnnnn

SEQ ID NO: 164715 - DNA, 198 bp, Homo sapiens
  misc_feature: GYAE6OF02I3Y7Z.30.10.A10.1.454.CMB.1.raw
  modified_base (197)..(198): a, c, t, g, unknown or other
  misc_feature (197)..(198): n is a, c, g, or t
tcagcacgctacgtcacgaccggtgctcgatttagcgtcgatctcagggtccggagatcatgagggtgtccttgggtttggggaagaggaagactgacggtccccaggagttcaggtgctgggcacagcggccctgggctgcctggtcaaggactacttccacgtagcgtgctgagcgggctggcaaggcgcatagnn

SEQ ID NO: 164716 - DNA, 252 bp, Homo sapiens
  misc_feature: GYAE6OF02FSSZP.30.10.A10.1.454.CMB.1.raw
  modified_base (201)..(252): a, c, t, g, unknown or other
  misc_feature (201)..(252): n is a, c, g, or t
tcagcacgctacgtcacgaccggtgctcgatttagcgtcgatctcagggtccgggagatcatgagggtggtccttgggtttggggaagaggtaagactgacggtcccccaggagttcaggtgctggcacagcggccctgggctgcctggtcaaggactacttccacgtagcgtgctgagcgggactggcaaggcgcatagnnnnnnnnnnnnnnnnnnnnnnnnnnnnnnnnnnnnnnnnnnnnnnnnnnnn

SEQ ID NO: 164717 - DNA, 204 bp, Homo sapiens; identical to SEQ ID NO: 164365
  misc_feature: GYAE6OF02GM2V5.30.10.A10.1.454.CMB.1.raw
  modified_base (201)..(204): a, c, t, g, unknown or other
  misc_feature (201)..(204): n is a, c, g, or t

SEQ ID NO: 164718 - DNA, 201 bp, Homo sapiens
  misc_feature: GYAE6OF02G10RL.30.10.A10.1.454.CMB.1.raw
  modified_base (198)..(201): a, c, t, g, unknown or other
  misc_feature (198)..(201): n is a, c, g, or t
tcagcacgctacgtcacgaccggtgctcgatttagcgtcgatctcagggtccgggagatcatgagggtgtccttgggtttggggaagaggaagactgacggtccccaggagttcaggtgctgggcacagcggccctgggctgcctggtcaaggactacttccacgtagcgtgctgagcgggctggcaaggcgcatagnnnn

SEQ ID NO: 164719 - DNA, 201 bp, Homo sapiens; identical to SEQ ID NO: 164718
  misc_feature: GYAE6OF02GS3W9.30.10.A10.1.454.CMB.1.raw
  modified_base (198)..(201): a, c, t, g, unknown or other
  misc_feature (198)..(201): n is a, c, g, or t

SEQ ID NO: 164720 - DNA, 201 bp, Homo sapiens
  misc_feature: GYAE6OF02I7I8Y.30.10.A10.1.454.CMB.1.raw
  modified_base (198)..(201): a, c, t, g, unknown or other
  misc_feature (198)..(201): n is a, c, g, or t
tcagcacgctacgtcacgaccggtgctcgatttagcgtcgatctcagggtccgggagatcatgaggatgtccttgggtttggggaagaggaagactgacggtccccaggagttcaggtgctgggcacagcggccctgggctgcctggtcaaggactacttccacgtagcgtgctgagcgggctggcaaggcgcatagnnnn

SEQ ID NO: 164721 - DNA, 242 bp, Homo sapiens
  misc_feature: GYAE6OF02HQ8YE.30.10.A10.1.454.CMB.1.raw
  modified_base (240)..(242): a, c, t, g, unknown or other
  misc_feature (240)..(242): n is a, c, g, or t
tcagcacgctacgtcacgaccggtgctcgatttagcgtcgatctcagggtcttcgtggctcacgtccaccaccacgcatgtgacctcagggtccgggagatcatgaggtgtccttgggtttggggaagaggaagactgacggtcccccaggagttcaggtgctgggcacagcggccctgggctgcctggtcaaggactacttccacgtagcgtgctgagcgggctggcaaggcgcatagnnn

SEQ ID NO: 164722 - DNA, 246 bp, Homo sapiens
  misc_feature: GYAE6OF02GKMA6.30.10.A10.1.454.CMB.1.raw
  modified_base (241)..(246): a, c, t, g, unknown or other
  misc_feature (241)..(246): n is a, c, g, or t
tcagcacgctacgtcacgaccggtgctcgatttagcgtcgatctcagggtcttcgtggctcacgtccaccaccacgcatgtgacctcagggtccgggagatcatgagggtgtccttgggtttgggggaagaggaagactgacggtcccccaggagttcaggtgctgggcacagcggcctgggctgcctggtcaaggactacttccacgtagcgtgctgagcgggctggcaaggcgcatagnnnnnn

SEQ ID NO: 164723 - DNA, 286 bp, Homo sapiens
  misc_feature: GYAE6OF02FRAYO.30.10.A10.1.454.CMB.1.raw
  modified_base (248)..(250): a, c, t, g, unknown or other
  misc_feature (248)..(250): n is a, c, g, or t
  modified_base (252)..(255): a, c, t, g, unknown or other
  misc_feature (252)..(255): n is a, c, g, or t
  modified_base (257)..(258): a, c, t, g, unknown or other
  misc_feature (257)..(258): n is a, c, g, or t
  modified_base (261)..(286): a, c, t, g, unknown or other
  misc_feature (261)..(286): n is a, c, g, or t
tcagcacgctacgtcacgaccggtgctcgatttagcgtcgatctcgagggtcttcgtggctcacgtccaccaccacgcatgtgacctcaggggtcccgggagatcatgagggtgtccttggggtttgggggaagaggaagactgaccggtcccccaggagttcaggtgctgggcacagcggccctggctgcctggtcaaggactacgttccacgtagcgtgctgagcgggctggcaaggcgcagtagnnntnnnncnnttnnnnnnnnnnnnnnnnnnnnnnnnnn

SEQ ID NO: 164724 - DNA, 246 bp, Homo sapiens
  misc_feature: GYAE6OF02HZDJG.30.10.A10.1.454.CMB.1.raw
  modified_base (244)..(246): a, c, t, g, unknown or other
  misc_feature (244)..(246): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttgggggaagaggaagactgacgatcccccaggagttcaggtgctgggcacagcggccctgggctgcctggtcaaggactacttccacgtagcgtgctgagcgggctggcaaggcgcatagnnn

SEQ ID NO: 164725 - DNA, 206 bp, Homo sapiens
  misc_feature: GYAE6OF02H70XM.30.10.A10.1.454.CMB.1.raw
  modified_base (199)..(206): a, c, t, g, unknown or other
  misc_feature (199)..(206): n is a, c, g, or t
tcagcacgctacgtcacgaccggtgctcgatttagcgtcgatctcaggggtccgggagatcatgagggtgtccttgggtttggggaagaggaagactgacggtccccaggagttcaggtgctgggcacagcggccctgggctgcctggtcaaggactacttccacgtagcgtgctgagcgggctggcaaggcgcatagnnnnnnnn

SEQ ID NO: 164726 - DNA, 202 bp, Homo sapiens; identical to SEQ ID NO: 164363
  misc_feature: GYAE6OF02I85RW.30.10.A10.1.454.CMB.1.raw
  modified_base (201)..(202): a, c, t, g, unknown or other
  misc_feature (201)..(202): n is a, c, g, or t

SEQ ID NO: 164727 - DNA, 245 bp, Homo sapiens
  misc_feature: GYAE6OF02H2ENG.30.10.A10.1.454.CMB.1.raw
  modified_base (242)..(245): a, c, t, g, unknown or other
  misc_feature (242)..(245): n is a, c, g, or t
tcagcacgctacgtcacgaccggtgctcgatttagcgtcgatctcagggtcttcgtggctcacgtccaccaccacgcatgtgacctcagggtccgggagatcatgagggtgtccttgggtttgggggaagaggaagactgacggtcccccaggagttcaggtgctgggcacagcggccctgggctgcctggtcaaggactacttccacgtagcgtgctgagcgggctggcaaggcgcatagnnnn

SEQ ID NO: 164728 - DNA, 205 bp, Homo sapiens
  misc_feature: GYAE6OF02I6704.30.10.A10.1.454.CMB.1.raw
  modified_base (200)..(205): a, c, t, g, unknown or other
  misc_feature (200)..(205): n is a, c, g, or t
tcagcacgctacgtcacgaccggtgctcgatttagcgtcgatctcagggtccgggagatcatgagggtgtccttgggttttgggggaagaggaagactgacggtcccccaggagttcaggtgctgggcacagcggccctgggctgcctggtcaaggactacttccacgtagcgtgctgagcggctggcaaggcgcatagnnnnnn

SEQ ID NO: 164729 - DNA, 203 bp, Homo sapiens; identical to SEQ ID NO: 164334
  misc_feature: GYAE6OF02FF67W.30.10.A10.1.454.CMB.1.raw
  modified_base (201)..(203): a, c, t, g, unknown or other
  misc_feature (201)..(203): n is a, c, g, or t

SEQ ID NO: 164730 - DNA, 245 bp, Homo sapiens; identical to SEQ ID NO: 164463
  misc_feature: GYAE6OF02G20T9.30.10.A10.1.454.CMB.1.raw
  modified_base (243)..(245): a, c, t, g, unknown or other
  misc_feature (243)..(245): n is a, c, g, or t

SEQ ID NO: 164731 - DNA, 247 bp, Homo sapiens; identical to SEQ ID NO: 164369
  misc_feature: GYAE6OF02HVF88.30.10.A10.1.454.CMB.1.raw
  modified_base (243)..(247): a, c, t, g, unknown or other
  misc_feature (243)..(247): n is a, c, g, or t

SEQ ID NO: 164732 - DNA, 246 bp, Homo sapiens; identical to SEQ ID NO: 164347
  misc_feature: GYAE6OF02HUDWB.30.10.A10.1.454.CMB.1.raw
  modified_base (243)..(246): a, c, t, g, unknown or other
  misc_feature (243)..(246): n is a, c, g, or t

SEQ ID NO: 164733 - DNA, 209 bp, Homo sapiens
  misc_feature: GYAE6OF02I1RBT.30.10.A10.1.454.CMB.1.raw
  modified_base (202)..(209): a, c, t, g, unknown or other
  misc_feature (202)..(209): n is a, c, g, or t
tcagcacgctacgtcacgaccggtgctcgatttagcgtcgatctcaggggtccgggagatcatgagggtgtccttgggttttgggggaagaggaagactgacggtcccccaggagttcaggtgctgggcacagcggccctgggctgcctggtcaaggactacttccacgtagcgtgctgagcgggctggcaaggcgcatagnnnnnnnn

SEQ ID NO: 164734 - DNA, 200 bp, Homo sapiens; identical to SEQ ID NO: 164339
  misc_feature: GYAE6OF02IZ4DQ.30.10.A10.1.454.CMB.1.raw
  modified_base (199)..(200): a, c, t, g, unknown or other
  misc_feature (199)..(200): n is a, c, g, or t

SEQ ID NO: 164735 - DNA, 249 bp, Homo sapiens; identical to SEQ ID NO: 164464
  misc_feature: GYAE6OF02FZ6RJ.30.10.A10.1.454.CMB.1.raw
  modified_base (243)..(249): a, c, t, g, unknown or other
  misc_feature (243)..(249): n is a, c, g, or t

SEQ ID NO: 164736 - DNA, 247 bp, Homo sapiens
  misc_feature: GYAE6OF02JMI2T.30.10.A10.1.454.CMB.1.raw
  modified_base (243)..(247): a, c, t, g, unknown or other
  misc_feature (243)..(247): n is a, c, g, or t
tcagcacgctacgtcacgaccggtgctcgatttagcgtcgatctcagggtcttcgtggctcacgtccaccaccacgcatgtgacctcagggtccgggagatcatgagggtgtccttgggttttgggggaagaggaagactgacggtcccccaggagttcaggtgctgggcacagcggccctgggctgcctggtcaaggactacttccacgtagcgtgctgagcgggctggcaaggcgcatagnnnnn

SEQ ID NO: 164737 - DNA, 203 bp, Homo sapiens
  misc_feature: GYAE6OF02GY31C.30.10.A10.1.454.CMB.1.raw
  modified_base (200)..(203): a, c, t, g, unknown or other
  misc_feature (200)..(203): n is a, c, g, or t
tcagcacgctacgtcacgaccggtgctcgatttagcgtcgatctcagggtccgggagatcatgagggtgtccttgggtttgggggaagaggaagactgacggtcccccaggagttcaggtgctgggcacagcggccctgggctgcctggtcaaggactacttccacgtagcgtgctgagcgggctggcaaggcgcatagnnnn

SEQ ID NO: 164738 - DNA, 204 bp, Homo sapiens; identical to SEQ ID NO: 164365
  misc_feature: GYAE6OF02FKMSG.30.10.A10.1.454.CMB.1.raw
  modified_base (201)..(204): a, c, t, g, unknown or other
  misc_feature (201)..(204): n is a, c, g, or t

SEQ ID NO: 164739 - DNA, 204 bp, Homo sapiens; identical to SEQ ID NO: 164365
  misc_feature: GYAE6OF02GA8AB.30.10.A10.1.454.CMB.1.raw
  modified_base (201)..(204): a, c, t, g, unknown or other
  misc_feature (201)..(204): n is a, c, g, or t

SEQ ID NO: 164740 - DNA, 202 bp, Homo sapiens; identical to SEQ ID NO: 164363
  misc_feature: GYAE6OF02G62KS.30.10.A10.1.454.CMB.1.raw
  modified_base (201)..(202): a, c, t, g, unknown or other
  misc_feature (201)..(202): n is a, c, g, or t

SEQ ID NO: 164741 - DNA, 203 bp, Homo sapiens; identical to SEQ ID NO: 164334
  misc_feature: GYAE6OF02GCZPJ.30.10.A10.1.454.CMB.1.raw
  modified_base (201)..(203): a, c, t, g, unknown or other
  misc_feature (201)..(203): n is a, c, g, or t

SEQ ID NO: 164742 - DNA, 225 bp, Homo sapiens
  misc_feature: GYAE6OF02GS8TF.30.10.A10.1.454.CMB.1.raw
  modified_base (204)..(225): a, c, t, g, unknown or other
  misc_feature (204)..(225): n is a, c, g, or t
tcagcacgctacgtcacgaccggtgctcgatttagcgtcgatctcaggggtccgggagaatcactgagggtgtccttgggttttgggggaagaggaagactcgacggtcccccaggagttcaggtgctgggcacagcggcctgggctgcctggtcaaggactacttccacgtagcgtgctgagcgggctggcaaggcgcatagnnnnnnnnnnnnnnnnnnnnnn

SEQ ID NO: 164743 - DNA, 265 bp, Homo sapiens
  misc_feature: GYAE6OF02GD4QD.30.10.A10.1.454.CMB.1.raw
  modified_base (241)..(265): a, c, t, g, unknown or other
  misc_feature (241)..(265): n is a, c, g, or t
tcagcacgctacgtcacgaccggtgctcgatttagcgtcgatctcgagggtcttcgtggctcacgtccaccaccacgcatgtgacctcagggtccggagatcatgagggtgtccttgggtttggggaagaggaagactgacggtcccccaggagttcaggtgctgggcacagcggccctgggctgcctggtcaaggactacttccacgtagcgtgctgagcgggctggcaaggcgcatagnnnnnnnnnnnnnnnnnnnnnnnnn

SEQ ID NO: 164744 - DNA, 204 bp, Homo sapiens; identical to SEQ ID NO: 164365
  misc_feature: GYAE6OF02FSEZE.30.10.A10.1.454.CMB.1.raw
  modified_base (201)..(204): a, c, t, g, unknown or other
  misc_feature (201)..(204): n is a, c, g, or t

SEQ ID NO: 164745 - DNA, 246 bp, Homo sapiens; identical to SEQ ID NO: 164347
  misc_feature: GYAE6OF02GNAL3.30.10.A10.1.454.CMB.1.raw
  modified_base (243)..(246): a, c, t, g, unknown or other
  misc_feature (243)..(246): n is a, c, g, or t

SEQ ID NO: 164746 - DNA, 258 bp, Homo sapiens
  misc_feature: GYAE6OF02GECTK.30.10.A10.1.454.CMB.1.raw
  modified_base (244)..(258): a, c, t, g, unknown or other
  misc_feature (244)..(258): n is a, c, g, or t
tcagcacgctacgtcacgaccggtgctcgatttagcgtcgatctcagggtcgttcgtggctcacgtccaccaccacgcatgtgacctcagggtccgggagatcatgagggtgtccttgggttttgggggaagaggaagactgacggtcccccaggagttcaggtgctgggcacagcggccctgggctgcctggtcaaggactacttccacgtagcgtgctgagcgggctggcaaggcgcatagnnnnnnnnnnnnnnn

SEQ ID NO: 164747 - DNA, 205 bp, Homo sapiens; identical to SEQ ID NO: 164395
  misc_feature: GYAE6OF02G1W01.30.10.A10.1.454.CMB.1.raw
  modified_base (201)..(205): a, c, t, g, unknown or other
  misc_feature (201)..(205): n is a, c, g, or t

SEQ ID NO: 164748 - DNA, 245 bp, Homo sapiens
  misc_feature: GYAE6OF02IG83U.30.10.A10.1.454.CMB.1.raw
  modified_base (242)..(245): a, c, t, g, unknown or other
  misc_feature (242)..(245): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggtttggggaagaggaagactgacggtcccccaggagttcaggtgctgggcacagcggccctgggctgcctggtcaaggactacttccacgtagcgtgctgagcgggctggcaaggcgcatagnnnn

SEQ ID NO: 164749 - DNA, 239 bp, Homo sapiens
  misc_feature: GYAE6OF02JACHN.30.10.A10.1.454.CMB.1.raw
  modified_base (202)..(239): a, c, t, g, unknown or other
  misc_feature (202)..(239): n is a, c, g, or t
tcagcacgctacgtcacgaccggtgctcgatttagcgtcgatctcagggggtccgggagatcatgagggtgtccttgggttttgggggaagaggaagactgacggtcccccaggagttcaggtgctgggcacagcggccctgggctgcctggtcaaggctacttccacgtagcgtgctgagcgggctggcaaggcgcatagnnnnnnnnnnnnnnnnnnnnnnnnnnnnnnnnnnnnnn

SEQ ID NO: 164750 - DNA, 244 bp, Homo sapiens
  misc_feature: GYAE6OF02F2Y4W.30.10.A10.1.454.CMB.1.raw
  modified_base (240)..(244): a, c, t, g, unknown or other
  misc_feature (240)..(244): n is a, c, g, or t
tcagcacgctacgtcacgaccggtgctcgatttagcgtcgatctcagggtcttcgtggctcacgtccaccaccacgcatgtgacctcagggtccgggagatcatgagggtgtccttgggtttggggaagaggaagactgacggtccccaggagttcaggtgctgggcacagcggccctgggctgcctggtcaaggactacttccacgtagcgtgctgagcgggctggcaaggcgcatagnnnnn

SEQ ID NO: 164751 - DNA, 246 bp, Homo sapiens; identical to SEQ ID NO: 164347
  misc_feature: GYAE6OF02GREII.30.10.A10.1.454.CMB.1.raw
  modified_base (243)..(246): a, c, t, g, unknown or other
  misc_feature (243)..(246): n is a, c, g, or t

SEQ ID NO: 164752 - DNA, 243 bp, Homo sapiens
  misc_feature: GYAE6OF02FGVUX.30.10.A10.1.454.CMB.1.raw
  modified_base (242)..(243): a, c, t, g, unknown or other
  misc_feature (242)..(243): n is a, c, g, or t
tcagcacgctacgtcacgaccggtgctcgatttagcgtcgatctcagggtcttcgtggctcacgtccaccaccacgcatgtgacctcagggtccgggagatcatgagggtgtccttgggtttgggggaagaggaagactgacggtcccccaggagttcaggtgctgggcacagcggccctgggctgcctggtcaaggactacttccacgtagcgtgctgagcgggctggcaaggcgcatagnn

SEQ ID NO: 164753 - DNA, 201 bp, Homo sapiens
  misc_feature: GYAE6OF02GBLUU.30.10.A10.1.454.CMB.1.raw
  modified_base (199)..(201): a, c, t, g, unknown or other
  misc_feature (199)..(201): n is a, c, g, or t
tcagcacgctacgtcacgaccggtgctcgatttagcgtcgatctcagggtccggagatcatgagggtgtccttgggttttggggaagaggaagactgacggtcccccaggagttcaggtgctgggcacagcggccctgggctgcctggtcaaggactacttccacgtagcgtgctgagcgggctggcaaggcgcatagnnn

SEQ ID NO: 164754 - DNA, 246 bp, Homo sapiens
  misc_feature: GYAE6OF02HVHPL.30.10.A10.1.454.CMB.1.raw
  modified_base (243)..(246): a, c, t, g, unknown or other
  misc_feature (243)..(246): n is a, c, g, or t
tcagcacgctacgtcacgaccggtgctcgatttagcgtcgatctcagggtcttcgtggctcacgtccaccaccacgcatgtgacctcagggtccgggagatcatgagggtgtccttgggttttgggggaagaggaagactgacggtcccccaggagttcaggtgctgggcacagcggccctgggctgcctggtcaaggactacttccacgtagcgtgctgagcgggctggcaaggcgcatagnnnn

SEQ ID NO: 164755 - DNA, 264 bp, Homo sapiens
  misc_feature: GYAE6OF02I2D6S.30.10.A10.1.454.CMB.1.raw
  modified_base (209)..(212): a, c, t, g, unknown or other
  misc_feature (209)..(212): n is a, c, g, or t
  modified_base (214)..(220): a, c, t, g, unknown or other
  misc_feature (214)..(220): n is a, c, g, or t
  modified_base (222)..(264): a, c, t, g, unknown or other
  misc_feature (222)..(264): n is a, c, g, or t
tcagcacgctacgtcacgaccggtgctcgatttagcgtcgatctcaggggggtccggggagatcatgagggtgtccttggggttttggggggaagaggaagactgacggtccccccaggagttcaggtgcctgggccacagcggccctgggctgcctggtcaaggctacttccacgtagcgtgctgagcgggctggcaaggcgcatagnnnnannnnnnncnnnnnnnnnnnnnnnnnnnnnnnnnnnnnnnnnnnnnnnnnnn

SEQ ID NO: 164756 - DNA, 248 bp, Homo sapiens; identical to SEQ ID NO: 164452
  misc_feature: GYAE6OF02GBZ43.30.10.A10.1.454.CMB.1.raw
  modified_base (244)..(248): a, c, t, g, unknown or other
  misc_feature (244)..(248): n is a, c, g, or t

SEQ ID NO: 164757 - DNA, 205 bp, Homo sapiens
  misc_feature: GYAE6OF02FJA7P.30.10.A10.1.454.CMB.1.raw
  modified_base (202)..(205): a, c, t, g, unknown or other
  misc_feature (202)..(205): n is a, c, g, or t
tcagcacgctacgtcacgaccggtgctcgatttagcgtcgatctcagggtccgggagatcatgagggtgtccttgggttttggggagaagaggaagactgacggtcccccaggagttcaggtgctgggcacagcggccctgggctgcctggtcaaggactacttccacgtagcgtgctgagcgggctggcaaggcgcatagnnnn

SEQ ID NO: 164758 - DNA, 203 bp, Homo sapiens
  misc_feature: GYAE6OF02HVTYQ.30.10.A10.1.454.CMB.1.raw
  modified_base (199)..(203): a, c, t, g, unknown or other
  misc_feature (199)..(203): n is a, c, g, or t
tcagcacgctacgtcacgaccggtgctcgatttagcgtcgatctcagggtccgggagatcatgagggtgtccttgggtttgggggaagaggaagactgacggtcccccaggagttcaggtgctgggcacagcggcctgggctgcctggtcaaggactacttccacgtagcgtgctgagcgggctggcaaggcgcatagnnnnn

SEQ ID NO: 164759 - DNA, 253 bp, Homo sapiens
  misc_feature: GYAE6OF02H3YS0.30.10.A10.1.454.CMB.1.raw
  modified_base (242)..(253): a, c, t, g, unknown or other
  misc_feature (242)..(253): n is a, c, g, or t
tcagcacgctacgtcacgaccggtgctcgatttagcgtcgatctcagggtcttcgtggctcacgtccaccaccacgcatgtgacctcagggtccgggagatcatgagggtgtccttgggtttgggggaagaggaagactgacggtcccccaggagttcaggtgctgggcacagcggccctgggctgcctggtcaaggactacttccacgtagcgtgctgagcgggctggcaaggcgcatagnnnnnnnnnnnn

SEQ ID NO: 164760 - DNA, 244 bp, Homo sapiens
  misc_feature: GYAE6OF02HBI60.30.10.A10.1.454.CMB.1.raw
  modified_base (242)..(244): a, c, t, g, unknown or other
  misc_feature (242)..(244): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggtttggggaagaggaagactgacggtcccccaggagttcaggtgctgggcacagcggccctgggctgcctggtcaaggactacttccacgtagcgtgctgagcgggctggcaaggcgcatagnnn

SEQ ID NO: 164761 - DNA, 244 bp, Homo sapiens; identical to SEQ ID NO: 164371
  misc_feature: GYAE6OF02HTH9W.30.10.A10.1.454.CMB.1.raw
  modified_base (243)..(244): a, c, t, g, unknown or other
  misc_feature (243)..(244): n is a, c, g, or t

SEQ ID NO: 164762 - DNA, 217 bp, Homo sapiens
  misc_feature: GYAE6OF02F4F3E.30.10.A10.1.454.CMB.1.raw
  modified_base (206)..(217): a, c, t, g, unknown or other
  misc_feature (206)..(217): n is a, c, g, or t
tcagcacgctacgtcacgaccggtgctcgatttagcgtcgatctcgaggggtccgggagatcatgacgggtgtccttgggtttgggggaagacggaaggactgacggtccctccaggagttcaggtgctgggcacagcggcctgggctgcctggtcaaggactacttccacgtagcgtgctgagcgggctggccaaggcgcatagnnnnnnnnnnnn

SEQ ID NO: 164763 - DNA, 203 bp, Homo sapiens; identical to SEQ ID NO: 164334
  misc_feature: GYAE6OF02H3MHY.30.10.A10.1.454.CMB.1.raw
  modified_base (201)..(203): a, c, t, g, unknown or other
  misc_feature (201)..(203): n is a, c, g, or t

SEQ ID NO: 164764 - DNA, 204 bp, Homo sapiens; identical to SEQ ID NO: 164408
  misc_feature: GYAE6OF02FRKAK.30.10.A10.1.454.CMB.1.raw
  modified_base (202)..(204): a, c, t, g, unknown or other
  misc_feature (202)..(204): n is a, c, g, or t

SEQ ID NO: 164765 - DNA, 248 bp, Homo sapiens; identical to SEQ ID NO: 164452
  misc_feature: GYAE6OF02HX8NT.30.10.A10.1.454.CMB.1.raw
  modified_base (244)..(248): a, c, t, g, unknown or other
  misc_feature (244)..(248): n is a, c, g, or t

SEQ ID NO: 164766 - DNA, 203 bp, Homo sapiens; identical to SEQ ID NO: 164378
  misc_feature: GYAE6OF02G3D42.30.10.A10.1.454.CMB.1.raw
  modified_base (202)..(203): a, c, t, g, unknown or other
  misc_feature (202)..(203): n is a, c, g, or t

SEQ ID NO: 164767 - DNA, 246 bp, Homo sapiens; identical to SEQ ID NO: 164347
  misc_feature: GYAE6OF02GNCZO.30.10.A10.1.454.CMB.1.raw
  modified_base (243)..(246): a, c, t, g, unknown or other
  misc_feature (243)..(246): n is a, c, g, or t

SEQ ID NO: 164768 - DNA, 218 bp, Homo sapiens
  misc_feature: GYAE6OF02JBBPD.30.10.A10.1.454.CMB.1.raw
  modified_base (203)..(218): a, c, t, g, unknown or other
  misc_feature (203)..(218): n is a, c, g, or t
tcagcacgctacgtcacgaccggtgctcgatttagcgtcgatctcaggggtccgggagaatcatgagggtgtccttgggttttgggggaagaggaagactgacggtcccccaggagttcaggtgctgggcacagcggccctgggctgcctggtcaaggactacttccacgtagcgtgctgagcgggctggcaaggcgcatagnnnnnnnnnnnnnnnn

SEQ ID NO: 164769 - DNA, 203 bp, Homo sapiens; identical to SEQ ID NO: 164334
  misc_feature: GYAE6OF02FZXN4.30.10.A10.1.454.CMB.1.raw
  modified_base (201)..(203): a, c, t, g, unknown or other
  misc_feature (201)..(203): n is a, c, g, or t

SEQ ID NO: 164770 - DNA, 247 bp, Homo sapiens; identical to SEQ ID NO: 164369
  misc_feature: GYAE6OF02HFNZG.30.10.A10.1.454.CMB.1.raw
  modified_base (243)..(247): a, c, t, g, unknown or other
  misc_feature (243)..(247): n is a, c, g, or t

SEQ ID NO: 164771 - DNA, 250 bp, Homo sapiens
  misc_feature: GYAE6OF02GPGGM.30.10.A10.1.454.CMB.1.raw
  modified_base (243)..(250): a, c, t, g, unknown or other
  misc_feature (243)..(250): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggtttgggggaagaggaagactgacggtcccccaggagttcaggtgctgggcacagcggccctgggctgcctggtcaaggactacttccacgtagcgtgctgagcgggctggcaaggcgcatagnnnnnnnn

SEQ ID NO: 164772 - DNA, 204 bp, Homo sapiens; identical to SEQ ID NO: 164408
  misc_feature: GYAE6OF02FKURR.30.10.A10.1.454.CMB.1.raw
  modified_base (202)..(204): a, c, t, g, unknown or other
  misc_feature (202)..(204): n is a, c, g, or t

SEQ ID NO: 164773 - DNA, 203 bp, Homo sapiens; identical to SEQ ID NO: 164378
  misc_feature: GYAE6OF02H2BVX.30.10.A10.1.454.CMB.1.raw
  modified_base (202)..(203): a, c, t, g, unknown or other
  misc_feature (202)..(203): n is a, c, g, or t

SEQ ID NO: 164774 - DNA, 291 bp, Homo sapiens
  misc_feature: GYAE6OF02GGKAR.30.10.A10.1.454.CMB.1.raw
  modified_base (134)..(134): a, c, t, g, unknown or other
  misc_feature (134)..(134): n is a, c, g, or t
  modified_base (248)..(291): a, c, t, g, unknown or other
  misc_feature (248)..(291): n is a, c, g, or t
tcagcacgctacgtcacgaccggtgctcgatttagcgtcgatctcaggggtcttcgtggctcacgtccaccaccgacgcatgtgacctcaggggtccgggagatcatgagggtgtccttgggttttgggggaanaggaagactgacggtcccccagggacgttcaggtgctgggcacagcggccctgggctgcctggtcaaggactacttccacgtagcgtgctgagcgggctggcaaggcgcatagnnnnnnnnnnnnnnnnnnnnnnnnnnnnnnnnnnnnnnnnnnnn

SEQ ID NO: 164775 - DNA, 249 bp, Homo sapiens
  misc_feature: GYAE6OF02IKTSL.30.10.A10.1.454.CMB.1.raw
  modified_base (245)..(249): a, c, t, g, unknown or other
  misc_feature (245)..(249): n is a, c, g, or t
tcagcacgctacgtcacgaccggtgctcgatttagcgtcgatctcagggtcttcgtggctcacgtccaccaccacgcatgtgacctcaggggtccgggagatcatggagggtgtccttgggtttggggagaggaagactgaccggtcccccaggagttcaggtgcgtgggcacagccggccctgggctgcctggtcaaggactacttccacgtagcgtgctgagcgggctggcaaggcgcatagnnnnn

SEQ ID NO: 164776 - DNA, 247 bp, Homo sapiens; identical to SEQ ID NO: 164736
  misc_feature: GYAE6OF02HWIE8.30.10.A10.1.454.CMB.1.raw
  modified_base (243)..(247): a, c, t, g, unknown or other
  misc_feature (243)..(247): n is a, c, g, or t

SEQ ID NO: 164777 - DNA, 246 bp, Homo sapiens; identical to SEQ ID NO: 164347
  misc_feature: GYAE6OF02IWCC3.30.10.A10.1.454.CMB.1.raw
  modified_base (243)..(246): a, c, t, g, unknown or other
  misc_feature (243)..(246): n is a, c, g, or t

SEQ ID NO: 164778 - DNA, 201 bp, Homo sapiens; identical to SEQ ID NO: 164392
  misc_feature: GYAE6OF02GC773.30.10.A10.1.454.CMB.1.raw
  modified_base (201)..(201): a, c, t, g, unknown or other
  misc_feature (201)..(201): n is a, c, g, or t

SEQ ID NO: 164779 - DNA, 206 bp, Homo sapiens; identical to SEQ ID NO: 164538
  misc_feature: GYAE6OF02H7NEN.30.10.A10.1.454.CMB.1.raw
  modified_base (202)..(206): a, c, t, g, unknown or other
  misc_feature (202)..(206): n is a, c, g, or t

SEQ ID NO: 164780 - DNA, 244 bp, Homo sapiens; identical to SEQ ID NO: 164714
  misc_feature: GYAE6OF02GV1YG.30.10.A10.1.454.CMB.1.raw
  modified_base (241)..(244): a, c, t, g, unknown or other
  misc_feature (241)..(244): n is a, c, g, or t

SEQ ID NO: 164781 - DNA, 203 bp, Homo sapiens; identical to SEQ ID NO: 164334
  misc_feature: GYAE6OF02IB980.30.10.A10.1.454.CMB.1.raw
  modified_base (201)..(203): a, c, t, g, unknown or other
  misc_feature (201)..(203): n is a, c, g, or t

SEQ ID NO: 164782 - DNA, 246 bp, Homo sapiens; identical to SEQ ID NO: 164347
  misc_feature: GYAE6OF02F02OU.30.10.A10.1.454.CMB.1.raw
  modified_base (243)..(246): a, c, t, g, unknown or other
  misc_feature (243)..(246): n is a, c, g, or t

SEQ ID NO: 164783 - DNA, 248 bp, Homo sapiens; identical to SEQ ID NO: 164452
  misc_feature: GYAE6OF02IO4B8.30.10.A10.1.454.CMB.1.raw
  modified_base (244)..(248): a, c, t, g, unknown or other
  misc_feature (244)..(248): n is a, c, g, or t

SEQ ID NO: 164784 - DNA, 248 bp, Homo sapiens; identical to SEQ ID NO: 164414
  misc_feature: GYAE6OF02JHZ42.30.10.A10.1.454.CMB.1.raw
  modified_base (243)..(248): a, c, t, g, unknown or other
  misc_feature (243)..(248): n is a, c, g, or t

SEQ ID NO: 164785 - DNA, 248 bp, Homo sapiens; identical to SEQ ID NO: 164452
  misc_feature: GYAE6OF02F8DBW.30.10.A10.1.454.CMB.1.raw
  modified_base (244)..(248): a, c, t, g, unknown or other
  misc_feature (244)..(248): n is a, c, g, or t

SEQ ID NO: 164786 - DNA, 204 bp, Homo sapiens; identical to SEQ ID NO: 164365
  misc_feature: GYAE6OF02HPM1F.30.10.A10.1.454.CMB.1.raw
  modified_base (201)..(204): a, c, t, g, unknown or other
  misc_feature (201)..(204): n is a, c, g, or t

SEQ ID NO: 164787 - DNA, 246 bp, Homo sapiens; identical to SEQ ID NO: 164347
  misc_feature: GYAE6OF02ILYVX.30.10.A10.1.454.CMB.1.raw
  modified_base (243)..(246): a, c, t, g, unknown or other
  misc_feature (243)..(246): n is a, c, g, or t

SEQ ID NO: 164788 - DNA, 218 bp, Homo sapiens
  misc_feature: GYAE6OF02GT3P7.30.10.A10.1.454.CMB.1.raw
  modified_base (202)..(218): a, c, t, g, unknown or other
  misc_feature (202)..(218): n is a, c, g, or t
tcagcacgctacgtcacgaccggtgctcgatttagcgtcgatctcaggggtccggggagatcatgagggtgtccttgggttttgggggaagaggaagactgacggtcccccaggagttcaggtgctggcacagcggccctgggctgcctggtcaaggactacttccacgtagcgtgctgagcgggctggcaaggcgcatagnnnnnnnnnnnnnnnnn

SEQ ID NO: 164789 - DNA, 247 bp, Homo sapiens; identical to SEQ ID NO: 164369
  misc_feature: GYAE6OF02FW6F2.30.10.A10.1.454.CMB.1.raw
  modified_base (243)..(247): a, c, t, g, unknown or other
  misc_feature (243)..(247): n is a, c, g, or t

SEQ ID NO: 164790 - DNA, 205 bp, Homo sapiens
  misc_feature: GYAE6OF02IZ4EM.30.10.A10.1.454.CMB.1.raw
  modified_base (200)..(205): a, c, t, g, unknown or other
  misc_feature (200)..(205): n is a, c, g, or t
tcagcacgctacgtcacgaccggtgctcgatttagcgtcgatctcagggtccggagatcatgagggtgtccttgggttttgggggaagaggaagactgacggtcccccaggagttcaggtgctgggcacagcggccctgggctgcctggtcaaggactacttccacgtagcgtgctgagcgggctggcaaggcgcatagnnnnnn

SEQ ID NO: 164791 - DNA, 206 bp, Homo sapiens
  misc_feature: GYAE6OF02HTVXB.30.10.A10.1.454.CMB.1.raw
  modified_base (201)..(206): a, c, t, g, unknown or other
  misc_feature (201)..(206): n is a, c, g, or t
tcagcacgctacgtcacgaccggtgctcgatttagcgtcgatctcaggggtccgggagatcatgagggtgtccttgggtttgggggaagaggaagactgacggtcccccaggagttcaggtgctgggcacagcggccctgggctgcctggtcaaggactacttccacgtagcgtgctgagcgggctggcaaggcgcatagnnnnnn

SEQ ID NO: 164792 - DNA, 205 bp, Homo sapiens; identical to SEQ ID NO: 164374
  misc_feature: GYAE6OF02GXRFI.30.10.A10.1.454.CMB.1.raw
  modified_base (202)..(205): a, c, t, g, unknown or other
  misc_feature (202)..(205): n is a, c, g, or t

SEQ ID NO: 164793 - DNA, 247 bp, Homo sapiens; identical to SEQ ID NO: 164457
  misc_feature: GYAE6OF02I9OOF.30.10.A10.1.454.CMB.1.raw
  modified_base (244)..(247): a, c, t, g, unknown or other
  misc_feature (244)..(247): n is a, c, g, or t

SEQ ID NO: 164794 - DNA, 207 bp, Homo sapiens; identical to SEQ ID NO: 164439
  misc_feature: GYAE6OF02JG470.30.10.A10.1.454.CMB.1.raw
  modified_base (202)..(207): a, c, t, g, unknown or other
  misc_feature (202)..(207): n is a, c, g, or t

SEQ ID NO: 164795 - DNA, 203 bp, Homo sapiens; identical to SEQ ID NO: 164378
  misc_feature: GYAE6OF02GOUTH.30.10.A10.1.454.CMB.1.raw
  modified_base (202)..(203): a, c, t, g, unknown or other
  misc_feature (202)..(203): n is a, c, g, or t

SEQ ID NO: 164796 - DNA, 246 bp, Homo sapiens; identical to SEQ ID NO: 164347
  misc_feature: GYAE6OF02I79Y3.30.10.A10.1.454.CMB.1.raw
  modified_base (243)..(246): a, c, t, g, unknown or other
  misc_feature (243)..(246): n is a, c, g, or t

SEQ ID NO: 164797 - DNA, 202 bp, Homo sapiens; identical to SEQ ID NO: 164363
  misc_feature: GYAE6OF02G1M0R.30.10.A10.1.454.CMB.1.raw
  modified_base (201)..(202): a, c, t, g, unknown or other
  misc_feature (201)..(202): n is a, c, g, or t

SEQ ID NO: 164798 - DNA, 274 bp, Homo sapiens
  misc_feature: GYAE6OF02FUT3S.30.10.A10.1.454.CMB.1.raw
  modified_base (134)..(134): a, c, t, g, unknown or other
  misc_feature (134)..(134): n is a, c, g, or t
  modified_base (248)..(274): a, c, t, g, unknown or other
  misc_feature (248)..(274): n is a, c, g, or t
tcagcacgctacgtcacgaccggtgctcgatttagcgtcgatctcagggtacgttcgtggctcacgtccaccaccacgcatgtgacctccaggggtccgggagatcatgagggtgtccttgggtttgggggaanaggaagactgacggtccccccaggagttcaggtgctgggcacagcggccctgggctgcctggtcaaggactacttccacgtagcgtgcctgagcgggctggcaaggcgcatagnnnnnnnnnnnnnnnnnnnnnnnnnnn

SEQ ID NO: 164799 - DNA, 310 bp, Homo sapiens
  misc_feature: GYAE6OF02IJ6FA.30.10.A10.1.454.CMB.1.raw
  modified_base (272)..(310): a, c, t, g, unknown or other
  misc_feature (272)..(310): n is a, c, g, or t
tcagcacgctacgtcacgaccggtgctcgatttagcgtcgatctcaggggtcttcgtggctccacgtccaccaccacgcatgtgacctcaggggtcccgggaggatcatcgagggtgtccttgggtttttggggggaagagggaagacgtgacggtcccccccaggagttcagggtgctgggcaccagcgggccctgggctgcctgggtcaaggactacttccacgtagcgtagcgtggacggcgggcgtggacgaagggccgtcggaatgnnnnnnnnnnnnnnnnnnnnnnnnnnnnnnnnnnnnnnn

SEQ ID NO: 164800 - DNA, 246 bp, Homo sapiens; identical to SEQ ID NO: 164495
  misc_feature: GYAE6OF02FOY48.30.10.A10.1.454.CMB.1.raw
  modified_base (244)..(246): a, c, t, g, unknown or other
  misc_feature (244)..(246): n is a, c, g, or t

SEQ ID NO: 164801 - DNA, 246 bp, Homo sapiens; identical to SEQ ID NO: 164353
  misc_feature: GYAE6OF02GOKUH.30.10.A10.1.454.CMB.1.raw
  modified_base (242)..(246): a, c, t, g, unknown or other
  misc_feature (242)..(246): n is a, c, g, or t

SEQ ID NO: 164802 - DNA, 247 bp, Homo sapiens; identical to SEQ ID NO: 164369
  misc_feature: GYAE6OF02ITGIT.30.10.A10.1.454.CMB.1.raw
  modified_base (243)..(247): a, c, t, g, unknown or other
  misc_feature (243)..(247): n is a, c, g, or t

SEQ ID NO: 164803 - DNA, 205 bp, Homo sapiens; identical to SEQ ID NO: 164374
  misc_feature: GYAE6OF02IX2LZ.30.10.A10.1.454.CMB.1.raw
  modified_base (202)..(205): a, c, t, g, unknown or other
  misc_feature (202)..(205): n is a, c, g, or t

SEQ ID NO: 164804 - DNA, 246 bp, Homo sapiens; identical to SEQ ID NO: 164353
  misc_feature: GYAE6OF02GRBE4.30.10.A10.1.454.CMB.1.raw
  modified_base (242)..(246): a, c, t, g, unknown or other
  misc_feature (242)..(246): n is a, c, g, or t

SEQ ID NO: 164805 - DNA, 246 bp, Homo sapiens; identical to SEQ ID NO: 164347
  misc_feature: GYAE6OF02GL9W9.30.10.A10.1.454.CMB.1.raw
  modified_base (243)..(246): a, c, t, g, unknown or other
  misc_feature (243)..(246): n is a, c, g, or t

SEQ ID NO: 164806 - DNA, 205 bp, Homo sapiens; identical to SEQ ID NO: 164374
  misc_feature: GYAE6OF02H70H3.30.10.A10.1.454.CMB.1.raw
  modified_base (202)..(205): a, c, t, g, unknown or other
  misc_feature (202)..(205): n is a, c, g, or t

SEQ ID NO: 164807 - DNA, 205 bp, Homo sapiens; identical to SEQ ID NO: 164374
  misc_feature: GYAE6OF02GDMK2.30.10.A10.1.454.CMB.1.raw
  modified_base (202)..(205): a, c, t, g, unknown or other
  misc_feature (202)..(205): n is a, c, g, or t

SEQ ID NO: 164808 - DNA, 246 bp, Homo sapiens; identical to SEQ ID NO: 164347
  misc_feature: GYAE6OF02FV12M.30.10.A10.1.454.CMB.1.raw
  modified_base (243)..(246): a, c, t, g, unknown or other
  misc_feature (243)..(246): n is a, c, g, or t

SEQ ID NO: 164809 - DNA, 231 bp, Homo sapiens
  misc_feature: GYAE6OF02HX0ZJ.30.10.A10.1.454.CMB.1.raw
  modified_base (206)..(231): a, c, t, g, unknown or other
  misc_feature (206)..(231): n is a, c, g, or t
tcagcacgctacgtcacgaccggtgctcgatttagcgtcgatctcaggggttccggggagatcatgagggtgtccttgggttttgggggaagaggaagactgacggtcccccgacggagttcaggtgctggggcacagcggcctggctgcctggtcaaggactacttccacgtagcgtgctgacgcgggctggcaaggcgcatagnnnnnnnnnnnnnnnnnnnnnnnnnn

SEQ ID NO: 164810 - DNA, 203 bp, Homo sapiens; identical to SEQ ID NO: 164378
  misc_feature: GYAE6OF02ISS7R.30.10.A10.1.454.CMB.1.raw
  modified_base (202)..(203): a, c, t, g, unknown or other
  misc_feature (202)..(203): n is a, c, g, or t

SEQ ID NO: 164811 - DNA, 204 bp, Homo sapiens; identical to SEQ ID NO: 164408
  misc_feature: GYAE6OF02H3JAH.30.10.A10.1.454.CMB.1.raw
  modified_base (202)..(204): a, c, t, g, unknown or other
  misc_feature (202)..(204): n is a, c, g, or t

SEQ ID NO: 164812 - DNA, 204 bp, Homo sapiens; identical to SEQ ID NO: 164365
  misc_feature: GYAE6OF02F3EYV.30.10.A10.1.454.CMB.1.raw
  modified_base (201)..(204): a, c, t, g, unknown or other
  misc_feature (201)..(204): n is a, c, g, or t

SEQ ID NO: 164813 - DNA, 201 bp, Homo sapiens
  misc_feature: GYAE6OF02I5CK3.30.10.A10.1.454.CMB.1.raw
  modified_base (200)..(201): a, c, t, g, unknown or other
  misc_feature (200)..(201): n is a, c, g, or t
tcagcacgctacgtcacgaccggtgctcgatttagcgtcgatctcaggggtccgggagatcatgaggtgtccttgggtttgggggaagaggaagactgacggtcccccaggagttcaggtgctgggcacagcggccctgggctgcatggtcaaggactacttccacgtagcgtgctgagcgggctggcaaggcgcatagnn

SEQ ID NO: 164814 - DNA, 209 bp, Homo sapiens
  misc_feature: GYAE6OF02HYP0G.30.10.A10.1.454.CMB.1.raw
  modified_base (203)..(209): a, c, t, g, unknown or other
  misc_feature (203)..(209): n is a, c, g, or t
tcagcacgctacgtcacgaccggtgctcgatttagcgtcgatctcaggggtccgggagatcgatgagggtgtccttgggttttgggggaagaggaagactgacggtcccccaggagttcaggtgctgggcacagcggccctgggctgcctggtcaaggactacttccacgtagcgtgctgagcgggctggcaaggcgcatagnnnnnnn

SEQ ID NO: 164815 - DNA, 202 bp, Homo sapiens
  misc_feature: GYAE6OF02ITJ3F.30.10.A10.1.454.CMB.1.raw
  modified_base (198)..(202): a, c, t, g, unknown or other
  misc_feature (198)..(202): n is a, c, g, or t
tcagcacgctacgtcacgaccggtgctcgatttagcgtcgatctcagggtccgggagatcatgaggtgtccttgggttttggggaagaggaagactgacggtccccaggagttcaggtgctgggcacagcggccctgggctgcctggtcaaggactacttccacgtagcgtgctgagcgggctggcaaggcgcatagnnnnn

SEQ ID NO: 164816 - DNA, 245 bp, Homo sapiens
  misc_feature: GYAE6OF02GK1D9.30.10.A10.1.454.CMB.1.raw
  modified_base (243)..(245): a, c, t, g, unknown or other
  misc_feature (243)..(245): n is a, c, g, or t
tcagcacgctacgtcacgaccggtgctcgatttagcgtcgatctcagggtcttcgtggctcacgtccaccaccacgcatgtgacctcagggtccgggagatcatgagggtgtccttgggttttgggggaagaggaagactgacggtcccccaggagttcaggtgctgggcacagcggccctgggctgcctggtcaaggactacttccacgtagcgtgctgagcgggctggcaaggcgcatagnnn

SEQ ID NO: 164817 - DNA, 247 bp, Homo sapiens; identical to SEQ ID NO: 164369
  misc_feature: GYAE6OF02FON43.30.10.A10.1.454.CMB.1.raw
  modified_base (243)..(247): a, c, t, g, unknown or other
  misc_feature (243)..(247): n is a, c, g, or t

SEQ ID NO: 164818 - DNA, 204 bp, Homo sapiens; identical to SEQ ID NO: 164408
  misc_feature: GYAE6OF02GQB7Q.30.10.A10.1.454.CMB.1.raw
  modified_base (202)..(204): a, c, t, g, unknown or other
  misc_feature (202)..(204): n is a, c, g, or t

SEQ ID NO: 164819 - DNA, 245 bp, Homo sapiens; identical to SEQ ID NO: 164727
  misc_feature: GYAE6OF02FUIOX.30.10.A10.1.454.CMB.1.raw
  modified_base (242)..(245): a, c, t, g, unknown or other
  misc_feature (242)..(245): n is a, c, g, or t

SEQ ID NO: 164820 - DNA, 245 bp, Homo sapiens; identical to SEQ ID NO: 164463
  misc_feature: GYAE6OF02JBRPB.30.10.A10.1.454.CMB.1.raw
  modified_base (243)..(245): a, c, t, g, unknown or other
  misc_feature (243)..(245): n is a, c, g, or t

SEQ ID NO: 164821 - DNA, 277 bp, Homo sapiens
  misc_feature: GYAE6OF02GIVM6.30.10.A10.1.454.CMB.1.raw
  modified_base (267)..(277): a, c, t, g, unknown or other
  misc_feature (267)..(277): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttggggggaagaggaagactgacggtccccccaggagttcgaggtgcgtggcacgaggccggcccgtgggctcgccgtggtacgaaggtacctaccttccgacgtagcgtgcgtgaggcgggcgtggacgaagggcgacagtagnnnnnnnnnnn

SEQ ID NO: 164822 - DNA, 269 bp, Homo sapiens
  misc_feature: GYAE6OF02HKKQW.30.10.A10.1.454.CMB.1.raw
  modified_base (245)..(246): a, c, t, g, unknown or other
  misc_feature (245)..(246): n is a, c, g, or t
  modified_base (248)..(269): a, c, t, g, unknown or other
  misc_feature (248)..(269): n is a, c, g, or t
tcagcacgctacgtcacgaccggtgctcgatttagcgtcgatctcgagggtcttcgtggctcacgtccaccaccacgcatgtgacctcaggggtcccgggagatcatgagggtgtccttgggtttgggggaagaggaagactgacggtcccccaggagttcaggtgctgggcacagcggccctgggctgcctggtcaaggctacttccacgtagcgtgctagagcgggctggcaaggcgcatagnngnnnnnnnnnnnnnnnnnnnnnn

SEQ ID NO: 164823 - DNA, 249 bp, Homo sapiens; identical to SEQ ID NO: 164464
  misc_feature: GYAE6OF02IU8WS.30.10.A10.1.454.CMB.1.raw
  modified_base (243)..(249): a, c, t, g, unknown or other
  misc_feature (243)..(249): n is a, c, g, or t

SEQ ID NO: 164824 - DNA, 329 bp, Homo sapiens
  misc_feature: GYAE6OF02FHHNP.30.10.A10.1.454.CMB.1.raw
  modified_base (266)..(267): a, c, t, g, unknown or other
  misc_feature (266)..(267): n is a, c, g, or t
  modified_base (270)..(271): a, c, t, g, unknown or other
  misc_feature (270)..(271): n is a, c, g, or t
  modified_base (274)..(329): a, c, t, g, unknown or other
  misc_feature (274)..(329): n is a, c, g, or t
tcagcacgctacgtcacgaccggtgctcgatttagcgtcgatctcagggtcttcggtggctcacgtccaccaccaccgccatgtgaccgtcaggggtccggggagagtccatgagggtcgtccttgggtttttggggggaagacggaagaccttgacgggttcccccccagggagttcaggtgctgggcacagcggtccctgggctgcctggtcaaggactacttccacggtagcggctgagcgggctggcaacggcgacactagnncannatnnnnnnnnnnnnnnnnnnnnnnnnnnnnnnnnnnnnnnnnnnnnnnnnnnnnnnnn

SEQ ID NO: 164825 - DNA, 204 bp, Homo sapiens; identical to SEQ ID NO: 164408
  misc_feature: GYAE6OF02HROVG.30.10.A10.1.454.CMB.1.raw
  modified_base (202)..(204): a, c, t, g, unknown or other
  misc_feature (202)..(204): n is a, c, g, or t

SEQ ID NO: 164826 - DNA, 204 bp, Homo sapiens; identical to SEQ ID NO: 164408
  misc_feature: GYAE6OF02F07XC.30.10.A10.1.454.CMB.1.raw
  modified_base (202)..(204): a, c, t, g, unknown or other
  misc_feature (202)..(204): n is a, c, g, or t

SEQ ID NO: 164827 - DNA, 205 bp, Homo sapiens; identical to SEQ ID NO: 164374
  misc_feature: GYAE6OF02HSQF2.30.10.A10.1.454.CMB.1.raw
  modified_base (202)..(205): a, c, t, g, unknown or other
  misc_feature (202)..(205): n is a, c, g, or t

SEQ ID NO: 164828 - DNA, 217 bp, Homo sapiens
  misc_feature: GYAE6OF02GKPHF.30.10.A10.1.454.CMB.1.raw
  modified_base (203)..(217): a, c, t, g, unknown or other
  misc_feature (203)..(217): n is a, c, g, or t
tcagcacgctacgtcacgaccggtgctcgatttagcgtcgatctcaggggtccgggagatcatgagggtgtccttgggttttgggggaagaggaagactgacggtcccccaggagttcaggtgctgggcacagcggccctgggctgcctggtcaaggactacgttccacgtagcgtgctgagcgggctggcaaggcgcatagnnnnnnnnnnnnnnn

SEQ ID NO: 164829 - DNA, 203 bp, Homo sapiens; identical to SEQ ID NO: 164378
  misc_feature: GYAE6OF02JASNZ.30.10.A10.1.454.CMB.1.raw
  modified_base (202)..(203): a, c, t, g, unknown or other
  misc_feature (202)..(203): n is a, c, g, or t

SEQ ID NO: 164830 - DNA, 202 bp, Homo sapiens
  misc_feature: GYAE6OF02FYIFT.30.10.A10.1.454.CMB.1.raw
  modified_base (202)..(202): a, c, t, g, unknown or other
  misc_feature (202)..(202): n is a, c, g, or t
tcagcacgctacgtcacgaccggtgctcgatttagcgtcgatctcaggggtccgggagatcatgagggtgtccttgggttttgggggaagaggaagactgacggtcccccaggagttcaggtgctgggcacagcggccctgggctgcctggtcaaggactacttccacgtagcgtgctgagcgggctggcaaggcgcatagn

SEQ ID NO: 164831 - DNA, 205 bp, Homo sapiens; identical to SEQ ID NO: 164374
  misc_feature: GYAE6OF02GUNSR.30.10.A10.1.454.CMB.1.raw
  modified_base (202)..(205): a, c, t, g, unknown or other
  misc_feature (202)..(205): n is a, c, g, or t

SEQ ID NO: 164832 - DNA, 239 bp, Homo sapiens
  misc_feature: GYAE6OF02I0A1L.30.10.A10.1.454.CMB.1.raw
  modified_base (201)..(203): a, c, t, g, unknown or other
  misc_feature (201)..(203): n is a, c, g, or t
  modified_base (205)..(239): a, c, t, g, unknown or other
  misc_feature (205)..(239): n is a, c, g, or t
tcagcacgctacgtcacgaccggtgctcgatttagcgtcgatctcaggggtccgggagatcatgagggtgtccttgggtttgggggaagaggaagactgacggtcccccaggagttcaggtgctgggcacagcggccctgggctgactggtcaaggactacttccacgtagcgtgctgagcgggctggcaaggcgcatagnnngnnnnnnnnnnnnnnnnnnnnnnnnnnnnnnnnnnn

SEQ ID NO: 164833 - DNA, 265 bp, Homo sapiens
  misc_feature: GYAE6OF02IL636.30.10.A10.1.454.CMB.1.raw
  modified_base (224)..(225): a, c, t, g, unknown or other
  misc_feature (224)..(225): n is a, c, g, or t
  modified_base (227)..(230): a, c, t, g, unknown or other
  misc_feature (227)..(230): n is a, c, g, or t
  modified_base (232)..(265): a, c, t, g, unknown or other
  misc_feature (232)..(265): n is a, c, g, or t
tcagcacgctacgtcacgaccggtgctcgatttagcgtcgatctcgacgggtccgggacgagtcactgagggtgttccttgggttttggggggtaaggaggaaggactgacggtccccccaggagttccaggtgctggcacagcggcctgggctgcctggtcgtaaggactactccaacgttaagcgttcgcttgagcggggctggcaaggtcggcgatagggnntnnnngnnnnnnnnnnnnnnnnnnnnnnnnnnnnnnnnnn

SEQ ID NO: 164834 - DNA, 203 bp, Homo sapiens
  misc_feature: GYAE6OF02H840I.30.10.A10.1.454.CMB.1.raw
  modified_base (202)..(203): a, c, t, g, unknown or other
  misc_feature (202)..(203): n is a, c, g, or t
tcagcacgctacgtcacgaccggtgctcgatttagcgtcgatctcaggggtccgggagatcatgagggtgtccttgggttttgggggaagaggaagactgacggtcccccaggagttcaggtgctgagcacagcggccctgggctgcctggtcaaggactacttccacgtagcgtgctgagcgggctggcaaggcgcatagnn

SEQ ID NO: 164835 - DNA, 253 bp, Homo sapiens
  misc_feature: GYAE6OF02H1NET.30.10.A10.1.454.CMB.1.raw
  modified_base (241)..(253): a, c, t, g, unknown or other
  misc_feature (241)..(253): n is a, c, g, or t
tcagcacgctacgtcacgaccggtgctcgatttagcgtcgatctcagggtcttcgtggctcacgtccaccaccacgcatgtgacctcagggtccgggagatcatgagggtgtccttgggtttgggggaagaggaagactgacggtcccccaggagttcaggtgctgggcacagcggccctgggctgcctggtcaaggctacttccacgtagcgtgctgagcgggctggcaaggcgcatagnnnnnnnnnnnnn

SEQ ID NO: 164836 - DNA, 243 bp, Homo sapiens
  misc_feature: GYAE6OF02HIIGF.30.10.A10.1.454.CMB.1.raw
  modified_base (208)..(243): a, c, t, g, unknown or other
  misc_feature (208)..(243): n is a, c, g, or t
tcagcacgctacgtcacgaccggtgctcgatttagcgtcgatctcaggggtccgggagatcgactagagggtcgtccttggggtttggggggaagacggaagactgaccggtcccccaggagttcaggtgctgggcacagcggcctgggcttgcctggtcaaggctacttccacgtagcgtgctgagcgggctggcaaggcgcatagnnnnnnnnnnnnnnnnnnnnnnnnnnnnnnnnnnnn

SEQ ID NO: 164837 - DNA, 207 bp, Homo sapiens
  misc_feature: GYAE6OF02HJXF2.30.10.A10.1.454.CMB.1.raw
  modified_base (201)..(207): a, c, t, g, unknown or other
  misc_feature (201)..(207): n is a, c, g, or t
tcagcacgctacgtcacgaccggtgctcgatttagcgtcgatctcaggggtccgggagatcatgagggtgtccttgggtttgggggaagaggaagactgacggtcccccaggagttcaggtgctgggcacagcggccctgggctgcctggtcaaggactacttccacgtagcgtgctgagcgggctggcaaggcgcatagnnnnnnn

SEQ ID NO: 164838 - DNA, 205 bp, Homo sapiens; identical to SEQ ID NO: 164395
  misc_feature: GYAE6OF02JEIRB.30.10.A10.1.454.CMB.1.raw
  modified_base (201)..(205): a, c, t, g, unknown or other
  misc_feature (201)..(205): n is a, c, g, or t

SEQ ID NO: 164839 - DNA, 250 bp, Homo sapiens; identical to SEQ ID NO: 164599
  misc_feature: GYAE6OF02IEJ8K.30.10.A10.1.454.CMB.1.raw
  modified_base (244)..(250): a, c, t, g, unknown or other
  misc_feature (244)..(250): n is a, c, g, or t

SEQ ID NO: 164840 - DNA, 235 bp, Homo sapiens
  misc_feature: GYAE6OF02G97SH.30.10.A10.1.454.CMB.1.raw
  modified_base (206)..(235): a, c, t, g, unknown or other
  misc_feature (206)..(235): n is a, c, g, or t
tcagcacgctacgtcacgaccggtgctcgatttagcgtcgatctcaggggtccgggagatcattgagggtgtccttgggttttgggggaagaggaagactgacggtcccccaggagttcaggtgctgggcacgagcggccctgggctgccgtggtccaaggactacttccacgtagcgtgctgagcgggctggcaaggcgcatagnnnnnnnnnnnnnnnnnnnnnnnnnnnnnn

SEQ ID NO: 164841 - DNA, 204 bp, Homo sapiens; identical to SEQ ID NO: 164408
  misc_feature: GYAE6OF02IMKTS.30.10.A10.1.454.CMB.1.raw
  modified_base (202)..(204): a, c, t, g, unknown or other
  misc_feature (202)..(204): n is a, c, g, or t

SEQ ID NO: 164842 - DNA, 250 bp, Homo sapiens
  misc_feature: GYAE6OF02H2N5H.30.10.A10.1.454.CMB.1.raw
  modified_base (244)..(250): a, c, t, g, unknown or other
  misc_feature (244)..(250): n is a, c, g, or t
tcagcacgctacgtcacgaccggtgctcgatttagcgtcgatctcagggtcttacgtggctcacgtccaccaccacgcatgtgacctcagggtccgggagatcatgagggtgtccttgggttttgggggaagaggaagactgacggtcccccaggagttcaggtgctgggcacagcggccctgggctgcctggtcaaggactacttccacgtagcgtgctgagcgggctggcaaggcgcatagnnnnnnn

SEQ ID NO: 164843 - DNA, 204 bp, Homo sapiens; identical to SEQ ID NO: 164408
  misc_feature: GYAE6OF02HWEOZ.30.10.A10.1.454.CMB.1.raw
  modified_base (202)..(204): a, c, t, g, unknown or other
  misc_feature (202)..(204): n is a, c, g, or t

SEQ ID NO: 164844 - DNA, 204 bp, Homo sapiens; identical to SEQ ID NO: 164408
  misc_feature: GYAE6OF02GASGG.30.10.A10.1.454.CMB.1.raw
  modified_base (202)..(204): a, c, t, g, unknown or other
  misc_feature (202)..(204): n is a, c, g, or t

SEQ ID NO: 164845 - DNA, 245 bp, Homo sapiens; identical to SEQ ID NO: 164463
  misc_feature: GYAE6OF02GOO4T.30.10.A10.1.454.CMB.1.raw
  modified_base (243)..(245): a, c, t, g, unknown or other
  misc_feature (243)..(245): n is a, c, g, or t

SEQ ID NO: 164846 - DNA, 202 bp, Homo sapiens; identical to SEQ ID NO: 164343
  misc_feature: GYAE6OF02HNM76.30.10.A10.1.454.CMB.1.raw
  modified_base (199)..(202): a, c, t, g, unknown or other
  misc_feature (199)..(202): n is a, c, g, or t

SEQ ID NO: 164847 - DNA, 263 bp, Homo sapiens
  misc_feature: GYAE6OF02G8IE1.30.10.A10.1.454.CMB.1.raw
  modified_base (244)..(263): a, c, t, g, unknown or other
  misc_feature (244)..(263): n is a, c, g, or t
tcagcacgctacgtcacgaccggtgctcgatttagcgtcgatctcagggtcgttcgtggctcacgtccaccaccacgcatgtgacctcaggggtccgggagatcatgagggtgtccttgggtttgggggaagaggaagactgacggtccccccaggagttcaggtgctgggcacagcggccctgggctgcctggtcaaggctacttccacgtagcgtgctgagcgggctggcaaggcgcatagnnnnnnnnnnnnnnnnnnnn

SEQ ID NO: 164848 - DNA, 207 bp, Homo sapiens
  misc_feature: GYAE6OF02H0U80.30.10.A10.1.454.CMB.1.raw
  modified_base (203)..(207): a, c, t, g, unknown or other
  misc_feature (203)..(207): n is a, c, g, or t
tcagcacgctacgtcacgaccggtgctcgatttagcgtcgatctcaggggtccgggagatcatgagggtgtccttgggttttggggggaagaggaagactgacggtcccccaggagttcaggtgctgggcacagcggccctgggctgcctggtcaaggactacttccacgtagcgtgctgagcgggctggcaaggcgcatagnnnnn

SEQ ID NO: 164849 - DNA, 205 bp, Homo sapiens; identical to SEQ ID NO: 164374
  misc_feature: GYAE6OF02GZ6IR.30.10.A10.1.454.CMB.1.raw
  modified_base (202)..(205): a, c, t, g, unknown or other
  misc_feature (202)..(205): n is a, c, g, or t

SEQ ID NO: 164850 - DNA, 248 bp, Homo sapiens; identical to SEQ ID NO: 164414
  misc_feature: GYAE6OF02F7XJ0.30.10.A10.1.454.CMB.1.raw
  modified_base (243)..(248): a, c, t, g, unknown or other
  misc_feature (243)..(248): n is a, c, g, or t

SEQ ID NO: 164851 - DNA, 206 bp, Homo sapiens; identical to SEQ ID NO: 164538
  misc_feature: GYAE6OF02FQC6W.30.10.A10.1.454.CMB.1.raw
  modified_base (202)..(206): a, c, t, g, unknown or other
  misc_feature (202)..(206): n is a, c, g, or t

SEQ ID NO: 164852 - DNA, 207 bp, Homo sapiens; identical to SEQ ID NO: 164501
  misc_feature: GYAE6OF02F1LC6.30.10.A10.1.454.CMB.1.raw
  modified_base (203)..(207): a, c, t, g, unknown or other
  misc_feature (203)..(207): n is a, c, g, or t

SEQ ID NO: 164853 - DNA, 250 bp, Homo sapiens; identical to SEQ ID NO: 164771
  misc_feature: GYAE6OF02H3KZ5.30.10.A10.1.454.CMB.1.raw
  modified_base (243)..(250): a, c, t, g, unknown or other
  misc_feature (243)..(250): n is a, c, g, or t

SEQ ID NO: 164854 - DNA, 285 bp, Homo sapiens
  misc_feature: GYAE6OF02GQ5XH.30.10.A10.1.454.CMB.1.raw
  modified_base (248)..(251): a, c, t, g, unknown or other
  misc_feature (248)..(251): n is a, c, g, or t
  modified_base (253)..(256): a, c, t, g, unknown or other
  misc_feature (253)..(256): n is a, c, g, or t
  modified_base (258)..(285): a, c, t, g, unknown or other
  misc_feature (258)..(285): n is a, c, g, or t
tcagcacgctacgtcacgaccggtgctcgatttagcgtcgatctcagggtcgttcgtcggctcacgtccaccaccacgcatgtgacctcagggtccgggagatcatgagggtgtccttgggttttggggggaagaggaagactgacgggtcccccaggagttcaggtgctgggctacagcggccctgggctgcctggtcaaggctacttccgacgtagcgtgcgtgagcgggctggcaggcgcatagnnnntnnnnannnnnnnnnnnnnnnnnnnnnnnnnnnn

SEQ ID NO: 164855 - DNA, 283 bp, Homo sapiens
  misc_feature: GYAE6OF02GE6WS.30.10.A10.1.454.CMB.1.raw
  modified_base (250)..(255): a, c, t, g, unknown or other
  misc_feature (250)..(255): n is a, c, g, or t
  modified_base (257)..(283): a, c, t, g, unknown or other
  misc_feature (257)..(283): n is a, c, g, or t
tcagcacgctacgtcacgaccggtgctcgatttagcgtcgatctcaggggtcttcgtggctcacgtccaccaccacgcatgtgacctcagggtccgggagatcatgagggtgtccttgggttttggggggaagaggaagactagacggtccccccaggagttcaggtgctgggcacagcggccctgggctgcctggtcaagggactacttccacgtagcgtgctgagcgggctggcaaggccgcatagcnnnnnncnnnnnnnnnnnnnnnnnnnnnnnnnnn

SEQ ID NO: 164856 - DNA, 241 bp, Homo sapiens
  misc_feature: GYAE6OF02F7UOK.30.10.A10.1.454.CMB.1.raw
  modified_base (204)..(241): a, c, t, g, unknown or other
  misc_feature (204)..(241): n is a, c, g, or t
tcagcacgctacgtcacgaccggtgctcgatttagcgtcgatctcgaggggtccgggagatcatgagggtgtccttgggttttggggggaagaggaagactgacggtcccccaggagttcaggtgctgggcacagcggccctgggctgcctggtcaaggctacttccacgtagcgtgctgagcgggctggcaaggcgcatacgnnnnnnnnnnnnnnnnnnnnnnnnnnnnnnnnnnnnnn

SEQ ID NO: 164857 - DNA, 204 bp, Homo sapiens; identical to SEQ ID NO: 164408
  misc_feature: GYAE6OF02FR6QR.30.10.A10.1.454.CMB.1.raw
  modified_base (202)..(204): a, c, t, g, unknown or other
  misc_feature (202)..(204): n is a, c, g, or t

SEQ ID NO: 164858 - DNA, 253 bp, Homo sapiens
  misc_feature: GYAE6OF02JB0TS.30.10.A10.1.454.CMB.1.raw
  modified_base (245)..(253): a, c, t, g, unknown or other
  misc_feature (245)..(253): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttggggggaagaggaagactgacggtcccccaggagttcaggtgctgggcacagcggccctgggctgcctggtcaaggactacttccacgtagcgtgctgagcgggctggcaaggcgcatagnnnnnnnnn

SEQ ID NO: 164859 - DNA, 206 bp, Homo sapiens; identical to SEQ ID NO: 164538
  misc_feature: GYAE6OF02HC1RW.30.10.A10.1.454.CMB.1.raw
  modified_base (202)..(206): a, c, t, g, unknown or other
  misc_feature (202)..(206): n is a, c, g, or t

SEQ ID NO: 164860 - DNA, 208 bp, Homo sapiens; identical to SEQ ID NO: 164467
  misc_feature: GYAE6OF02IU0LP.30.10.A10.1.454.CMB.1.raw
  modified_base (203)..(208): a, c, t, g, unknown or other
  misc_feature (203)..(208): n is a, c, g, or t

SEQ ID NO: 164861 - DNA, 248 bp, Homo sapiens; identical to SEQ ID NO: 164551
  misc_feature: GYAE6OF02FW1TF.30.10.A10.1.454.CMB.1.raw
  modified_base (245)..(248): a, c, t, g, unknown or other
  misc_feature (245)..(248): n is a, c, g, or t

SEQ ID NO: 164862 - DNA, 206 bp, Homo sapiens; identical to SEQ ID NO: 164538
  misc_feature: GYAE6OF02HA3V7.30.10.A10.1.454.CMB.1.raw
  modified_base (202)..(206): a, c, t, g, unknown or other
  misc_feature (202)..(206): n is a, c, g, or t

SEQ ID NO: 164863 - DNA, 250 bp, Homo sapiens
  misc_feature: GYAE6OF02F8E1B.30.10.A10.1.454.CMB.1.raw
  modified_base (244)..(250): a, c, t, g, unknown or other
  misc_feature (244)..(250): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggtttggggggaagaggaagactgacggtcccccaggagttcaggtgctgggcacagcggacctgggctgcctggtcaaggactacttccacgtagcgtgctgagcgggctggcaaggcgcatagnnnnnnn

SEQ ID NO: 164864 - DNA, 248 bp, Homo sapiens; identical to SEQ ID NO: 164414
  misc_feature: GYAE6OF02GJZEL.30.10.A10.1.454.CMB.1.raw
  modified_base (243)..(248): a, c, t, g, unknown or other
  misc_feature (243)..(248): n is a, c, g, or t

SEQ ID NO: 164865 - DNA, 205 bp, Homo sapiens
  misc_feature: GYAE6OF02G6UTB.30.10.A10.1.454.CMB.1.raw
  modified_base (203)..(205): a, c, t, g, unknown or other
  misc_feature (203)..(205): n is a, c, g, or t
tcagcacgctacgtcacgaccggtgctcgatttagcgtcgatctcaggggtccgggagatcatgagggtgtccttgggttttggggggaagaggaagactgacggtcccccaggagttcaggtgctgggcacagcggccctgggctgcctggtcaaggactacttccacgtagcgtgctgagcgggctggcaaggcgcatagnnn

SEQ ID NO: 164866 - DNA, 208 bp, Homo sapiens; identical to SEQ ID NO: 164612
  misc_feature: GYAE6OF02G0U2M.30.10.A10.1.454.CMB.1.raw
  modified_base (202)..(208): a, c, t, g, unknown or other
  misc_feature (202)..(208): n is a, c, g, or t

SEQ ID NO: 164867 - DNA, 202 bp, Homo sapiens
  misc_feature: GYAE6OF02H8R6P.30.10.A10.1.454.CMB.1.raw
  modified_base (202)..(202): a, c, t, g, unknown or other
  misc_feature (202)..(202): n is a, c, g, or t
tcagcacgctacgtcacgaccggtgctcgatttagcgtcgatctcaggggtccgggagatcatgagggtgtccttgggttttgggggaagaggaagactaacggtcccccaggagttcaggtgctgggcacagcggccctgggctgcctggtcaaggactacttccacgtagcgtgctgagcgggctggcaaggcgcatagn

SEQ ID NO: 164868 - DNA, 246 bp, Homo sapiens; identical to SEQ ID NO: 164536
  misc_feature: GYAE6OF02HSHPH.30.10.A10.1.454.CMB.1.raw
  modified_base (244)..(246): a, c, t, g, unknown or other
  misc_feature (244)..(246): n is a, c, g, or t

SEQ ID NO: 164869 - DNA, 227 bp, Homo sapiens
  misc_feature: GYAE6OF02I585O.30.10.A10.1.454.CMB.1.raw
  modified_base (204)..(227): a, c, t, g, unknown or other
  misc_feature (204)..(227): n is a, c, g, or t
tcagcacgctacgtcacgaccggtgctcgatttagcgtcgatctcagggggtccgggagatcatgagggtgtccttgggttttggggggaagaggaagactgacggtcccccaggagttcaggtgctgggcacagcggccctgggctgcctggtcaaggactacttccacgtagcgtgctgagcgggctggcaaggcgcatagnnnnnnnnnnnnnnnnnnnnnnnn

SEQ ID NO: 164870 - DNA, 205 bp, Homo sapiens
  misc_feature: GYAE6OF02JCEI3.30.10.A10.1.454.CMB.1.raw
  modified_base (201)..(205): a, c, t, g, unknown or other
  misc_feature (201)..(205): n is a, c, g, or t
tcagcacgctacgtcacgaccggtgctcgatttagcgtcgatctcaggggtccgggagatcatgagggtgtccttgggttttgggggaagaggaagactgacggtcccccaggagttcaggtgctgggcacagcggccctgggctgcctggtcaaggctacttccacgtagcgtgctgagcgggctggcaaggcgcatagnnnnn

SEQ ID NO: 164871 - DNA, 292 bp, Homo sapiens
  misc_feature: GYAE6OF02FHRR3.30.10.A10.1.454.CMB.1.raw
  modified_base (248)..(250): a, c, t, g, unknown or other
  misc_feature (248)..(250): n is a, c, g, or t
  modified_base (252)..(292): a, c, t, g, unknown or other
  misc_feature (252)..(292): n is a, c, g, or t
tcagcacgctacgtcacgaccggtgctcgatttagcgtcgatctcaggggtcttcgtggctcacgtccaccaccacgcatgtgacctcaggggtccgggagatcatgagggtgtccttgggttttgggggaagaggaagactgacgggtccccccaggagttcaggtgctgggcacagcggccctgggctgccctggtcaaggactacttccacgtagcgtgctgagcgggctggcaaggcgcatagnnngnnnnnnnnnnnnnnnnnnnnnnnnnnnnnnnnnnnnnnnnn

SEQ ID NO: 164872 - DNA, 285 bp, Homo sapiens
  misc_feature: GYAE6OF02IA0IR.30.10.A10.1.454.CMB.1.raw
  modified_base (250)..(285): a, c, t, g, unknown or other
  misc_feature (250)..(285): n is a, c, g, or t
tcagcacgctacgtcacgaccggtgctcgatttagcgtcgatctcagggtcgttcgtgggctcacgtccaccaccacgcatggtgacctcaggggtcccgggagagtcatgagggtgtccttgggtttggggggaagaggaagactgacggtccccccaggagttcaggtgctgggcacagcggcctgggctgcctggtcaaggactacttccacgtagcgtgctgagcgggctggcaaggcgcaatagnnnnnnnnnnnnnnnnnnnnnnnnnnnnnnnnnnnn

SEQ ID NO: 164873 - DNA, 204 bp, Homo sapiens; identical to SEQ ID NO: 164408
  misc_feature: GYAE6OF02HYKWK.30.10.A10.1.454.CMB.1.raw
  modified_base (202)..(204): a, c, t, g, unknown or other
  misc_feature (202)..(204): n is a, c, g, or t

SEQ ID NO: 164874 - DNA, 230 bp, Homo sapiens
  misc_feature: GYAE6OF02FYAMT.30.10.A10.1.454.CMB.1.raw
  modified_base (206)..(230): a, c, t, g, unknown or other
  misc_feature (206)..(230): n is a, c, g, or t
tcagcacgctacgtcacgaccggtgctcgatttagcgtcgatctcaggggtccggggagatcatgagggtgtccttgggttttggggggaagaggaagactgacggtccccccaggagttcaggtgctgggcacagcggccctgggctgcctggtcaaggacctacttccacgtagcgtgctgagcgggctggcaaggcgcatagnnnnnnnnnnnnnnnnnnnnnnnnn

SEQ ID NO: 164875 - DNA, 247 bp, Homo sapiens; identical to SEQ ID NO: 164525
  misc_feature: GYAE6OF02FVLMO.30.10.A10.1.454.CMB.1.raw
  modified_base (245)..(247): a, c, t, g, unknown or other
  misc_feature (245)..(247): n is a, c, g, or t

SEQ ID NO: 164876 - DNA, 207 bp, Homo sapiens; identical to SEQ ID NO: 164439
  misc_feature: GYAE6OF02JT21U.30.10.A10.1.454.CMB.1.raw
  modified_base (202)..(207): a, c, t, g, unknown or other
  misc_feature (202)..(207): n is a, c, g, or t

SEQ ID NO: 164877 - DNA, 520 bp, Homo sapiens
  misc_feature: GYAE6OF02HEZIN.30.10.A10.1.454.CMB.1.raw
  modified_base (263)..(265): a, c, t, g, unknown or other
  misc_feature (263)..(265): n is a, c, g, or t
  modified_base (267)..(267): a, c, t, g, unknown or other
  misc_feature (267)..(267): n is a, c, g, or t
  modified_base (278)..(278): a, c, t, g, unknown or other
  misc_feature (278)..(278): n is a, c, g, or t
  modified_base (286)..(286): a, c, t, g, unknown or other
  misc_feature (286)..(286): n is a, c, g, or t
  modified_base (291)..(292): a, c, t, g, unknown or other
  misc_feature (291)..(292): n is a, c, g, or t
  modified_base (294)..(294): a, c, t, g, unknown or other
  misc_feature (294)..(294): n is a, c, g, or t
  modified_base (296)..(296): a, c, t, g, unknown or other
  misc_feature (296)..(296): n is a, c, g, or t
  modified_base (309)..(309): a, c, t, g, unknown or other
  misc_feature (309)..(309): n is a, c, g, or t
  modified_base (311)..(311): a, c, t, g, unknown or other
  misc_feature (311)..(311): n is a, c, g, or t
  modified_base (318)..(318): a, c, t, g, unknown or other
  misc_feature (318)..(318): n is a, c, g, or t
  modified_base (328)..(328): a, c, t, g, unknown or other
  misc_feature (328)..(328): n is a, c, g, or t
  modified_base (337)..(337): a, c, t, g, unknown or other
  misc_feature (337)..(337): n is a, c, g, or t
  modified_base (352)..(352): a, c, t, g, unknown or other
  misc_feature (352)..(352): n is a, c, g, or t
  modified_base (358)..(358): a, c, t, g, unknown or other
  misc_feature (358)..(358): n is a, c, g, or t
tcagcacgctacgtcacgaccggtgctcgatttagcgtcgatctcaagggtcttcgtagggctcgacgtccacacccaacgcgatgtgacctcaggggtccgggagatcgactgaggtgtccttgggttttcgggggaaggaggaacgactgacggtccccccaggaggttcaggtgcgtgggcacagcggccctgggctgcctggtcaacggactacttccacgtacgccgtgctgagtcgggctgggcaaggcgcatacgnnntncagcgagcagnatgcatgnatgannananactggacctatcnanctcatcnctactagtgngcgacgcanactatacacgagagngagcgngagtagtattagtcgtcactcagcacgctacacgtacgtagtatatacgtactatatactctactactactatatagtactctactcctactactacgttcgtacggtacggtacgacgtacggacgtacgtacgtacgtacgtacgtcgtcgtacgtcacg

SEQ ID NO: 164878 - DNA, 248 bp, Homo sapiens; identical to SEQ ID NO: 164452
  misc_feature: GYAE6OF02FTBWU.30.10.A10.1.454.CMB.1.raw
  modified_base (244)..(248): a, c, t, g, unknown or other
  misc_feature (244)..(248): n is a, c, g, or t

SEQ ID NO: 164879 - DNA, 245 bp, Homo sapiens
  misc_feature: GYAE6OF02G0FYA.30.10.A10.1.454.CMB.1.raw
  modified_base (244)..(245): a, c, t, g, unknown or other
  misc_feature (244)..(245): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttgggggaagaggaagactgacggtcccccaggagttcaggtgctgggcacagcggccctgggctgcctggtcaaggactacttccacgtagcgtgctgagcgggctggcaaggcgcatagnn

SEQ ID NO: 164880 - DNA, 251 bp, Homo sapiens
  misc_feature: GYAE6OF02JN38V.30.10.A10.1.454.CMB.1.raw
  modified_base (242)..(251): a, c, t, g, unknown or other
  misc_feature (242)..(251): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggtttgggggaagaggaagactgacggtcccccaggagttcaggtgctgggcacagcggcctgggctgcctggtcaaggactacttccacgtagcgtgctgagcgggctggcaaggcgcatagnnnnnnnnnn

SEQ ID NO: 164881 - DNA, 206 bp, Homo sapiens; identical to SEQ ID NO: 164538
  misc_feature: GYAE6OF02G9G52.30.10.A10.1.454.CMB.1.raw
  modified_base (202)..(206): a, c, t, g, unknown or other
  misc_feature (202)..(206): n is a, c, g, or t

SEQ ID NO: 164882 - DNA, 250 bp, Homo sapiens; identical to SEQ ID NO: 164583
  misc_feature: GYAE6OF02JCHPF.30.10.A10.1.454.CMB.1.raw
  modified_base (245)..(250): a, c, t, g, unknown or other
  misc_feature (245)..(250): n is a, c, g, or t

SEQ ID NO: 164883 - DNA, 203 bp, Homo sapiens; identical to SEQ ID NO: 164378
  misc_feature: GYAE6OF02HYPG6.30.10.A10.1.454.CMB.1.raw
  modified_base (202)..(203): a, c, t, g, unknown or other
  misc_feature (202)..(203): n is a, c, g, or t

SEQ ID NO: 164884 - DNA, 206 bp, Homo sapiens
  misc_feature: GYAE6OF02GSCQQ.30.10.A10.1.454.CMB.1.raw
  modified_base (201)..(206): a, c, t, g, unknown or other
  misc_feature (201)..(206): n is a, c, g, or t
tcagcacgctacgtcacgaccggtgctcgatttagcgtcgatctcaggggtccgggagatcatgagggtgtccttgggttttgggggaagaggaagactgacggtcccccaggagttcaggtgctggcacagcggccctgggctgcctggtcaaggactacttccacgtagcgtgctgagcgggctggcaaggcgcatagnnnnnn

SEQ ID NO: 164885 - DNA, 249 bp, Homo sapiens; identical to SEQ ID NO: 164638
  misc_feature: GYAE6OF02HTS42.30.10.A10.1.454.CMB.1.raw
  modified_base (246)..(249): a, c, t, g, unknown or other
  misc_feature (246)..(249): n is a, c, g, or t

SEQ ID NO: 164886 - DNA, 246 bp, Homo sapiens
  misc_feature: GYAE6OF02JGLAV.30.10.A10.1.454.CMB.1.raw
  modified_base (206)..(209): a, c, t, g, unknown or other
  misc_feature (206)..(209): n is a, c, g, or t
  modified_base (211)..(213): a, c, t, g, unknown or other
  misc_feature (211)..(213): n is a, c, g, or t
  modified_base (215)..(246): a, c, t, g, unknown or other
  misc_feature (215)..(246): n is a, c, g, or t
tcagcacgctacgtcacgaccggtgctcgatttagcgtcgatctcaggggtccgggagatcgatgagggtgtccttgggttttggggggaacgaggaagactgacggtcccccaggagttcaggtgctgggcacagcggccctgggctgcctggtcaaggctacttccgacgtagcgtgtctgagcgggctggcaaggcgcatagnnnngnnngnnnnnnnnnnnnnnnnnnnnnnnnnnnnnnnn

SEQ ID NO: 164887 - DNA, 237 bp, Homo sapiens
  misc_feature: GYAE6OF02GU018.30.10.A10.1.454.CMB.1.raw
  modified_base (206)..(237): a, c, t, g, unknown or other
  misc_feature (206)..(237): n is a, c, g, or t
tcagcacgctacgtcacgaccggtgctcgatttagcgtcgatctcaggggtccgggacgatcatgagggtgtccttgggttttggggggaagaggaagactgacggtcccccaggagttcaggtgctgggcacagcggccctgggctggcctggtcaacggactacttccacgtagcgtgctgagcgggctggcaaggcgcatagnnnnnnnnnnnnnnnnnnnnnnnnnnnnnnnn

SEQ ID NO: 164888 - DNA, 248 bp, Homo sapiens
  misc_feature: GYAE6OF02ID78V.30.10.A10.1.454.CMB.1.raw
  modified_base (246)..(248): a, c, t, g, unknown or other
  misc_feature (246)..(248): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttggggggaagaggaagactgacggtccccccaggagttcaggtgctgggcacagcggccctgggctgcctggtcaaggactacttccacgtagcgtgctgagcgggctggcaaggcgcatagnnn

SEQ ID NO: 164889 - DNA, 275 bp, Homo sapiens
  misc_feature: GYAE6OF02FKYJQ.30.10.A10.1.454.CMB.1.raw
  modified_base (248)..(275): a, c, t, g, unknown or other
  misc_feature (248)..(275): n is a, c, g, or t
tcagcacgctacgtcacgaccggtgctcgatttagcgtcgatctcagggtcttcgtaggctcacgtccaccaccacgcatgtgacctcaaggggtccgggagatcatgagggtgtccttgggttttggggggaagaggaagactgacggtccccccaggagttcaggtgctgggcacagcggccctgggctgcctggtcaaggactacttccacgtagcgtgctgagcgggctggcaaggcgcatagnnnnnnnnnnnnnnnnnnnnnnnnnnnn

SEQ ID NO: 164890 - DNA, 206 bp, Homo sapiens; identical to SEQ ID NO: 164538
  misc_feature: GYAE6OF02G4BHN.30.10.A10.1.454.CMB.1.raw
  modified_base (202)..(206): a, c, t, g, unknown or other
  misc_feature (202)..(206): n is a, c, g, or t

SEQ ID NO: 164891 - DNA, 266 bp, Homo sapiens
  misc_feature: GYAE6OF02IMWGT.30.10.A10.1.454.CMB.1.raw
  modified_base (245)..(266): a, c, t, g, unknown or other
  misc_feature (245)..(266): n is a, c, g, or t
tcagcacgctacgtcacgaccggtgctcgatttagcgtcgatctcaggggtcttcgtggctcacgtccaccaccacgcatgtgacctcaggggtccgggagatcatgagggtgtccttgggtttgggggagaggaagacgtgacggtcccccaggagtcaggtgctgggcacagcggccctagggctgcctggtcaaggactacttccgacgtagcgtgctgagcgggctggcaaggcgcatagnnnnnnnnnnnnnnnnnnnnnn

SEQ ID NO: 164892 - DNA, 205 bp, Homo sapiens; identical to SEQ ID NO: 164374
  misc_feature: GYAE6OF02H0II2.30.10.A10.1.454.CMB.1.raw
  modified_base (202)..(205): a, c, t, g, unknown or other
  misc_feature (202)..(205): n is a, c, g, or t

SEQ ID NO: 164893 - DNA, 145 bp, Homo sapiens
  misc_feature: GYAE6OF02G96VU.30.10.A10.1.454.CMB.1.raw
tcagcacgctacgtcacgaccggtgctcgatttagcgtcgatctcaggggtccgggagatcatgagggtgtccttgggttttgggggaagaggaagactgacggtcccccaggagttcaggtgctgggcacagcggccctgggct

SEQ ID NO: 164894 - DNA, 260 bp, Homo sapiens
  misc_feature: GYAE6OF02IITT6.30.10.A10.1.454.CMB.1.raw
  modified_base (247)..(260): a, c, t, g, unknown or other
  misc_feature (247)..(260): n is a, c, g, or t
tcagcacgctacgtcacgaccggtgctcgatttagcgtcgatctcaggggtcttcgtggctcacgtccaccaccacgcatgtgacctcagggtccgggagatcatgagggtgtccttgggttttgggggaagaggaagacgtgtacgggtccccccaggacgttcgaggtgctgggcacagcggccctgggctgcctggtcaaggctacttccacgtagcgtgctgagcggctggcaaggcgcatgnnnnnnnnnnnnnn

SEQ ID NO: 164895 - DNA, 205 bp, Homo sapiens; identical to SEQ ID NO: 164865
  misc_feature: GYAE6OF02JHZ70.30.10.A10.1.454.CMB.1.raw
  modified_base (203)..(205): a, c, t, g, unknown or other
  misc_feature (203)..(205): n is a, c, g, or t

SEQ ID NO: 164896 - DNA, 204 bp, Homo sapiens; identical to SEQ ID NO: 164408
  misc_feature: GYAE6OF02GFBTE.30.10.A10.1.454.CMB.1.raw
  modified_base (202)..(204): a, c, t, g, unknown or other
  misc_feature (202)..(204): n is a, c, g, or t

SEQ ID NO: 164897 - DNA, 248 bp, Homo sapiens; identical to SEQ ID NO: 164452
  misc_feature: GYAE6OF02I2XH5.30.10.A10.1.454.CMB.1.raw
  modified_base (244)..(248): a, c, t, g, unknown or other
  misc_feature (244)..(248): n is a, c, g, or t

SEQ ID NO: 164898 - DNA, 205 bp, Homo sapiens
  misc_feature: GYAE6OF02GLZBQ.30.10.A10.1.454.CMB.1.raw
  modified_base (203)..(205): a, c, t, g, unknown or other
  misc_feature (203)..(205): n is a, c, g, or t
tcagcacgctacgtcacgaccggtgctcgatttagcgtcgatctcaggggtccgggagatcatgagggtgtccttgggttttggggggaagaggaagactgacggtccccccaggagttcaggtgctgggcacagcggccctgggctgcctggtcaaggctacttccacgtagcgtgctgagcgggctggcaaggcgcatagnnn

SEQ ID NO: 164899 - DNA, 252 bp, Homo sapiens
  misc_feature: GYAE6OF02IG5RW.30.10.A10.1.454.CMB.1.raw
  modified_base (245)..(252): a, c, t, g, unknown or other
  misc_feature (245)..(252): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttggggggaagaggaagactgacggtccccccaggagttcaggtgctgggcacagcggccctgggctgcctggtcaaggactacttccacgtagcgtgcgagcgggctggcaaggcgcatagnnnnnnnn

SEQ ID NO: 164900 - DNA, 206 bp, Homo sapiens; identical to SEQ ID NO: 164680
  misc_feature: GYAE6OF02FOEWO.30.10.A10.1.454.CMB.1.raw
  modified_base (204)..(206): a, c, t, g, unknown or other
  misc_feature (204)..(206): n is a, c, g, or t

SEQ ID NO: 164901 - DNA, 227 bp, Homo sapiens
  misc_feature: GYAE6OF02GOEA8.30.10.A10.1.454.CMB.1.raw
  modified_base (204)..(227): a, c, t, g, unknown or other
  misc_feature (204)..(227): n is a, c, g, or t
tcagcacgctacgtcacgaccggtgctcgatttagcgtcgatctcaggggtccgggagatcatgagggtgtccttgggttttgggggaagaggaagactgaccggtccccccaggagttcaggtgctgggcacagcggccctgggctgcctggtcaaggactacttccacgtagcgtgctgagcgggctggcaaggcgcatagnnnnnnnnnnnnnnnnnnnnnnnn

SEQ ID NO: 164902 - DNA, 211 bp, Homo sapiens
  misc_feature: GYAE6OF02GBHMX.30.10.A10.1.454.CMB.1.raw
  modified_base (202)..(211): a, c, t, g, unknown or other
  misc_feature (202)..(211): n is a, c, g, or t
tcagcacgctacgtcacgaccggtgctcgatttagcgtcgatctcaggggtccgggagatcatgagggtgtccttgggttttgggggaagaggaagactgacggtcccccaggagttcaggtgctgggcacagcggccctgggctgcctggtcaaggactacttccacgtagcgtgctgagcgggctggcaaggcgcatagnnnnnnnnnn

SEQ ID NO: 164903 - DNA, 256 bp, Homo sapiens
  misc_feature: GYAE6OF02G4HCV.30.10.A10.1.454.CMB.1.raw
  modified_base (246)..(256): a, c, t, g, unknown or other
  misc_feature (246)..(256): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttggggggaagaggaagactgacggtccccccaggagttcaggtgctgggcaaagcggccctgggctgcctggttaaggactacttccacgtagcgtgctgagcgggctggcaaggcgcatagnnnnnnnnnnn

SEQ ID NO: 164904 - DNA, 206 bp, Homo sapiens
  misc_feature: GYAE6OF02HQDM7.30.10.A10.1.454.CMB.1.raw
  modified_base (203)..(206): a, c, t, g, unknown or other
  misc_feature (203)..(206): n is a, c, g, or t
tcagcacgctacgtcacgaccggtgctcgatttagcgtcgatctcaggggtccgggagatcatgagggtgtccttgggttttggggggaagaggaagactgacggtcccccaggagttcaggtgctgggcacagcggccctgggctgcctggtcaaggactacttccacgtagcgtgctgagcgggctggcaaggcgcatagnnnn

SEQ ID NO: 164905 - DNA, 246 bp, Homo sapiens
  misc_feature: GYAE6OF02GVL92.30.10.A10.1.454.CMB.1.raw
  modified_base (245)..(246): a, c, t, g, unknown or other
  misc_feature (245)..(246): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttgggggaagaggaagactgacggtccccccaggagttcaggtgctgggcacagcggccctgggctgcctggtcaaggactacttccacgtagcgtgctgagcgggctggcaaggcgcatagnn

SEQ ID NO: 164906 - DNA, 248 bp, Homo sapiens
  misc_feature: GYAE6OF02GLCOT.30.10.A10.1.454.CMB.1.raw
  modified_base (243)..(247): a, c, t, g, unknown or other
  misc_feature (243)..(247): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggtttgggggaagaggaagactgacggtcccccaggagttcaggtgctgggcacagcggccctgggctgcctggtcaaggactacttccacgtagcgtgctgagcgggctggcaaggcgcatagnnnnna

SEQ ID NO: 164907 - DNA, 247 bp, Homo sapiens
  misc_feature: GYAE6OF02HQ6EM.30.10.A10.1.454.CMB.1.raw
  modified_base (200)..(247): a, c, t, g, unknown or other
  misc_feature (200)..(247): n is a, c, g, or t
tcagcacgctacgtcacgaccggtgctcgatttagcgtcgatctcaggggtccggagatcatgagggtgtccttgggttttcgggggaagaggtaagacttgacggtcccccaggagttcaggtgctgggcacagcggccctggctgcctggtcaaggctactcacgtagcgtgctgagcgggctggcaggccgcatagnnnnnnnnnnnnnnnnnnnnnnnnnnnnnnnnnnnnnnnnnnnnnnnn

SEQ ID NO: 164908 - DNA, 208 bp, Homo sapiens
  misc_feature: GYAE6OF02J3KT5.30.10.A10.1.454.CMB.1.raw
  modified_base (198)..(208): a, c, t, g, unknown or other
  misc_feature (198)..(208): n is a, c, g, or t
tcagcacgctacgtcacgaccggtgctcgatttagcgtcgatctcagggtccgggagatcatgaggtgtccttgggttttgggggaagaggaagactgacggtcccccaggagttcaggtgctgggcacagcggccctgggctgcctggtcaaggctacttccacgtagcgtgctgagcggctggcaaggcgcatagnnnnnnnnnnn

SEQ ID NO: 164909 - DNA, 219 bp, Homo sapiens
  misc_feature: GYAE6OF02I8XJF.30.10.A10.1.454.CMB.1.raw
  modified_base (203)..(219): a, c, t, g, unknown or other
  misc_feature (203)..(219): n is a, c, g, or t
tcagcacgctacgtcacgaccggtgctcgatttagcgtcgatctcaggggtccgggagatcatgagggtgtccttgggttttgggggaagaggaagactgacggtcccccaggagttcaggtgctgggcacagcggccctggctgcctggtcaaggctacttccacgtagcgtgctgagcgggctgggcaaggccgctatagnnnnnnnnnnnnnnnnn

SEQ ID NO: 164910 - DNA, 208 bp, Homo sapiens; identical to SEQ ID NO: 164397
  misc_feature: GYAE6OF02F39C4.30.10.A10.1.454.CMB.1.raw
  modified_base (201)..(208): a, c, t, g, unknown or other
  misc_feature (201)..(208): n is a, c, g, or t

SEQ ID NO: 164911 - DNA, 247 bp, Homo sapiens; identical to SEQ ID NO: 164525
  misc_feature: GYAE6OF02GBP15.30.10.A10.1.454.CMB.1.raw
  modified_base (245)..(247): a, c, t, g, unknown or other
  misc_feature (245)..(247): n is a, c, g, or t

SEQ ID NO: 164912 - DNA, 206 bp, Homo sapiens; identical to SEQ ID NO: 164538
  misc_feature: GYAE6OF02JA2I8.30.10.A10.1.454.CMB.1.raw
  modified_base (202)..(206): a, c, t, g, unknown or other
  misc_feature (202)..(206): n is a, c, g, or t

SEQ ID NO: 164913 - DNA, 247 bp, Homo sapiens
  misc_feature: GYAE6OF02HW27O.30.10.A10.1.454.CMB.1.raw
  modified_base (200)..(200): a, c, t, g, unknown or other
  misc_feature (200)..(200): n is a, c, g, or t
  modified_base (206)..(247): a, c, t, g, unknown or other
  misc_feature (206)..(247): n is a, c, g, or t
tcagcacgctacgtcacgaccggtgctcgatttagcgtcgatctcaggggtccgggagatcatgagggtggtccttgggtttgggggaagaggtaagactgacggtccccccaggagttcagggtgctgggcacagcggccctgggctgacctggtcaaggctacttccacgtagcgtgctgagcgggactggcaaggcncatagnnnnnnnnnnnnnnnnnnnnnnnnnnnnnnnnnnnnnnnnnn

SEQ ID NO: 164914 - DNA, 250 bp, Homo sapiens; identical to SEQ ID NO: 164771
  misc_feature: GYAE6OF02HH93H.30.10.A10.1.454.CMB.1.raw
  modified_base (243)..(250): a, c, t, g, unknown or other
  misc_feature (243)..(250): n is a, c, g, or t

SEQ ID NO: 164915 - DNA, 205 bp, Homo sapiens; identical to SEQ ID NO: 164374
  misc_feature: GYAE6OF02HBZFE.30.10.A10.1.454.CMB.1.raw
  modified_base (202)..(205): a, c, t, g, unknown or other
  misc_feature (202)..(205): n is a, c, g, or t

SEQ ID NO: 164916 - DNA, 206 bp, Homo sapiens; identical to SEQ ID NO: 164904
  misc_feature: GYAE6OF02HF7C2.30.10.A10.1.454.CMB.1.raw
  modified_base (203)..(206): a, c, t, g, unknown or other
  misc_feature (203)..(206): n is a, c, g, or t

SEQ ID NO: 164917 - DNA, 265 bp, Homo sapiens
  misc_feature: GYAE6OF02G796T.30.10.A10.1.454.CMB.1.raw
  modified_base (246)..(265): a, c, t, g, unknown or other
  misc_feature (246)..(265): n is a, c, g, or t
tcagcacgctacgtcacgaccggtgctcgatttagcgtcgatctcagggtcgttcgtggctcacgtccaccaccacgcatgtgacctcaggggtccgggagatcatgagggtgtccttgggttttggggggaagaggaagactgacggtccccccaggagttcaggtgctgggcacagcggccctgggctgcctggtcaaggctacttccacgtagcgtgctgagcgggctggcaaggcgcatagnnnnnnnnnnnnnnnnnnnn

SEQ ID NO: 164918 - DNA, 220 bp, Homo sapiens; identical to SEQ ID NO: 164403
  misc_feature: GYAE6OF02FZLR5.30.10.A10.1.454.CMB.1.raw
  modified_base (203)..(220): a, c, t, g, unknown or other
  misc_feature (203)..(220): n is a, c, g, or t

SEQ ID NO: 164919 - DNA, 230 bp, Homo sapiens
  misc_feature: GYAE6OF02FXVAE.30.10.A10.1.454.CMB.1.raw
  modified_base (204)..(230): a, c, t, g, unknown or other
  misc_feature (204)..(230): n is a, c, g, or t
tcagcacgctacgtcacgaccggtgctcgatttagcgtcgatctcagggggtccgggagatcatgagggtgtccttgggttttggggggaagaggaagactgacggtcccccaggagttcaggtgctgggcacagcggccctgggctgcctggtcaaggctacttccacgtagcgtgctgagcgggctggcaaggcgcatagcnnnnnnnnnnnnnnnnnnnnnnnnnnn

SEQ ID NO: 164920 - DNA, 290 bp, Homo sapiens
  misc_feature: GYAE6OF02I7MMK.30.10.A10.1.454.CMB.1.raw
  modified_base (253)..(290): a, c, t, g, unknown or other
  misc_feature (253)..(290): n is a, c, g, or t
tcagcacgctacgtcacgaccggtgctcgatttagcgtcgatctcagggtcttcgtggctctacgtccaccaccacgtacatgtgacctcaggggtccgggagatcatgagggtgtccttgggtttggggggaagagggaagactgacggtccccccaggacgttcaggtgcctgggcacagtcggccctgggctgccctggtcaaggctacctccacgtagcgtgcgtgagcgggctggcaaggcgcatagnnnnnnnnnnnnnnnnnnnnnnnnnnnnnnnnnnnnnn

SEQ ID NO: 164921 - DNA, 253 bp, Homo sapiens; identical to SEQ ID NO: 164641
  misc_feature: GYAE6OF02JGVPG.30.10.A10.1.454.CMB.1.raw
  modified_base (246)..(253): a, c, t, g, unknown or other
  misc_feature (246)..(253): n is a, c, g, or t

SEQ ID NO: 164922 - DNA, 251 bp, Homo sapiens
  misc_feature: GYAE6OF02F7K7V.30.10.A10.1.454.CMB.1.raw
  modified_base (245)..(251): a, c, t, g, unknown or other
  misc_feature (245)..(251): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttggggggaagaggaagactgacggtccccccaggagttcaggtgctgggcacagcggccctgggctgcctggtcaaggctacttccacgtagcgtgctgagcgggctggcaaggcgcatagnnnnnnn

SEQ ID NO: 164923 - DNA, 569 bp, Homo sapiens
  misc_feature: GYAE6OF02I4UKI.30.10.A10.1.454.CMB.1.raw
  modified_base (219)..(219): a, c, t, g, unknown or other
  misc_feature (219)..(219): n is a, c, g, or t
  modified_base (221)..(221): a, c, t, g, unknown or other
  misc_feature (221)..(221): n is a, c, g, or t
  modified_base (224)..(224): a, c, t, g, unknown or other
  misc_feature (224)..(224): n is a, c, g, or t
  modified_base (230)..(230): a, c, t, g, unknown or other
  misc_feature (230)..(230): n is a, c, g, or t
  modified_base (233)..(234): a, c, t, g, unknown or other
  misc_feature (233)..(234): n is a, c, g, or t
  modified_base (246)..(246): a, c, t, g, unknown or other
  misc_feature (246)..(246): n is a, c, g, or t
  modified_base (251)..(251): a, c, t, g, unknown or other
  misc_feature (251)..(251): n is a, c, g, or t
  modified_base (253)..(257): a, c, t, g, unknown or other
  misc_feature (253)..(257): n is a, c, g, or t
  modified_base (260)..(260): a, c, t, g, unknown or other
  misc_feature (260)..(260): n is a, c, g, or t
  modified_base (262)..(263): a, c, t, g, unknown or other
  misc_feature (262)..(263): n is a, c, g, or t
  modified_base (265)..(265): a, c, t, g, unknown or other
  misc_feature (265)..(265): n is a, c, g, or t
  modified_base (268)..(268): a, c, t, g, unknown or other
  misc_feature (268)..(268): n is a, c, g, or t
  modified_base (272)..(273): a, c, t, g, unknown or other
  misc_feature (272)..(273): n is a, c, g, or t
  modified_base (290)..(290): a, c, t, g, unknown or other
  misc_feature (290)..(290): n is a, c, g, or t
  modified_base (293)..(293): a, c, t, g, unknown or other
  misc_feature (293)..(293): n is a, c, g, or t
  modified_base (308)..(308): a, c, t, g, unknown or other
  misc_feature (308)..(308): n is a, c, g, or t
  modified_base (312)..(312): a, c, t, g, unknown or other
  misc_feature (312)..(312): n is a, c, g, or t
  modified_base (314)..(314): a, c, t, g, unknown or other
  misc_feature (314)..(314): n is a, c, g, or t
  modified_base (316)..(316): a, c, t, g, unknown or other
  misc_feature (316)..(316): n is a, c, g, or t
  modified_base (333)..(333): a, c, t, g, unknown or other
  misc_feature (333)..(333): n is a, c, g, or t
  modified_base (360)..(360): a, c, t, g, unknown or other
  misc_feature (360)..(360): n is a, c, g, or t
tcagcacgctacgtcacgaccggtgctcgatttagcgtcgatctcaggggtccgggagatcatgtagggtgtccttggggttttggggggaagtagggtaaggacgtgacggtccccccaggagttcaggtggctggcacagcggccctgggctcgcctggtcaacggctactccacgtagcgtgctgagtcgggctgggcctaagggcgacagttagnangcncgcagngcnnctgcagacagcnctatncnnnnncgnannantanacannatatatctagtacgacncgngagacgacgacgacncgcntntnagtactatatatagtanacgcgacgacgcgcgacgtacgtactntacgtcgtcgtacctacacgacgtcgacgacgacgtacgtacgacgacgtaccggactcgtacggtacgtacgacgacggacgacgacgacggtacgtagttacgttacgttacgttacgtacgtacgtacgtagtacgtaacgtacgtaacggtaacgtagttacgtacgtacgttacgttccgttacggtacggtacggacgtacgg

SEQ ID NO: 164924 - DNA, 248 bp, Homo sapiens; identical to SEQ ID NO: 164551
  misc_feature: GYAE6OF02GMQPL.30.10.A10.1.454.CMB.1.raw
  modified_base (245)..(248): a, c, t, g, unknown or other
  misc_feature (245)..(248): n is a, c, g, or t

SEQ ID NO: 164925 - DNA, 220 bp, Homo sapiens
  misc_feature: GYAE6OF02GEXOI.30.10.A10.1.454.CMB.1.raw
  modified_base (203)..(220): a, c, t, g, unknown or other
  misc_feature (203)..(220): n is a, c, g, or t
tcagcacgctacgtcacgaccggtgctcgatttagcgtcgatctcagggggtccgggagatcatgagggtgtccttgggttttgggggaagaggaagactgacggtcccccaggagttcaggtgctgggcacagcggccctgggctgcctggtcaaggactacttccacgtagcgtgctgagcgggctggcaaggcgcatagnnnnnnnnnnnnnnnnnn

SEQ ID NO: 164926 - DNA, 248 bp, Homo sapiens
  misc_feature: GYAE6OF02F91NO.30.10.A10.1.454.CMB.1.raw
  modified_base (245)..(248): a, c, t, g, unknown or other
  misc_feature (245)..(248): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttggggggaagaggaagactgacggtcccccaggagttcaggtgctgggcacagcggccctgggctgcctggtcaaggactacttccacgtagcgtgctgagcgggctggcaaggcgcatagnnnn

SEQ ID NO: 164927 - DNA, 213 bp, Homo sapiens
  misc_feature: GYAE6OF02IQ0NT.30.10.A10.1.454.CMB.1.raw
  modified_base (204)..(213): a, c, t, g, unknown or other
  misc_feature (204)..(213): n is a, c, g, or t
tcagcacgctacgtcacgaccggtgctcgatttagcgtcgatctcaggggtccgggagatcatgagggtgtccttgggttttgggggaagaggaagactgacggtcccccaggagttcaggtgctgggcacagcggccctgggctgcctggtcaaggactacttccacgtagcgtgctgagcgggctgggacaaggcgcatagnnnnnnnnnn

SEQ ID NO: 164928 - DNA, 270 bp, Homo sapiens
  misc_feature: GYAE6OF02G5MFT.30.10.A10.1.454.CMB.1.raw
  modified_base (247)..(270): a, c, t, g, unknown or other
  misc_feature (247)..(270): n is a, c, g, or t
tcagcacgctacgtcacgaccggtgctcgatttagcgtcgatctcgagggtcttcgtggctcacgtccaccaccacgcatgtgacctcaggggtccgggagatcatgagggtgtccgttgggttttggggggagaggaagactgacggtcccccaggagttcaggtgctgggcacagcggccctgggcctgcctggtcaaggactacttccacgtagcgtgctgagcgggctggcaaggcgcatagnnnnnnnnnnnnnnnnnnnnnnnn

SEQ ID NO: 164929 - DNA, 252 bp, Homo sapiens; identical to SEQ ID NO: 164535
  misc_feature: GYAE6OF02JLO9R.30.10.A10.1.454.CMB.1.raw
  modified_base (246)..(252): a, c, t, g, unknown or other
  misc_feature (246)..(252): n is a, c, g, or t

SEQ ID NO: 164930 - DNA, 206 bp, Homo sapiens
  misc_feature: GYAE6OF02ICPT0.30.10.A10.1.454.CMB.1.raw
  modified_base (200)..(206): a, c, t, g, unknown or other
  misc_feature (200)..(206): n is a, c, g, or t
tcagcacgctacgtcacgaccggtgctcgatttagcgtcgatctcaggggtccgggagatcatgagggtgtccttgggttttgggggaagaggaagactgacggtcccccaggagttcaggtgctgggcacagcggcctgggctgcctggtcaaggactactccacgtagcgtgctgagcgggctggcaaggcgcatagnnnnnnn

SEQ ID NO: 164931 - DNA, 251 bp, Homo sapiens
  misc_feature: GYAE6OF02JIAA2.30.10.A10.1.454.CMB.1.raw
  modified_base (215)..(215): a, c, t, g, unknown or other
  misc_feature (215)..(215): n is a, c, g, or t
  modified_base (245)..(251): a, c, t, g, unknown or other
  misc_feature (245)..(251): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttgggggaagaggaagactgacggtccccccaggagttcaggtgctgggcacagcggccctgggctgcctggtcaaggactacttccacgtancgtgctgagcgggctggcaaggcgcatagnnnnnnn

SEQ ID NO: 164932 - DNA, 209 bp, Homo sapiens; identical to SEQ ID NO: 164733
  misc_feature: GYAE6OF02G1PMH.30.10.A10.1.454.CMB.1.raw
  modified_base (202)..(209): a, c, t, g, unknown or other
  misc_feature (202)..(209): n is a, c, g, or t

SEQ ID NO: 164933 - DNA, 254 bp, Homo sapiens
  misc_feature: GYAE6OF02JSH9O.30.10.A10.1.454.CMB.1.raw
  modified_base (240)..(254): a, c, t, g, unknown or other
  misc_feature (240)..(254): n is a, c, g, or t
tcagcacgctacgtcacgaccggtgctcgatttagcgtcgatctcagggtcttcgtggctcacgtccaccaccacgcatgtgacctcaggggtccgggagatcatgaggtgtccttgggtttgggggaagaggaagactgacggtcccccaggagttcaggtgctgggcacagcgccctgggctgcctggtcaaggctacttccacgtagcgtgctgagcgggctggcaaggcgcatagnnnnnnnnnnnnnnn

SEQ ID NO: 164934 - DNA, 254 bp, Homo sapiens
  misc_feature: GYAE6OF02JCN4K.30.10.A10.1.454.CMB.1.raw
  modified_base (246)..(254): a, c, t, g, unknown or other
  misc_feature (246)..(254): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttggggggaagaggaagactgacggtccccccaggagttcaggtgctgggcacagcggccctgggctgcctggtcaaggactacttccacgtagcgtgctgagcgggctggcaaggcgcatagnnnnnnnnn

SEQ ID NO: 164935 - DNA, 558 bp, Homo sapiens
  misc_feature: GYAE6OF02FG2D1.30.10.A10.1.454.CMB.1.raw
  modified_base (137)..(137): a, c, t, g, unknown or other
  misc_feature (137)..(137): n is a, c, g, or t
  modified_base (253)..(254): a, c, t, g, unknown or other
  misc_feature (253)..(254): n is a, c, g, or t
  modified_base (256)..(259): a, c, t, g, unknown or other
  misc_feature (256)..(259): n is a, c, g, or t
  modified_base (263)..(263): a, c, t, g, unknown or other
  misc_feature (263)..(263): n is a, c, g, or t
  modified_base (267)..(267): a, c, t, g, unknown or other
  misc_feature (267)..(267): n is a, c, g, or t
  modified_base (289)..(289): a, c, t, g, unknown or other
  misc_feature (289)..(289): n is a, c, g, or t
  modified_base (293)..(293): a, c, t, g, unknown or other
  misc_feature (293)..(293): n is a, c, g, or t
  modified_base (298)..(298): a, c, t, g, unknown or other
  misc_feature (298)..(298): n is a, c, g, or t
  modified_base (307)..(307): a, c, t, g, unknown or other
  misc_feature (307)..(307): n is a, c, g, or t
  modified_base (317)..(317): a, c, t, g, unknown or other
  misc_feature (317)..(317): n is a, c, g, or t
  modified_base (331)..(331): a, c, t, g, unknown or other
  misc_feature (331)..(331): n is a, c, g, or t
  modified_base (333)..(333): a, c, t, g, unknown or other
  misc_feature (333)..(333): n is a, c, g, or t
tcagcacgctacgtcacgaccggtgctcgatttagcgtcgatctcaggggtcttcgtggctcacgtcgaccaccacgcatggtagacctcagggtccggagactcgactgacggtgtccttcgggttttgggggaanaggtagactgacggtcccccaggagttcaggtgctgggcacgagcggccctgggctcgccctggtcaaggactacttcccacgtagacgtgctgagcggctggcaaggcgcatagnnannnntgcngcanagcagcagtcctgactgcatcngagnacagngacgacacncggaccgcgngagacgtactctcncnctacgacgacgacgacgacgacgcgacgtcgtacgacacgcgcgtcggcgacgtacgagagtacgacgacgacgtacttacgtagtacgtacgacgacacgacgagtacgtacgtacgtacgtacggtacggtacgtacggacggtacgtacgtacgtacgtacgtacgtacgacgacgtaccgtaccgaccgtccgtacccgtccgaccgtacgtaccgtaccg

SEQ ID NO: 164936 - DNA, 207 bp, Homo sapiens
  misc_feature: GYAE6OF02FS464.30.10.A10.1.454.CMB.1.raw
  modified_base (203)..(207): a, c, t, g, unknown or other
  misc_feature (203)..(207): n is a, c, g, or t
tcagcacgctacgtcacgaccggtgctcgatttagcgtcgatctcaggggtccgggagatcatgagggtgtccttgggttttggggggaagaggaagactgacggtccccccaggagttcaggtgctgggcacagcggccctgggctgcctggtcaaggactacttcacgtagcgtgctgagcgggctggcaaggcgcatagnnnnn

SEQ ID NO: 164937 - DNA, 206 bp, Homo sapiens; identical to SEQ ID NO: 164680
  misc_feature: GYAE6OF02FLU7X.30.10.A10.1.454.CMB.1.raw
  modified_base (204)..(206): a, c, t, g, unknown or other
  misc_feature (204)..(206): n is a, c, g, or t

SEQ ID NO: 164938 - DNA, 251 bp, Homo sapiens
  misc_feature: GYAE6OF02GTDWP.30.10.A10.1.454.CMB.1.raw
  modified_base (246)..(251): a, c, t, g, unknown or other
  misc_feature (246)..(251): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttggggggaagaggaagactgacggtccccccaggagttcaggtgctgggcacagcggccctgggctgcctggtcaaggactacttccacgtagcgtgctgagcgggctggcaaggcgcatagnnnnnn

SEQ ID NO: 164939 - DNA, 212 bp, Homo sapiens; identical to SEQ ID NO: 164671
  misc_feature: GYAE6OF02GRBVL.30.10.A10.1.454.CMB.1.raw
  modified_base (204)..(212): a, c, t, g, unknown or other
  misc_feature (204)..(212): n is a, c, g, or t

SEQ ID NO: 164940 - DNA, 260 bp, Homo sapiens
  misc_feature: GYAE6OF02GY6PH.30.10.A10.1.454.CMB.1.raw
  modified_base (80)..(80): a, c, t, g, unknown or other
  misc_feature (80)..(80): n is a, c, g, or t
  modified_base (227)..(227): a, c, t, g, unknown or other
  misc_feature (227)..(227): n is a, c, g, or t
  modified_base (248)..(260): a, c, t, g, unknown or other
  misc_feature (248)..(260): n is a, c, g, or t
tcagcacgctacgtcacgaccggtgctcgatttagcgtcgatctcagggtcttcgtggcgtcacgtccaccaccacgcancgtgacctcagggtccgggagatcatgagggtgtccttgggttttgggggagagggaagactgacggtcccccaggagttcgaggtgctgggcacacggcggccctgggctgcctggtcaaggactacttcacgtagcgtgctgagngggcctggcaaggcgcaatgnnnnnnnnnnnnn

SEQ ID NO: 164941 - DNA, 265 bp, Homo sapiens
  misc_feature: GYAE6OF02IVIN9.30.10.A10.1.454.CMB.1.raw
  modified_base (245)..(265): a, c, t, g, unknown or other
  misc_feature (245)..(265): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttggggggaagaggaagatgacggtccccccaggagttcaggtgctgggcacagcggccctgggctgcctggtcaaggactacttccacgtagcgtgctgagcgggctggcaaggcgcatagnnnnnnnnnnnnnnnnnnnnn

SEQ ID NO: 164942 - DNA, 206 bp, Homo sapiens; identical to SEQ ID NO: 164680
  misc_feature: GYAE6OF02FNCIJ.30.10.A10.1.454.CMB.1.raw
  modified_base (204)..(206): a, c, t, g, unknown or other
  misc_feature (204)..(206): n is a, c, g, or t

SEQ ID NO: 164943 - DNA, 257 bp, Homo sapiens
  misc_feature: GYAE6OF02HQREE.30.10.A10.1.454.CMB.1.raw
  modified_base (244)..(257): a, c, t, g, unknown or other
  misc_feature (244)..(257): n is a, c, g, or t
tcagcacgctacgtcacgaccggtgctcgatttagcgtcgatctcagggtcttcgtggctcacgtccaccaccacgcatgtgacctcaggggtccgggagatcatgaggtgtccttgggtttgggggaagaggaagactgacggtcccccaggagttcaggtgctgggcacgagcggccctgggctgcctggtcaaggactacttcacgtagcgtgctgagcgggctggcaaggcgtcaagtgnnnnnnnnnnnnnn

SEQ ID NO: 164944 - DNA, 306 bp, Homo sapiens
  misc_feature: GYAE6OF02FFD6E.30.10.A10.1.454.CMB.1.raw
  modified_base (137)..(137): a, c, t, g, unknown or other
  misc_feature (137)..(137): n is a, c, g, or t
  modified_base (273)..(306): a, c, t, g, unknown or other
  misc_feature (273)..(306): n is a, c, g, or t
tcagcacgctacgtcacgaccggtgctcgatttagcgtcgatctcagggtcttcgtggctcacgtccaccaccacgcatgtgacctcaggggtcccgggagatcatggagggtgttccgtttggggtttgggggaanaggaagactcgaccggtccccccaggagttcaggtcgcgtggacacgacggccggccgtggctcgccgtagacaacggtacctacgtccgacgtagcgtgcgtcggacggtcggcgtacggacgacggcactagannnnnnnnnnnnnnnnnnnnnnnnnnnnnnnnnn

SEQ ID NO: 164945 - DNA, 250 bp, Homo sapiens; identical to SEQ ID NO: 164580
  misc_feature: GYAE6OF02H2ZJ9.30.10.A10.1.454.CMB.1.raw
  modified_base (245)..(250): a, c, t, g, unknown or other
  misc_feature (245)..(250): n is a, c, g, or t

SEQ ID NO: 164946 - DNA, 204 bp, Homo sapiens; identical to SEQ ID NO: 164422
  misc_feature: GYAE6OF02IJY7U.30.10.A10.1.454.CMB.1.raw
  modified_base (201)..(204): a, c, t, g, unknown or other
  misc_feature (201)..(204): n is a, c, g, or t

SEQ ID NO: 164947 - DNA, 219 bp, Homo sapiens
  misc_feature: GYAE6OF02IAAFV.30.10.A10.1.454.CMB.1.raw
  modified_base (203)..(219): a, c, t, g, unknown or other
  misc_feature (203)..(219): n is a, c, g, or t
tcagcacgctacgtcacgaccggtgctcgatttagcgtcgatctcaggggtccgggagatcatgagggtgtccttgggtttggggggaagaggaagactgacggtccccccaggagttcaggtgctgggcacagcggccctgggctgcctggtcaaggactacttccacgtagcgtgctgagcgggctggcaaggcgcatagnnnnnnnnnnnnnnnnn

SEQ ID NO: 164948 - DNA, 249 bp, Homo sapiens; identical to SEQ ID NO: 164638
  misc_feature: GYAE6OF02F96GR.30.10.A10.1.454.CMB.1.raw
  modified_base (246)..(249): a, c, t, g, unknown or other
  misc_feature (246)..(249): n is a, c, g, or t

SEQ ID NO: 164949 - DNA, 212 bp, Homo sapiens; identical to SEQ ID NO: 164671
  misc_feature: GYAE6OF02HGJ5A.30.10.A10.1.454.CMB.1.raw
  modified_base (204)..(212): a, c, t, g, unknown or other
  misc_feature (204)..(212): n is a, c, g, or t

SEQ ID NO: 164950 - DNA, 210 bp, Homo sapiens
  misc_feature: GYAE6OF02HVZA8.30.10.A10.1.454.CMB.1.raw
  modified_base (197)..(197): a, c, t, g, unknown or other
  misc_feature (197)..(197): n is a, c, g, or t
  modified_base (203)..(210): a, c, t, g, unknown or other
  misc_feature (203)..(210): n is a, c, g, or t
tcagcacgctacgtcacgaccggtgctcgatttagcgtcgatctcaggggtccgggagatcatgagggtgtccttgggttttggggggaagaggaagactgacggtcccccaggagttcaggtgctgggcacagcggccctgggctgcctggtcaaggactacttccacgtagcgtgctgagcgggctggcaaggcncatagnnnnnnnn

SEQ ID NO: 164951 - DNA, 213 bp, Homo sapiens
  misc_feature: GYAE6OF02JH6RT.30.10.A10.1.454.CMB.1.raw
  modified_base (202)..(213): a, c, t, g, unknown or other
  misc_feature (202)..(213): n is a, c, g, or t
tcagcacgctacgtcacgaccggtgctcgatttagcgtcgatctcaggggtccgggagatcatgagggtgtccttgggttttgggggaagaggaagactgacggtcccccaggagttcaggtgctgggcacagcggccctgggctgcctggtcaaggactacttccacgtagcgtgctgagcgggctggcaaggcgcatagnnnnnnnnnnnn

SEQ ID NO: 164952 - DNA, 260 bp, Homo sapiens
  misc_feature: GYAE6OF02JI2F7.30.10.A10.1.454.CMB.1.raw
  modified_base (246)..(260): a, c, t, g, unknown or other
  misc_feature (246)..(260): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttggggggaagaggaagactgacggtccccccaggagttcaggtgctgggcacagcggccctgggctgcctggtcaaggactacttccacgtagcgtgctgagcgggctggcaaggcgcatagnnnnnnnnnnnnnnn

SEQ ID NO: 164953 - DNA, 208 bp, Homo sapiens
  misc_feature: GYAE6OF02G7BDU.30.10.A10.1.454.CMB.1.raw
  modified_base (204)..(208): a, c, t, g, unknown or other
  misc_feature (204)..(208): n is a, c, g, or t
tcagcacgctacgtcacgaccggtgctcgatttagcgtcgatctcaggggtccgggagatcatgagggtgtccttgggttttggggggaagaggaagactgacggtccccccaggagttcaggtgctgggcacagcggccctgggctgcctggtcaaggactacttccacgtagcgtgctgagcgggctggcaaggcgcatagnnnnn

SEQ ID NO: 164954 - DNA, 230 bp, Homo sapiens
  misc_feature: GYAE6OF02JDVIF.30.10.A10.1.454.CMB.1.raw
  modified_base (201)..(230): a, c, t, g, unknown or other
  misc_feature (201)..(230): n is a, c, g, or t
tcagcacgctacgtcacgaccggtgctcgatttagcgtcgatctcaggggtccgggagatcatgagggtgtccttgggttttgggggaagaggaagactgacggtcccccaggagttcaggtgctgggcacagcggccctgggctgcctggtcaaggctacttccacgtagcgtgctgagcgggctggcaaggcgcatagnnnnnnnnnnnnnnnnnnnnnnnnnnnnnn

SEQ ID NO: 164955 - DNA, 207 bp, Homo sapiens
  misc_feature: GYAE6OF02H5847.30.10.A10.1.454.CMB.1.raw
  modified_base (204)..(207): a, c, t, g, unknown or other
  misc_feature (204)..(207): n is a, c, g, or t
tcagcacgctacgtcacgaccggtgctcgatttagcgtcgatctcaggggtccgggagatcatgagggtgtccttgggttttggggggaagaggaagactgacggtccccccaggagttcaggtgctgggcacagcggccctgggctgcctggtcaaggactacttccacgtagcgtgctgagcgggctggcaaggcgcatagnnnn

SEQ ID NO: 164956 - DNA, 246 bp, Homo sapiens
  misc_feature: GYAE6OF02GESJ2.30.10.A10.1.454.CMB.1.raw
  modified_base (236)..(236): a, c, t, g, unknown or other
  misc_feature (236)..(236): n is a, c, g, or t
  modified_base (241)..(246): a, c, t, g, unknown or other
  misc_feature (241)..(246): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggtttgggggaagaggaagactgacggtcccccaggagttcaggtgctgggcacagcggccctgggctgcctggtcaaggactacttccacgtagcgtgctgagcgggctggcaggcncatgnnnnnn

SEQ ID NO: 164957 - DNA, 257 bp, Homo sapiens
  misc_feature: GYAE6OF02IG9PK.30.10.A10.1.454.CMB.1.raw
  modified_base (246)..(257): a, c, t, g, unknown or other
  misc_feature (246)..(257): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttggggttttggggggaagaggaagacgtgacggtcccccaggagttcaggtgctgggcacagcggccctgggctgcctggtcaaggactacttccacgtagcgtgctgagcggctggcaaggcgcatagnnnnnnnnnnnn

SEQ ID NO: 164958 - DNA, 249 bp, Homo sapiens
  misc_feature: GYAE6OF02GY3ZL.30.10.A10.1.454.CMB.1.raw
  modified_base (244)..(249): a, c, t, g, unknown or other
  misc_feature (244)..(249): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttgggggaagaggaagactgacggtcccccagaagttcaggtgctgggcacagcggccctgggctgcctggtcaaggactacttccacgtagcgtgctgagcgggctggcaaggcgcatagnnnnnn

SEQ ID NO: 164959 - DNA, 209 bp, Homo sapiens
  misc_feature: GYAE6OF02HO3KE.30.10.A10.1.454.CMB.1.raw
  modified_base (202)..(209): a, c, t, g, unknown or other
  misc_feature (202)..(209): n is a, c, g, or t
tcagcacgctacgtcacgaccggtgctcgatttagcgtcgatctcaggggtccgggagatcatgagggtgtccttgggttttggggggaagaggaagactgacggtcccccaggagttcaggtgctgggcacagcggcctgggctgcctggtcaaggactacttccacgtagcgtgctgagcgggctggcaaggcgcatagnnnnnnnn

SEQ ID NO: 164960 - DNA, 213 bp, Homo sapiens
  misc_feature: GYAE6OF02H32VO.30.10.A10.1.454.CMB.1.raw
  modified_base (193)..(193): a, c, t, g, unknown or other
  misc_feature (193)..(193): n is a, c, g, or t
  modified_base (198)..(213): a, c, t, g, unknown or other
  misc_feature (198)..(213): n is a, c, g, or t
tcagcacgctacgtcacgaccggtgctcgatttagcgtcgatctcaggggtccgggagatcatgaggtgtccttgggtttgggggaagaggaagactgacggtcccccaggagttcaggtgctgggcacagcggccctgggctgcctggtcaaggactacgttccacgtagcgtgctgagcggctggcaggcnatagnnnnnnnnnnnnnnnn

SEQ ID NO: 164961 - DNA, 214 bp, Homo sapiens
  misc_feature: GYAE6OF02H944K.30.10.A10.1.454.CMB.1.raw
  modified_base (204)..(214): a, c, t, g, unknown or other
  misc_feature (204)..(214): n is a, c, g, or t
tcagcacgctacgtcacgaccggtgctcgatttagcgtcgatctcagggggtccgggagatcatgagggtgtccttgggttttgggggaagaggaagactgacggtccccccaggagttcaggtgctgggcacagcggccctgggctgcctggtcaaggactacttccacgtagcgtgctgagcgggctggcaaggcgcatagnnnnnnnnnnn

SEQ ID NO: 164962 - DNA, 251 bp, Homo sapiens
  misc_feature: GYAE6OF02G1C05.30.10.A10.1.454.CMB.1.raw
  modified_base (245)..(251): a, c, t, g, unknown or other
  misc_feature (245)..(251): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttgggggaagaggaagactgacggtccccccaggagttcaggtgctgggcacagcggccctgggctgcctggtcaaggactacttccacgtagcgtgctgagcgggctggcaaggcgcatagnnnnnnn

SEQ ID NO: 164963 - DNA, 211 bp, Homo sapiens
  misc_feature: GYAE6OF02HBOAJ.30.10.A10.1.454.CMB.1.raw
  modified_base (205)..(211): a, c, t, g, unknown or other
  misc_feature (205)..(211): n is a, c, g, or t
tcagcacgctacgtcacgaccggtgctcgatttagcgtcgatctcaggggtccgggagatcatgagggtgtccttgggttttggggggaaagaggaagactgacggtccccccaggagttcaggtgctgggcacagcggccctgggctgcctggtcaaggactacttccacgtagcgtgctgagcgggctggcaaggcgcatagnnnnnnn

SEQ ID NO: 164964 - DNA, 266 bp, Homo sapiens
  misc_feature: GYAE6OF02JNDSQ.30.10.A10.1.454.CMB.1.raw
  modified_base (246)..(246): a, c, t, g, unknown or other
  misc_feature (246)..(246): n is a, c, g, or t
  modified_base (251)..(266): a, c, t, g, unknown or other
  misc_feature (251)..(266): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttggggttttggggggaagaggaagactgacggtccccccaggacgttcgaggtgcctgggcacagccggccctgggctgcctggtccaaggctacttccacgtagcgtgctgacgcgggctggcaaggcncatgnnnnnnnnnnnnnnnn

SEQ ID NO: 164965 - DNA, 250 bp, Homo sapiens
  misc_feature: GYAE6OF02HKYUO.30.10.A10.1.454.CMB.1.raw
  modified_base (243)..(250): a, c, t, g, unknown or other
  misc_feature (243)..(250): n is a, c, g, or t
tcagcacgctacgtcacgaccggtgctcgatttagcgtcgatctcagggtcttcgtggctcacgtccaccaccacgcatgtgacctcaggggtccgggagatcatgaggtgtccttgggttttgggggaagaggaagactgacggtccccccaggagttcaggtgctgggcacagcggccctgggctgcctggtcaaggactacttccacgtagcgtgctgagcggctggcaaggcgcatagnnnnnnnn

SEQ ID NO: 164966 - DNA, 255 bp, Homo sapiens
  misc_feature: GYAE6OF02GK7IQ.30.10.A10.1.454.CMB.1.raw
  modified_base (246)..(255): a, c, t, g, unknown or other
  misc_feature (246)..(255): n is a, c, g, or t
tcagcacgctacgtcacgaccggtgctcgatttagcgtcgatctcagggtcttcgtggctcacgtccaccaccacgcatgtgacctcagggtccgggagatcatgagggtgtccttgggttttggggggaagaggaagactgacggtccccccaggagttcaggtgctgggcacagcggccctgggctgcctggtcaaggactacttccacgtagcgtgctgagcgggctggcaaggcgcgatagnnnnnnnnnn

SEQ ID NO: 164967 - DNA, 206 bp, Homo sapiens; identical to SEQ ID NO: 164680
  misc_feature: GYAE6OF02F6MJU.30.10.A10.1.454.CMB.1.raw
  modified_base (204)..(206): a, c, t, g, unknown or other
  misc_feature (204)..(206): n is a, c, g, or t

SEQ ID NO: 164968 - DNA, 256 bp, Homo sapiens
  misc_feature: GYAE6OF02F5TS5.30.10.A10.1.454.CMB.1.raw
  modified_base (246)..(256): a, c, t, g, unknown or other
  misc_feature (246)..(256): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttggggggaagaggaagactgacggtcccccaggagttcaggtgctgggcacagcggccctgggctgcctggtcaaggactacttccacgtagcgtgctgagcgggctgggcaaggcgcatagnnnnnnnnnnn

SEQ ID NO: 164969 - DNA, 208 bp, Homo sapiens; identical to SEQ ID NO: 164953
  misc_feature: GYAE6OF02G056X.30.10.A10.1.454.CMB.1.raw
  modified_base (204)..(208): a, c, t, g, unknown or other
  misc_feature (204)..(208): n is a, c, g, or t

SEQ ID NO: 164970 - DNA, 218 bp, Homo sapiens
  misc_feature: GYAE6OF02FPVN4.30.10.A10.1.454.CMB.1.raw
  modified_base (204)..(218): a, c, t, g, unknown or other
  misc_feature (204)..(218): n is a, c, g, or t
tcagcacgctacgtcacgaccggtgctcgatttagcgtcgatctcaggggtccgggagatcatgagggtgtccttgggttttggggggaagaggaagactgacggtccccccaggagttcaggtgctgggcacagcggccctgggctgcctggtcaaggactacttccacgtagcgtgctgagcgggctggcaaggcgcatagnnnnnnnnnnnnnnn

SEQ ID NO: 164971 - DNA, 258 bp, Homo sapiens
  misc_feature: GYAE6OF02IQTRK.30.10.A10.1.454.CMB.1.raw
  modified_base (246)..(258): a, c, t, g, unknown or other
  misc_feature (246)..(258): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttggggggaagaggaagactgacggtccccccaggagttcaggtgctgggcacagcggccctgggctgcctggtcaaggactacttccacgtagcgtgctgagcgggctggcaaggcgcatagnnnnnnnnnnnnn

SEQ ID NO: 164972 - DNA, 262 bp, Homo sapiens
  misc_feature: GYAE6OF02IFWU9.30.10.A10.1.454.CMB.1.raw
  modified_base (131)..(131): a, c, t, g, unknown or other
  misc_feature (131)..(131): n is a, c, g, or t
  modified_base (245)..(262): a, c, t, g, unknown or other
  misc_feature (245)..(262): n is a, c, g, or t
tcagcacgctacgtcacgaccggtgctcgatttagcgtcgatctcagggtcttcgtggctcacgtccaccaccacgcatgtgacctcagggtccgggagatcatgagggtgtccttgggtttggggggaanaggaagactgacggtccccccaggagttcaggtgctgggcacagcggccctgggctgcctggtcaaggactacttccacgtagcgtgctgagcgggctggcaaggcgacatagnnnnnnnnnnnnnnnnnn

SEQ ID NO: 164973 - DNA, 251 bp, Homo sapiens
  misc_feature: GYAE6OF02GOKL4.30.10.A10.1.454.CMB.1.raw
  modified_base (247)..(251): a, c, t, g, unknown or other
  misc_feature (247)..(251): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttggggggaagaggaagactgacggtccccccaggagttcaggtgcgtgggcacagcggccctgggctgcctggtcaaggactacttccacgtagcgtgctgagcgggctggcaaggcgcatagnnnnn

SEQ ID NO: 164974 - DNA, 267 bp, Homo sapiens
  misc_feature: GYAE6OF02F32AV.30.10.A10.1.454.CMB.1.raw
  modified_base (238)..(238): a, c, t, g, unknown or other
  misc_feature (238)..(238): n is a, c, g, or t
  modified_base (244)..(244): a, c, t, g, unknown or other
  misc_feature (244)..(244): n is a, c, g, or t
  modified_base (246)..(267): a, c, t, g, unknown or other
  misc_feature (246)..(267): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggtttggggggaagaggagactgacggtcccccaggagttcaggtgctgggcacagcggccctgggctgcctggtcaaggactacttccacgtagcgtgctgagcgggctggcaagggcncatagnannnnnnnnnnnnnnnnnnnnnn

SEQ ID NO: 164975 - DNA, 258 bp, Homo sapiens
  misc_feature: GYAE6OF02FP9D3.30.10.A10.1.454.CMB.1.raw
  modified_base (247)..(258): a, c, t, g, unknown or other
  misc_feature (247)..(258): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttgggttttggggggaagaggaagactgacggtccccccaggagttcaggtgctgggcacagcggccctgggctgcctggtcaaggactacttccacgtagcgtgctggagcgggctggcaggcgcgatagnnnnnnnnnnnn

SEQ ID NO: 164976 - DNA, 255 bp, Homo sapiens
  misc_feature: GYAE6OF02H2W8L.30.10.A10.1.454.CMB.1.raw
  modified_base (247)..(255): a, c, t, g, unknown or other
  misc_feature (247)..(255): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttggggttttggggggaagaggaagactgacggtccccccaggagttcaggtgctgggcacagcggccctgggctgcctggtcaaggactacttccacgtagcgtgctgagcgggctggcaaggcgcatagnnnnnnnnn

SEQ ID NO: 164977 - DNA, 210 bp, Homo sapiens
  misc_feature: GYAE6OF02HFBEJ.30.10.A10.1.454.CMB.1.raw
  modified_base (195)..(195): a, c, t, g, unknown or other
  misc_feature (195)..(195): n is a, c, g, or t
  modified_base (200)..(210): a, c, t, g, unknown or other
  misc_feature (200)..(210): n is a, c, g, or t
tcagcacgctacgtcacgaccggtgctcgatttagcgtcgatctcaggggtccgggagatcatgagggtgtccttgggttttgggggaagaggaagactgacggtcccccaggagttcaggtgctggcacagcggcctgggctgcctggtcaaggactacttccacgtagcgtgctgagcgggctggcaaggcgnatagnnnnnnnnnnn

SEQ ID NO: 164978 - DNA, 222 bp, Homo sapiens
  misc_feature: GYAE6OF02FJ6ND.30.10.A10.1.454.CMB.1.raw
  modified_base (202)..(222): a, c, t, g, unknown or other
  misc_feature (202)..(222): n is a, c, g, or t
tcagcacgctacgtcacgaccggtgctcgatttagcgtcgatctcaggggtccgggagatcatgagggtgtccttgggttttggggggaagaggaagactgacggtccccccaggagttcaggtgctggcacagcggccctgggctgcctggtcaaggactacttcacgtagcgtgctgagcgggctggcaaggcgcatagnnnnnnnnnnnnnnnnnnnnn

SEQ ID NO: 164979 - DNA, 215 bp, Homo sapiens
  misc_feature: GYAE6OF02FUQL2.30.10.A10.1.454.CMB.1.raw
  modified_base (204)..(215): a, c, t, g, unknown or other
  misc_feature (204)..(215): n is a, c, g, or t
tcagcacgctacgtcacgaccggtgctcgatttagcgtcgatctcaggggtccgggagatcatgagggtgtccttgggttttggggggaagaggaagactgacggtccccccaggagttcaggtgctgggcacagcggccctgggctgcctggtcaaggactacttccacgtagcgtgctgagcgggctggcaaggcgcatagnnnnnnnnnnnn

SEQ ID NO: 164980 - DNA, 215 bp, Homo sapiens; identical to SEQ ID NO: 164979
  misc_feature: GYAE6OF02GX2WA.30.10.A10.1.454.CMB.1.raw
  modified_base (204)..(215): a, c, t, g, unknown or other
  misc_feature (204)..(215): n is a, c, g, or t

SEQ ID NO: 164981 - DNA, 209 bp, Homo sapiens; identical to SEQ ID NO: 164655
  misc_feature: GYAE6OF02FU6FP.30.10.A10.1.454.CMB.1.raw
  modified_base (204)..(209): a, c, t, g, unknown or other
  misc_feature (204)..(209): n is a, c, g, or t

SEQ ID NO: 164982 - DNA, 227 bp, Homo sapiens
  misc_feature: GYAE6OF02HDR24.30.10.A10.1.454.CMB.1.raw
  modified_base (183)..(183): a, c, t, g, unknown or other
  misc_feature (183)..(183): n is a, c, g, or t
  modified_base (204)..(227): a, c, t, g, unknown or other
  misc_feature (204)..(227): n is a, c, g, or t
tcagcacgctacgtcacgaccggtgctcgatttagcgtcgatctcaggggtccgggagatcatgagggtgtccttgggttttggggggaagaggaagactgacggtccccccaggagttcaggtgctgggcacagcggccctgggctgcctggtcaaggactacttccacgtagcgtgctagngcggctggcaaggcgcatagnnnnnnnnnnnnnnnnnnnnnnnn

SEQ ID NO: 164983 - DNA, 303 bp, Homo sapiens
  misc_feature: GYAE6OF02JZOMD.30.10.A10.1.454.CMB.1.raw
  modified_base (272)..(273): a, c, t, g, unknown or other
  misc_feature (272)..(273): n is a, c, g, or t
  modified_base (275)..(303): a, c, t, g, unknown or other
  misc_feature (275)..(303): n is a, c, g, or t
tcagcacgctacgtcacgaccggtgctcgatttagcgtcgatctcagggtcttcgtggctcacgtccaccaccacgcatgtgacctcaggggtccgggagatcatgagggtgtccttggggttttggggggaagaggaagactggaccgggtccccccgaggagttcaggtgcgtgggccacgaggccggccctggggcctggcctgggtccaaggtaccttacttccgacgtaggcgtgctggagcgggcgtggaccaaggcgcaagtagnnannnnnnnnnnnnnnnnnnnnnnnnnnnnn

SEQ ID NO: 164984 - DNA, 251 bp, Homo sapiens
  misc_feature: GYAE6OF02H86KW.30.10.A10.1.454.CMB.1.raw
  modified_base (199)..(199): a, c, t, g, unknown or other
  misc_feature (199)..(199): n is a, c, g, or t
  modified_base (210)..(251): a, c, t, g, unknown or other
  misc_feature (210)..(251): n is a, c, g, or t
tcagcacgctacgtcacgaccggtgctcgatttagcgtcgatctcagggggtccgggagatcatgagggtgtccttgggttttggggggaagaggaagactgacggtccccccaggacgttcaggtgctgggcaacaggcggcccgtgggctgccgtggtcaaggactacttccaacgtagcgtgctgagcggctgganaggcgcatagnnnnnnnnnnnnnnnnnnnnnnnnnnnnnnnnnnnnnnnnnn

SEQ ID NO: 164985 - DNA, 288 bp, Homo sapiens
  misc_feature: GYAE6OF02FJUIM.30.10.A10.1.454.CMB.1.raw
  modified_base (246)..(288): a, c, t, g, unknown or other
  misc_feature (246)..(288): n is a, c, g, or t
tcagcacgctacgtcacgaccggtgctcgatttagcgtcgatctcagggtcttcgtggctcacgtccaccaccacgcatgtgacctcaggggtcccgggagatcatgagggtgtccttgggttttggggggaagaggaagactgacggtccccccaggagttcaggtgctgggcacagcggccctgggtgcctggtcaaggactacttcgacgtagcgtgctgagcgggctggcaggcgcatacgnnnnnnnnnnnnnnnnnnnnnnnnnnnnnnnnnnnnnnnnnnn

SEQ ID NO: 164986 - DNA, 254 bp, Homo sapiens
  misc_feature: GYAE6OF02IZNIV.30.10.A10.1.454.CMB.1.raw
  modified_base (244)..(254): a, c, t, g, unknown or other
  misc_feature (244)..(254): n is a, c, g, or t
tcagcacgctacgtcacgaccggtgctcgatttagcgtcgatctcagggtcttcgtggctcacgtccaccacacgcatgtgacctcaggggtccgggagatcatgagggtgtccttgggttttggggggaagaggaagactgacggtccccccaggagttcaggtgcgtgggcacagcggcctgggctgcctggtcaaggactacttccacgtagcgtgctgagcgggctggcaggcgcatagnnnnnnnnnnn

SEQ ID NO: 164987 - DNA, 292 bp, Homo sapiens
  misc_feature: GYAE6OF02F2DU8.30.10.A10.1.454.CMB.1.raw
  modified_base (265)..(292): a, c, t, g, unknown or other
  misc_feature (265)..(292): n is a, c, g, or t
tcagcacgctacgtcacgaccggtgctcgatttagcgtcgatctcagggtcttcgtggctcacgtccaccaccacgcatgtgacctcagggggtccgggagatcatgagggtgtccttggggttttggggggaagaggaagactgaccggtccccccaggagttcgaggtggtctgggacacaggccggccctgggctcgccgtggtcaaggactacttcccgacgtagcgtgcgtggaggcgggcgtggcaagggcgacatagnnnnnnnnnnnnnnnnnnnnnnnnnnnn

SEQ ID NO: 164988 - DNA, 231 bp, Homo sapiens
  misc_feature: GYAE6OF02IVQBG.30.10.A10.1.454.CMB.1.raw
  modified_base (206)..(231): a, c, t, g, unknown or other
  misc_feature (206)..(231): n is a, c, g, or t
tcagcacgctacgtcacgaccggtgctcgatttagcgtcgatctcaggggtccgggagatcatgagggtgtccttgggttttggggggaagaggaagactgacggtccccccaggagttcaggtgctgggcacagcggccctgggctgcctgggtcaaggctacttccacgtagcgtgctggagcgggctggcaaggcgacatagnnnnnnnnnnnnnnnnnnnnnnnnnn

SEQ ID NO: 164989 - DNA, 157 bp, Homo sapiens
  misc_feature: GYAE6OF01DE2E5.33.23.C01.1.454.CMB.1.raw
  modified_base (157)..(157): a, c, t, g, unknown or other
  misc_feature (157)..(157): n is a, c, g, or t
tcagtacacacactcacgaccggtgctcgatttagtacacgtgattagggatgggagggaccaaggtggagctcaaacgaactgtggctgcaccatctgtcttcatcttcccgccatctgaagtgtgtgtactgagcgggctggcaaggcgcatagn

SEQ ID NO: 164990 - DNA, 590 bp, Homo sapiens
  misc_feature: GYAE6OF01C8CMV.33.23.C01.1.454.CMB.1.raw
  modified_base (203)..(203): a, c, t, g, unknown or other
  misc_feature (203)..(203): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtctttgtctccaggggaaangccacctctcctgcagggccagtcagagtgctggcagcaacttagcctggtaaccaacaaaacctggaccagactccaggctcctcatctatgatgcatccacagggccactggcatcccagccaggttcagtggcaggtggtctgggacagacttcactctcaccatcagcagcctagacgcctagaagtatttgctagtttattacgtgtcagcaagtccgtagacctaacgttcggttacgtttgggaaccgttttcgggaccgaaaggggacccgtaaagggttcgggaaaaacttccgaaaaaccggtaacgttagggtacggtaccgttaggacccgtaacccgtaattcctagggttacccttttcgaacttttcccccg

SEQ ID NO: 164991 - DNA, 540 bp, Homo sapiens
  misc_feature: GYAE6OF01BNXTC.33.23.C01.1.454.CMB.1.raw
  modified_base (250)..(250): a, c, t, g, unknown or other
  misc_feature (250)..(250): n is a, c, g, or t
  modified_base (311)..(311): a, c, t, g, unknown or other
  misc_feature (311)..(311): n is a, c, g, or t
tcagtacacacactcacgaccggtgctcgatttagtacacgtgattagggtagttgggggaggaactgctcagttaggacccagagggaaccatggaagccccagctcagcttctcttcctcctgctactctggctcccagataccaccggagaagttgagttgacgcagtctccaggcaccctgtctttgtctctagggaagagccacctctcctgccagggccaatcagagtgtagctagcggacttntagcctgtaccagcagaaacctggcaggctccacggctcctctctatggtgcattccacgnggccactggcatcccagacaggttcagtgcagtgggtctgggacagacttcatctcaccatcagcagactggagtcctgaagttattttgctagtgttatactgtcagtctagtacggtattctacgtcgtacggacgttcggaccgaaggtacccaaggtacgaaacgtacgaaacgtacgtagtacggctacggtacaacctattccgtattccttcgtacttcccg

SEQ ID NO: 164992 - DNA, 569 bp, Homo sapiens
  misc_feature: GYAE6OF01CR038.33.23.C01.1.454.CMB.1.raw
  modified_base (203)..(203): a, c, t, g, unknown or other
  misc_feature (203)..(203): n is a, c, g, or t
  modified_base (369)..(369): a, c, t, g, unknown or other
  misc_feature (369)..(369): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccagccaccctgtctttgtctccaggggaaangccacctctcctgcagggccagtcagagtgctggcagcaacttagcctggtaaccaacaaaaacctggccagactcccaggcctcctcatctatgatgcatccacagggccactggcactcccagccaggttcaggtggcggtgggtctgggacagacttcactcncacatcagcagcctagacgcctagaagtattttgactagtttatacgtgtcagtcagtcgtagcgtaacgttgggttcttgggaccgtttcggaccgtaaaggggacctaaagggtgaaaacttacgaaaacgtaacgtggtaggccttaggacccaacgtattaccgttcgttacctttacacgttcccttacccccgg

SEQ ID NO: 164993 - DNA, 612 bp, Homo sapiens
  misc_feature: GYAE6OF01EFJMW.33.23.C01.1.454.CMB.1.raw
  modified_base (203)..(203): a, c, t, g, unknown or other
  misc_feature (203)..(203): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtctttgtctccaggggaaangccacctctcctgcagggccagtcagagtgctggcagcaacttagcctggtaccaacaaaacctggaccagactcccaggctcctcatctatgatgcatccaccacgggccactggcatcccagacaggttcagtggcaggtggatcgtgggacagtatttcactctcaccatcagcagtctgacaacctgaacgtatttgactaactttcttctagtaccaactactaacgtttaacaacttaccttaccccgttaactaccgtttttacgggacccgtaacgggggtaccctaacggtacgtacgggtaacgtaacgttacccggaacggtaccggtaaaccggttcgggttacgggtaccttacgggtaccctacccgttaagttccgttacggttcctttacccg

SEQ ID NO: 164994 - DNA, 560 bp, Homo sapiens
  misc_feature: GYAE6OF01D45J2.33.23.C01.1.454.CMB.1.raw
  modified_base (207)..(207): a, c, t, g, unknown or other
  misc_feature (207)..(207): n is a, c, g, or t
  modified_base (268)..(268): a, c, t, g, unknown or other
  misc_feature (268)..(268): n is a, c, g, or t
  modified_base (313)..(313): a, c, t, g, unknown or other
  misc_feature (313)..(313): n is a, c, g, or t
  modified_base (458)..(458): a, c, t, g, unknown or other
  misc_feature (458)..(458): n is a, c, g, or t
tcagtacacacactcacgaccggtgctcgatttagtacacgtgattagggattggggaggaactcgctcagttaggacccagagggaaccatggaagccccacgctcagcttctcttcctcctgctactctggctcccgagactaccaccggtagaagttgtgttgacgcagtctccaggcaccctgtctttgtctccgagggaaangccaccgtctcctgcagggccaatcgacgagtgttagcagtaacttagtctaggtaccaanatagacctgacctaggctccagctctcatctacgatgcgtcaacnggggccaacgtggcatcccgagccgaggttcagtcggacaggtgggtctgggacagacttcactctcacctagtcagactaacctagtaaccttgaagtactttttacgatttttactactgtacaacatcacgcagctggcctntcacgtttcggacggtacgggaccaaggtgacgtctacgaaacgtacgtgttacggtcttgccgtaccagttctagtctttacgatttccgtcccgctaacg

SEQ ID NO: 164995 - DNA, 519 bp, Homo sapiens
  misc_feature: GYAE6OF01BJGI0.33.23.C01.1.454.CMB.1.raw
  modified_base (262)..(262): a, c, t, g, unknown or other
  misc_feature (262)..(262): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtctttgtctccaggggaaagagccaccctctcctgcagggccaatcagagtgttagcagtaacttagtctggtaccaanatagacctgaccaggctcccaggctcctcatctacgatgcgtccaacagggccactggcactcccagccaggttcagtgcagtggtctgggacagacttcactctcaccatcagcaactagaacttgaagtatttttcattttattactgtacaactatcacgcagctggcctctctactttcggcggtaggaccgtaaggtgagctacgaaacgtactggtggctgcctacatctgtcttcattcctcccgctacg

SEQ ID NO: 164996 - DNA, 517 bp, Homo sapiens
  misc_feature: GYAE6OF01B4NBU.33.23.C01.1.454.CMB.1.raw
  modified_base (470)..(470): a, c, t, g, unknown or other
  misc_feature (470)..(470): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtctttgtctccaggggaaagagccaccctctcctgcagggccaatcagagtgttagcagtaacttagtctggtaccaacatagacctgaccaggctcccaggctcctcatctacgatgcgtccaacagggccactggcatcccagccaggttcagtggcagtgggtctgggacagacttcactctcaccatcagcaacctagaacttgaagtatttttacattttattacttgtacaacatcacgcagctggcctctctactttcggcggtagggaccaaggtgganctacgaaacgactgtggctgcaccatctgtcttcattcttcccgcta

SEQ ID NO: 164997 - DNA, 159 bp, Homo sapiens
  misc_feature: GYAE6OF01BAOVF.33.23.C01.1.454.CMB.1.raw
  modified_base (157)..(159): a, c, t, g, unknown or other
  misc_feature (157)..(159): n is a, c, g, or t
tcagtacacacactcacgaccggtgctcgatttagtacacgtgattagggatgggagggaccaaggtggagctcaaacgaactgtggctgcaccatctgtcttcatcttcccgccatctgaagtgtgtgtactgagcgggctggcaaggcgcatagnnn

SEQ ID NO: 164998 - DNA, 549 bp, Homo sapiens
  misc_feature: GYAE6OF01BUJES.33.23.C01.1.454.CMB.1.raw
  modified_base (147)..(147): a, c, t, g, unknown or other
  misc_feature (147)..(147): n is a, c, g, or t
  modified_base (398)..(398): a, c, t, g, unknown or other
  misc_feature (398)..(398): n is a, c, g, or t
  modified_base (528)..(528): a, c, t, g, unknown or other
  misc_feature (528)..(528): n is a, c, g, or t
  modified_base (545)..(545): a, c, t, g, unknown or other
  misc_feature (545)..(545): n is a, c, g, or t
  modified_base (547)..(548): a, c, t, g, unknown or other
  misc_feature (547)..(548): n is a, c, g, or t
tcagtacacacactcacgaccggtgctcgatttagtacacgtgattagggtagttgggggaggaactgctcagttaggacccagagggaaccatggaagccccagctcagcttctcttcctcctgctactctggctcccagggtaanagccaccctcgtcctgctagggcctagtcagagtgttagcgggtacctagcctggtaccaacagaggacctggccacggctcccaggctccgtcttctatgatgcatccaacgagggcccagtcggacaactaccccaggcccagggttccacggtggccggtggtctgggacaggacttcactcctacaccgatcagcagcctagcgcctgaagtatttgactagtttattacgtgtcagtcagtcgtancaagtggtacttggacgttcggacgaagggaccaaggtaggaatacgaaacgtactgttaggctgactacatctgtcttcacgttccgttcccgtctactcctagaacgtgtgtagtacgtgaggtcggngtggcaaggcacatagntnnc

SEQ ID NO: 164999 - DNA, 532 bp, Homo sapiens
  misc_feature: GYAE6OF01DZ7ND.33.23.C01.1.454.CMB.1.raw
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (444)..(444): a, c, t, g, unknown or other
  misc_feature (444)..(444): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtctttgtctcaggggaaangccaccctntcatgcagggccagtcagagtattagcatcttctggcctggtaccaacagaaacctggccaggctcccaggctcctcatccagaatgcattcaacgagggccactggcactcccagccaggttcagtggcaggtgggtctgggacagcttcactctcacatcagcagcctagacgcctgagtattctgtctagtttattactgtcagcagcgtctcactcgggtcctccgtcnctacccgttcggaccaacgggaccacggtagttcggaagtagttacgaacgtaacgttggtcggacctggaccctaccgtcgttacgg

SEQ ID NO: 165000 - DNA, 522 bp, Homo sapiens
  misc_feature: GYAE6OF01EHSYZ.33.23.C01.1.454.CMB.1.raw
  modified_base (208)..(208): a, c, t, g, unknown or other
  misc_feature (208)..(208): n is a, c, g, or t
  modified_base (495)..(495): a, c, t, g, unknown or other
  misc_feature (495)..(495): n is a, c, g, or t
tcagtacacacactcacgaccggtgctcgattttagtacacgtgattagggagtttgggggaggaactgctcagttaggacccagagggaaccatggaagccccagctcagcttctcttcctcctgctactctggctcccagataccaccggagaagttgtgttgacgcagtctccaaggcaccctgtctttgtctccaggggaaagngccaccctctcctgcagggccaatcagagtgttagcagtaacttagtctggtaccaacatagacctgaccaggctcccaggctcctcatctacgatgcgtccaacgagggcccactggcatcccagccaggttcagtgcagtggtctgggacagacttcactctcaccatcagcaacctagaacttgaatattttgctagtttattactgtctgcagcgtagcaactggacctaacgaccttcggccaagggacacgactaggagaattaaacgactgtggctgacnccatctgtcttacattcctcccgctac

SEQ ID NO: 165001 - DNA, 563 bp, Homo sapiens
  misc_feature: GYAE6OF01A3QEF.33.23.C01.1.454.CMB.1.raw
  modified_base (203)..(203): a, c, t, g, unknown or other
  misc_feature (203)..(203): n is a, c, g, or t
  modified_base (314)..(314): a, c, t, g, unknown or other
  misc_feature (314)..(314): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtctttgtctccaggggaaangccaccctctcctgcagggccaatcagagtgttagcagtaacttagtctggtaccaacatagacctgaccaggcctcccgaggcctcctcatctacgatcgcgtccaacgngggccacgtggccatcccagccaggttcagtggcaggtgggtctgggacagacttcactctcaccatcagcctaactagtaacttagaagttatttttactatttttaacttactgttacaactatcacggtcagtctcggccttctctacgtttcgggcggtaacgggacctaagggtcgacgtcctacgtaaacgacgttggcggctagcaccgtattctgttccttcacttcccgttcccgctacg

SEQ ID NO: 165002 - DNA, 483 bp, Homo sapiens
  misc_feature: GYAE6OF01D2Q0A.33.23.C01.1.454.CMB.1.raw
  modified_base (438)..(438): a, c, t, g, unknown or other
  misc_feature (438)..(438): n is a, c, g, or t
  modified_base (456)..(456): a, c, t, g, unknown or other
  misc_feature (456)..(456): n is a, c, g, or t
  modified_base (461)..(461): a, c, t, g, unknown or other
  misc_feature (461)..(461): n is a, c, g, or t
  modified_base (478)..(478): a, c, t, g, unknown or other
  misc_feature (478)..(478): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggagaaagagccaccctctcatgcagggccagtcagagtattagcatcttcttggcctggtaccaacagaaacctggccaggctccaggctcctcatccagaatgcattcaacagggccactggcactcccagccaggttcagtggcaggtggtctgggacagactcactctcaccatcagcagcctagacgccctgaggattctgctagtttattactgtcagcagcgtctcactgcctcgnctacgtcgcaggacacgntggantagacgagtgtgctgcncctcg

SEQ ID NO: 165003 - DNA, 529 bp, Homo sapiens
  misc_feature: GYAE6OF01DA1OM.33.23.C01.1.454.CMB.1.raw
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtctttgtctccaggggaaagagccaccctctcctgcagggccaatcagagtgttagcagtaacttagtctggtaccagcagaaacctggccaggctcccaggctcctcctctatggtgcactccaccagggccactggcatcccagacaggttcagtggcagtgggtctgggacagacttcactctcaccatcgacagactggacgcctagaagtatttgctagtttattactgtcagcagcgtagctaacgtggtcttgggacgttcggaccgaagggaccaagggtacggaaatacgaaacgactggtcggctgacacatctgttcttacattcctcccgctac

SEQ ID NO: 165004 - DNA, 517 bp, Homo sapiens
  misc_feature: GYAE6OF01AW578.33.23.C01.1.454.CMB.1.raw
  modified_base (495)..(495): a, c, t, g, unknown or other
  misc_feature (495)..(495): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtctttgtctccaggggaaagagccaccctctcctgcagggccaatcagagtgttagcagtaacttagtctggtaccaacatagacctgaccaggctcccaggctcctcatctacgatgcgtccaacgacgggccactggcatccccagccaggttcagtggcagtgggtctgggacagacttcactctcaccatcagcaacctagaacttgaagtatttttcattttattactgtcaacatcacgcagctggcctctcactttcggcggtaggaccaagggtgagctacgaaacgtactgtcggctgcaccntctgtcttcatccttccgctac

SEQ ID NO: 165005 - DNA, 523 bp, Homo sapiens
  misc_feature: GYAE6OF01DOJKY.33.23.C01.1.454.CMB.1.raw
  modified_base (203)..(203): a, c, t, g, unknown or other
  misc_feature (203)..(203): n is a, c, g, or t
  modified_base (371)..(371): a, c, t, g, unknown or other
  misc_feature (371)..(371): n is a, c, g, or t
  modified_base (508)..(508): a, c, t, g, unknown or other
  misc_feature (508)..(508): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtctttgtctccaggggaaanagccaccctctcctgcagggccaatcagagtgttagcagtaacttagtctggtaccaacatagacctgaccaggctccaggctcctcatctacgatgccgtccaacgagggcccacgtggcatccccagccaggttcagtgcagtgggtctgggacagacttcactcncaccatcagcaacctagtaacttgaagttatttttcatttttattactgtacaactatcacgcagctggcctctctacgtttcggcggtaggaccgaggtggagctacaacgactggtgctgcaccatctgtccttnacttcctcccgctac

SEQ ID NO: 165006 - DNA, 156 bp, Homo sapiens
  misc_feature: GYAE6OF01B80FI.33.23.C01.1.454.CMB.1.raw
tcagtacacacactcacgaccggtgctcgatttagtacacgtgattagggatgggagggaccaaggtggagctcaaacgaactgtggctgcaccatctgtcttcatcttcccgccatctgaagtgtgtgtactgagcgggctggcaaggcgcatag

SEQ ID NO: 165007 - DNA, 551 bp, Homo sapiens
  misc_feature: GYAE6OF01DLVI2.33.23.C01.1.454.CMB.1.raw
  modified_base (204)..(204): a, c, t, g, unknown or other
  misc_feature (204)..(204): n is a, c, g, or t
  modified_base (454)..(454): a, c, t, g, unknown or other
  misc_feature (454)..(454): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtctttgtctccgaggggaaangccaccctctcctgcagggccaaatcagagtgttagcagtaacttagtctggtaccaacatagacctgaccaggctcccaggcctcctcatctacgatgccgtaccaacgacgggccacgtggcactccccagcctaggttcaggtcggcaggtgggtctggggacagtacttcactctcaccatcagcaacctagaacttgaatatttttcaatttttatactgtacaacattcacgcagctggccttntctacgtttcggcggtaggaccaagggtcgagctacgaaacgtactgtcggctgaccacctattctgttccttacgacctttccttccccgcttacg

SEQ ID NO: 165008 - DNA, 540 bp, Homo sapiens
  misc_feature: GYAE6OF01CKPC1.33.23.C01.1.454.CMB.1.raw
  modified_base (358)..(358): a, c, t, g, unknown or other
  misc_feature (358)..(358): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtctttgtctccaggggaaagagccaccctctcctgcagggccaatcagagtgttagcagtaacttagtctggtaccaacatagacctgaccaggctcccaggctcctcatctacgatgcgtccaacagggccacgtggcatcccagccaggttcagtggcagtgggtctgggacngacttcactctcaccatcagcaacctagaacttagaagtatttttcattttattactgtacactatcacgcagctcggcctctcacgtttcggaccgggtagggaccgaagggtggacgacgtacgaaacgacgtggtcggtctagccgacctagtctgtccttcacttccttcccgctacg

SEQ ID NO: 165009 - DNA, 715 bp, Homo sapiens
  misc_feature: GYAE6OF01B5MH1.33.23.C01.1.454.CMB.1.raw
tcagtacacacactcacgaccggtgctcgatttagtacacgtgattagggagttgggggaggaactgctcagttagggacccagagggaaccatggaagcccagctcagcttctcttcctcctgtctactctggctccgagactaccgaccggagaaggttaggtgttggacgcagtctcagctacctgtcttgtctccgaagggaacacgccacctctcctgcgacgggccaatcagagtcgtagacaagtaacttacgactacggtacaactatacgactagaaccaggcctacccgaggtcctccgtacactacctaacggacttacgaccgttaccaaacgacggggacccaacggtacggacctaacgtccccggaacggcccggtaagggttaccaagggtcggtacgtaacggtttcggggtaccggtaacgggggaacccaaggttaccctttccaacccgttcctacctaacccgaagtcccaaacgaacccgtaaaccgtagtaaacctttcggtaaccgttacttttttacgaatttttaactacgtacgttacaaactagtccaacggtcaggactcggacctcgtccgtaccgttcgggacggaacgggtaccagggttacgaactacctaccgtaaaacggcgttgggacgtctacggacctaaccgtgtcgtagttacctacgtactccgttccgctacg

SEQ ID NO: 165010 - DNA, 549 bp, Homo sapiens
  misc_feature: GYAE6OF01CXKK7.33.23.C01.1.454.CMB.1.raw
  modified_base (206)..(206): a, c, t, g, unknown or other
  misc_feature (206)..(206): n is a, c, g, or t
tcagtacacacactcacgaccggtgctcgatttagtacacgtgattagggattgggggaggaactgcgggtcagttaggacccagagggaaccatggaagccccagctcagcttctcttcctcctgctactctggctcccagataccaccggggaaattgtgttgacacagtctccagccaccctgtctttgtctccaggggaaangccaccctctcctgcagggccagtcagagtgctggcagcaaacttagcctggtaaccaaacaaaaacctggaccagactcccaggctcctcatctatgatgcatccaccaggccactggcatcccagccaggttcagtgcagtggtctgggacagactcactctcaccatcagcagcctagagcctagaagtattttgactagttttatactgtctgcagcgtagcaaactggaccctaaacgcccttacggacctaaagggccaacggaactgggaagtagttaaaaaccgaacttaggtcggccttagaccaaccacttactagttccttcaactttcccg

SEQ ID NO: 165011 - DNA, 528 bp, Homo sapiens
  misc_feature: GYAE6OF01CL2Y1.33.23.C01.1.454.CMB.1.raw
  modified_base (310)..(310): a, c, t, g, unknown or other
  misc_feature (310)..(310): n is a, c, g, or t
  modified_base (345)..(345): a, c, t, g, unknown or other
  misc_feature (345)..(345): n is a, c, g, or t
  modified_base (369)..(369): a, c, t, g, unknown or other
  misc_feature (369)..(369): n is a, c, g, or t
  modified_base (373)..(373): a, c, t, g, unknown or other
  misc_feature (373)..(373): n is a, c, g, or t
  modified_base (419)..(419): a, c, t, g, unknown or other
  misc_feature (419)..(419): n is a, c, g, or t
tcagtacacacactcacgaccggtgctcgatttagtacacgtgattagggattggggggaggaactgctcagttaggacccagagggaaccatggaagccccagctcagcttctcttcctcctgctactctggctcccagataccaccggagaagttgtgttgacgcagtctccaggcaccctgtctttgtctccaggggaaagagccaccctctcctgcagggccaatcagagtgttagcagttaacttagtctaggtaccaacatagacctgaccaggctccagctctcatcacgatgcgtccaacgngggccacgtggcactcccagccaggttcagtggcngtggtctgggacagacttcactcncacntcagacaactagacttgaattattttacattttatactgtacaacntcacgcagtctgcctctcacgtttcggacggaggaccgaggtcggacgctacaaacgtacgtgtacggctagcctacagttctgttcttacattcccttcccgcctacg

SEQ ID NO: 165012 - DNA, 545 bp, Homo sapiens
  misc_feature: GYAE6OF01C3RZY.33.23.C01.1.454.CMB.1.raw
  modified_base (147)..(147): a, c, t, g, unknown or other
  misc_feature (147)..(147): n is a, c, g, or t
  modified_base (335)..(335): a, c, t, g, unknown or other
  misc_feature (335)..(335): n is a, c, g, or t
  modified_base (470)..(470): a, c, t, g, unknown or other
  misc_feature (470)..(470): n is a, c, g, or t
  modified_base (541)..(542): a, c, t, g, unknown or other
  misc_feature (541)..(542): n is a, c, g, or t
  modified_base (544)..(545): a, c, t, g, unknown or other
  misc_feature (544)..(545): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccgaggggaaanagcccaccctctcctgcagggccagtcagagtgttagcgggtacctagcctggtaccaacagagacctggccaggcctcccaggccttcctcttctatgatgcatccaaacgagggccatggcactcccagccaggttcagtggcggtggtcgtgggacagacttcactctcaccatcagcagctagnctagaagtattttgactagttattactgtcagcagcgtaagctaaacgttggtcttgggtacgttcggaccgaagggaccgaaaggtaggaaaactacgaaaacgtactggtcggactagccacatctgttctcncttcctcccgacatcgtagagttgtgtcgtactggtacggcgggtgtcgggacgaagggtccgacgatagnngnn

SEQ ID NO: 165013 - DNA, 610 bp, Homo sapiens
  misc_feature: GYAE6OF01B6YW4.33.23.C01.1.454.CMB.1.raw
  modified_base (203)..(203): a, c, t, g, unknown or other
  misc_feature (203)..(203): n is a, c, g, or t
  modified_base (261)..(261): a, c, t, g, unknown or other
  misc_feature (261)..(261): n is a, c, g, or t
  modified_base (313)..(313): a, c, t, g, unknown or other
  misc_feature (313)..(313): n is a, c, g, or t
  modified_base (384)..(384): a, c, t, g, unknown or other
  misc_feature (384)..(384): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtctttgtctccaggggaaangccaccctctcctgcagggccaatcagagtgttagcagtaacttagtctggtaccaanatagacctgaccaggcctcccaggctcctcatcctacgatgccgtccaacgngggcccagtggacactccccagccaggttcagtggcaggtgggtctggggacagacttcacttctacaccntacagaccaacctagaacttagaagttatttttactaattttacttactgtactaacatacgacggctagccgtacggcccttcttaccgtaccgtttccgggaccgggtaacgggtaccgaagggttcggacgaccttaacgaaaaccggtacgttaggacggtctaggaccctacctacgttaccgtcgttacctttccaactttccccgttcccgccgtaacg

SEQ ID NO: 165014 - DNA, 752 bp, Homo sapiens
  misc_feature: GYAE6OF01C4IRO.33.23.C01.1.454.CMB.1.raw
  modified_base (202)..(202): a, c, t, g, unknown or other
  misc_feature (202)..(202): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtctttgtctccaggggaanagccaccctctcctgcagggccaatcagagtgttagcagtaacttagtctaggtaccaacatagacctgacctagacgtcctaccgagtcctcctactactaccgaactcgtccgtacccgtaacccgaacggaccggaccctacggtcgacctacctacccgacgacggtacgtacgtaggtcgacggtagggttcggtacgggacggacgtaacgttcctacctacgtcctaccactactacgaccgtaacctaaacgtaacgtacgttaaggtaacttttttccgtttaatttttaacttttaacttacggttacaacccttaaacgtacgttacccgaccggtacgtacgttccggtacccgtttaccctttacgtaacccgttttaccgggtacgggggaaccggggtacccgggaaacggttaggggacgtaacttacccggtaaaaccggaaaaccggttcggtcgggtacggtaccgttacggaccctaacgttccgttcgtttaccgtttaccctagttccccttcccccggttcctaccg

SEQ ID NO: 165015 - DNA, 543 bp, Homo sapiens
  misc_feature: GYAE6OF01BHP0K.33.23.C01.1.454.CMB.1.raw
  modified_base (202)..(202): a, c, t, g, unknown or other
  misc_feature (202)..(202): n is a, c, g, or t
  modified_base (312)..(312): a, c, t, g, unknown or other
  misc_feature (312)..(312): n is a, c, g, or t
  modified_base (440)..(440): a, c, t, g, unknown or other
  misc_feature (440)..(440): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtctttgctccaggggaaangccaccctctcctgcagggccaatcagagtgttagcagtaacttagtctggtaccaacatagacctgaccaggcctcccaggcctcctcatctacgatgccgtccaacgngggccacgtggcactccccagccaggttcagtggcagtgggtctgggacagacttcactctacacatcagcaactagaacttgaagtatttttcattttactactgtcaactatcacgcagctgcctntcgtacttcggcggtaggaccaagggtggactcgtacgaacgtacgtgtacggctaggccacctattccgttgttcccttacacttcccttcccgccttaacg

SEQ ID NO: 165016 - DNA, 558 bp, Homo sapiens
  misc_feature: GYAE6OF01BZFC2.33.23.C01.1.454.CMB.1.raw
  modified_base (204)..(204): a, c, t, g, unknown or other
  misc_feature (204)..(204): n is a, c, g, or t
  modified_base (459)..(459): a, c, t, g, unknown or other
  misc_feature (459)..(459): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtctttgtctccaggggaaagngccaccctctcctgcagggccaatcagagtgttagcagtaacttagtctggtaccaacatagacctgaccaggcctcccgaggcctcctcatctacgatcgcgtaccaacgacgggccacgtggccactcccagccaggttcaggtggcgaggtggggtctggggacaggtaccttcactctcaccatcagacaactagaacttgaattatttttacattttatactagtacaactatcgacgtcagtctgcctntcctacgtttccggacggtaggacctagggtcgagcctacgaaacgtcgtggtacggctgacctactagtcttcgtccttacacttccctcccgcctag

SEQ ID NO: 165017 - DNA, 537 bp, Homo sapiens
  misc_feature: GYAE6OF01C6Q7R.33.23.C01.1.454.CMB.1.raw
  modified_base (201)..(201): a, c, t, g, unknown or other
  misc_feature (201)..(201): n is a, c, g, or t
  modified_base (434)..(434): a, c, t, g, unknown or other
  misc_feature (434)..(434): n is a, c, g, or t
  modified_base (511)..(511): a, c, t, g, unknown or other
  misc_feature (511)..(511): n is a, c, g, or t
  modified_base (514)..(514): a, c, t, g, unknown or other
  misc_feature (514)..(514): n is a, c, g, or t
  modified_base (517)..(517): a, c, t, g, unknown or other
  misc_feature (517)..(517): n is a, c, g, or t
  modified_base (534)..(534): a, c, t, g, unknown or other
  misc_feature (534)..(534): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcacctgtcttgtctcaggggaaagngccacctctcctgcagggccaatcagagtgttagcagttaactagtctggtaccaacatagacctgaccaggcctcccaggctcctcactctacgatcgccgtaccgaacgacgggcccacgtggccactccccagccaggttcagtggcaggtgggtctgggacagacttcactctcacatcacgcaacctagaacttgtaagtatttttcatttttactacttgtactaanatcgacgcagctcgcctctctacgtttcgggcggtacgggacctaagggtgacgctacgaaacgacgtgtggctgcnccntcngttctcactcctcccgntac

SEQ ID NO: 165018 - DNA, 529 bp, Homo sapiens
  misc_feature: GYAE6OF01DLWQ2.33.23.C01.1.454.CMB.1.raw
  modified_base (202)..(202): a, c, t, g, unknown or other
  misc_feature (202)..(202): n is a, c, g, or t
  modified_base (383)..(383): a, c, t, g, unknown or other
  misc_feature (383)..(383): n is a, c, g, or t
  modified_base (526)..(526): a, c, t, g, unknown or other
  misc_feature (526)..(526): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctccagataccaccggagaagttgtgttgacgcagtctccagccaccctgtctttgtctccaggggaaangccaccctctcctgcagggccagtcagagtgctggcagctaacttagcctggtaaccaaacaaaaacctggaccagacctcccaggcctcctcatctatgatgcatccaccgagggccacgtggacactccccgagccctaggttcaggtggcaggttgggtctgggacagacttcactcncaccatcagcacgcctaagacgtcctagaagtatttgacttagtttattactgtctgcagtcgtagactacgtcgacctaacgtccgttacgaccgaggacacgactggagtataaacgatggtcgctgactacatctctctntac

SEQ ID NO: 165019 - DNA, 544 bp, Homo sapiens
  misc_feature: GYAE6OF01BO9PH.33.23.C01.1.454.CMB.1.raw
  modified_base (513)..(513): a, c, t, g, unknown or other
  misc_feature (513)..(513): n is a, c, g, or t
  modified_base (533)..(533): a, c, t, g, unknown or other
  misc_feature (533)..(533): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtctttgtctccaggggaaagagccaccctctcctgcagggccaatcagagtgttagcagtaacttagtctggtaccaacatagacctgaccaggctcccaggctcctcatctacgatgcgtccaacgagggccactggcactccccagcccaggttccaggtggcagtggggtctggggacagacttcacttctcaccatcagcagactggacgccgtagaagtatttgctagtgtattactgtcagtacagttacggtagttcatccgtccgtacgttccggaccgtaacgggaccaaggtagaaagtacgaaacgtaacgtggtcggntgcaccatctcgttcttacncttcctcccgc

SEQ ID NO: 165020 - DNA, 693 bp, Homo sapiens
  misc_feature: GYAE6OF01CRUW8.33.23.C01.1.454.CMB.1.raw
  modified_base (201)..(201): a, c, t, g, unknown or other
  misc_feature (201)..(201): n is a, c, g, or t
  modified_base (292)..(292): a, c, t, g, unknown or other
  misc_feature (292)..(292): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctccagataccaccggagaaattgtgttgacacagtctccggccaccctgtctttgctccgaggggaangccaccctctcctgcagggccagtcagagtgttagcgggtacctagcctggtaccaacagacgactggccaggcctccgaggctcctcttntatgatgctatccaacgacgggccacgtcggactacgtcccagccgtaggttcagggtcggcggggttcggtcgtacggggactacggtacttaccgaccgtcctccaacctagtccgaacggtaccacgtccgttaaggaccggtacccgtaaggtaaacggtttacgttttacggtaccgtttaagttttaacttaacgttcgttacgtacggaccgtaggtacgttacgtaccgtaacgttcgggtttacgttacgggttaaccgggttcggaaccgtaaacggggtaaccgtaaaggggtacgttaaacgtaccgaaaacggtaacgtacggtaggaccgtcgaccacctgttccgtacgttctttacgactttacccgtcccgtcctagttaccgg

SEQ ID NO: 165021 - DNA, 571 bp, Homo sapiens
  misc_feature: GYAE6OF01B2VDO.33.23.C01.1.454.CMB.1.raw
  modified_base (203)..(203): a, c, t, g, unknown or other
  misc_feature (203)..(203): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtctttgtctccaggggaaanagccaccctctcctgcagggccaatcagagtgttagcagtacttagtctggtaccaacagaaacctggccaggctcccaggcctcctcatccagaatgcattcaacagggccacgtggcactcccagccaggttcagtggcaggtgggtctgggacagacttcactctcaccatcagcagcctagacgcctgacggtattctgactagtttatactgtactagcagtcgtctactaacgtcggtccctccggtgtcctacccgttcggaccgtaacgggacctacggtacgttacgggaagtacgttaacggaaccggtaacgtggttacgggaccttggtccctacccgttcgttcgttccttaccg

SEQ ID NO: 165022 - DNA, 830 bp, Homo sapiens
  misc_feature: GYAE6OF01B2FWD.33.23.C01.1.454.CMB.1.raw
  modified_base (264)..(264): a, c, t, g, unknown or other
  misc_feature (264)..(264): n is a, c, g, or t
tcagtacacacactcacgaccggtgctcgatttagtacacgtgattagggagttgggggaggaactgctcagttaggacccagagggaaccatggaagccccagctcagcttctcttcctcctgctactctggctcccagataccaccggagaagttgtgttgacgcagtctccaggcaccctgtctttgtctccgaggggaaagcgccaccctctcctgcagggccaatcagagtgttagcagtaacttagtctggtaccaanatagacctgaccaggcctcccaggcctcctcatctacgatcgcgtaccaacgacgggcccacgtcggcctaacgtcccccgaaggccctaagggttccaagggttcgggaccgtaggttcgggggtaccgttacggggggaacctaacgggtaaccctttaccgaacccgtttcctacccgtaaccccgtaattacccgaaacggtacctaaaacccgttaaggtaaaccgttttaggtaaacgtttaactttttttaccgtaaactttttttaaccgttaaccgtttagttaaccctaaacgttacgttaccgaaccgggtacctaacggttcccggtcggtacccctttacgtacccgtttaaccggttttaccgggggaccggggttaacgggggtaacccctaaagggggttacgggtaacggtacccgttaaaccgtaaaaaccgggtaaccgttggggttaaccggtacccgttacgggacccctaaacccgtaacgtttcccgttaaccggttccctttacccgaaccttttccccgttcccccggtacccgtttaacg

SEQ ID NO: 165023 - DNA, 857 bp, Homo sapiens
  misc_feature: GYAE6OF01BQDGQ.33.23.C01.1.454.CMB.1.raw
  modified_base (480)..(480): a, c, t, g, unknown or other
  misc_feature (480)..(480): n is a, c, g, or t
tcagtacacacactcacgaccggtgctcgatttagtacacgtgattagggattgggggaggaactgctcagttaggacccagagggaaccatggaagccccagctcagtcttctcttcctctgctactcgtgcctccagactaccgacggagtagttgtgttgacgcagtcctcgaggcctaccttgttctttcgtcctaccgggaaagggggaaacgccgaccctacccttccgtccgtcggaccggaccggaactaacgtacgaaggtaggttaggtacgaactaacgtttaacgttacgttcggtaaccggtaaaccaaactaacgtaccgtaaccgtacgaaccggacgtaccctacccggacgttccttacctactacttaccgaacgtcgtaccggtacccgtaaaccgaacgggaccgggtacctacgggtacgacctaaccgtaccccgaacgtaccgggttacgttaacgngggtaccgacggtacggggttcggtaccgggtacgggaacctacggtttaccttacttacttacccgaaccaactactacgacgtacgaacggtcgcgggaccttacgaaggttaagttttcgtacgagttaacgttgtttaacttcggtagtaccgaaggttcgggttaaggttaaccggtttcaacgttacccgttttaccggaacccgggtttaccgggtacccggaaaacgggtaacgggtaaacccgggttaagggtaaaaccgtaaaccgtaaaacccggaaacggtttaaggtcgggtacgtacctacggaaccctaaacgttgttaccgtttacgttacccttacgttaacctttccccggccctaaac

SEQ ID NO: 165024 - DNA, 523 bp, Homo sapiens
  misc_feature: GYAE6OF01D6MZ1.33.23.C01.1.454.CMB.1.raw
  modified_base (204)..(204): a, c, t, g, unknown or other
  misc_feature (204)..(204): n is a, c, g, or t
  modified_base (305)..(305): a, c, t, g, unknown or other
  misc_feature (305)..(305): n is a, c, g, or t
  modified_base (365)..(365): a, c, t, g, unknown or other
  misc_feature (365)..(365): n is a, c, g, or t
  modified_base (415)..(415): a, c, t, g, unknown or other
  misc_feature (415)..(415): n is a, c, g, or t
  modified_base (422)..(422): a, c, t, g, unknown or other
  misc_feature (422)..(422): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtctttgtctccaggggaaagngccaccctctcctgcagggccaatcagagtgttagcagtaacttagtctggtaccaacatagacctgacaggctccagctctcatcacgatgcgtcaacgngggccacgtggcatcccagccaggttcagtggcaggtgggtctgggacagacttcactcncacatcagacaactagaacttgaagtattttctattttatactgtacatntcacgcngctcgcctctctacgttcggcggtaggaccgaaggtggacgctaacgaaacgactggagtcgtgactacgattctgttaccttacattccctcccgctacg

SEQ ID NO: 165025 - DNA, 758 bp, Homo sapiens
  misc_feature: GYAE6OF01DM4I7.33.23.C01.1.454.CMB.1.raw
  modified_base (204)..(204): a, c, t, g, unknown or other
  misc_feature (204)..(204): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtctttgtctccgaggggaaancgccaccctctcctgcagggccagtcagagtgctggcagcaacttgcctggaaccaaacaaaacctggaccagacctcccaggcctcctcatctatgatgcactcccaccgacgggccacgtcggcctactccccgagccctaggttccaggtcggccgtaggtcggggtcgttaggggaactaggtaccttccaccgtttcctaccgaaccctactacgacgcctaacggtccctaaggacgtcccgttaaggtaaacgttacgtttttggaccgtttaagtttttacgtttaaccgttcggttaccgttggaccgtaacgggtccggtttaacggaacccgtaacggtttacccgggtacccctttaaaacccgtaccccgggttttaccgggaaccccggtaacggggaacccgtaaaccgggtaaccggttaacggggaaacgttaaaccggtttaaaaacccgggaacgtttgggtaccgggtaccgttacggaaccccgttaaccttaacgttacccggttttacgttaccccgtttacgtaaccccg

SEQ ID NO: 165026 - DNA, 521 bp, Homo sapiens
  misc_feature: GYAE6OF01CL22P.33.23.C01.1.454.CMB.1.raw
  modified_base (203)..(203): a, c, t, g, unknown or other
  misc_feature (203)..(203): n is a, c, g, or t
  modified_base (403)..(403): a, c, t, g, unknown or other
  misc_feature (403)..(403): n is a, c, g, or t
  modified_base (420)..(420): a, c, t, g, unknown or other
  misc_feature (420)..(420): n is a, c, g, or t
  modified_base (483)..(483): a, c, t, g, unknown or other
  misc_feature (483)..(483): n is a, c, g, or t
  modified_base (497)..(497): a, c, t, g, unknown or other
  misc_feature (497)..(497): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtctttgtctccaggggaaanagccaaccctctcctgcagggccaaatcagagtgttagcagtaacttagtctggtaccaacatagacctgaccaggctcccaggctcctcatctacgatgccgtccaacagggccactggcatcacagccaggttcagtggcagtgggtctgggacagacttcactctacaccatcagcaactagaacttgaatattttnattttatatgtacaacntcagcagctgctctctacgtttcgggcgagggaccaagggtcgagtcctacgaaaacgagtgngggctacgacaccntcctgtcttcactccgttcccgac

SEQ ID NO: 165027 - DNA, 615 bp, Homo sapiens
  misc_feature: GYAE6OF01BXM5E.33.23.C01.1.454.CMB.1.raw
  modified_base (206)..(206): a, c, t, g, unknown or other
  misc_feature (206)..(206): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggccaccctgtctttgtctccgaaggggaaanacgcccaccctctcctgcacgggccaatcagagtgttagctagttaacttagtctaggtaaccaaacaaaacctcggaccaacgacctcccaggcctcctcactctatgatcgacactccgaccgacgggccacgtcggcctactcccacgcctaggttcaggtcgacgtaggtgggtcgtgggacctacgtacttcactcctacacctatcagtcaacgtctagcgctagacttctttgacttagtttactacgttgttactgactggtacgtagacttaacgtcgtaacccttaaccgtcccgttaccggacgtaacgggacctacgacgtagaaacgttacgtaaacgcgtggtacgacgtcgactacccgttagtccttgtacctttcctacgttcccgtacccg

SEQ ID NO: 165028 - DNA, 719 bp, Homo sapiens
  misc_feature: GYAE6OF01BJX0M.33.23.C01.1.454.CMB.1.raw
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtctttgtctccgaggggaaagagccaccctctcctgcagggccaatcagagttgttagcagtaacttagtctaggtaccaacatacgacctgaccaggcctcccgaggcctcctcacttctacgatcgaccgtaccaacgacgggcccaacgtggacctacgtccccgaacgtcccgtaaggttcgaacggttgggacctagggtcggggtacgtcggggaacctaggtaaccctttcgaaccttccgtaccaaccctagttaccaacgacctaaacccgtaagtaacctttggtaaacgtttactttttactaagttttttaacttacgttagtaaccgtaactaacgtaccgtaacggtccaacgtcgtcgggtacccttaccgttaccgtaccggtttcccgggacgggttaccgggaaccgtaagggtacggacggacttaaaccggaaacgttaccgtaggtccggtcgtacggaccctaaccgtgttaccttcggttaccttacctacccgttccttccccgccttaacg

SEQ ID NO: 165029 - DNA, 856 bp, Homo sapiens
  misc_feature: GYAE6OF01CAWCI.33.23.C01.1.454.CMB.1.raw
  modified_base (202)..(202): a, c, t, g, unknown or other
  misc_feature (202)..(202): n is a, c, g, or t
  modified_base (214)..(214): a, c, t, g, unknown or other
  misc_feature (214)..(214): n is a, c, g, or t
tcagtacacacactcacgaccggtgctcgatttagtacacgtgattagggattgggggagaactgctcagttaggacccagaggaaccatggaagccccagctcagcttctcttcctcctgctactctggctccagataccacggagaagttgtgttgaacgcagtctcgaggcaccgtgtcttcgctaccgaagggaaacncgccctaccgtntccgtagccgtagggacctaaatcgaggtaccgttgttaacgaccgtagttaaaaccttcggtcctaacggtaacctaaacgtacgttaccggtaacccgttggtaaacccgaggtacccttacccccggtaagggtcccttaccgtacgacgtttaaccgtaacggtaacgttcggaccgtttaaccaaacggtccgggtacctaacgtcggggaaccctacgttaccccggaaacggtcccgttaagggttaccgagggttaccggtacgttaacggttccgggtacttaacggggaacctttaacgggtacctttaccgaaccgttcgttaacccgtaacccgtagtacccgtaacgggtacccttaaaccgttaacggtaaccgtttacgtaacggttttactttttaccgaaacgttttttaaccgtaacgttacgttaaccgtaacgttaacgtttaccgacccggtataaccgttcgtacgggtacccttcgtaacgtaccgtttaccgggaccgtaacggtactaacggttacgacggttactaccggaaaccgttgtacggtcgtacgttaccggacctaccgttaagttccgttacgttactaccgttaccgttacctcccggtacgttacg

SEQ ID NO: 165030 - DNA, 767 bp, Homo sapiens
  misc_feature: GYAE6OF01C4K7G.33.23.C01.1.454.CMB.1.raw
tcagtacacacactcacgaccggtgctcgatttagtacacgtgattagggattgggggaggaactgctcagttaggacccagagggaaccatggaagccccagctcagcttctcttcctcctgctactctggctcccgaggggaagacgccaccctctcctgcagggccagtcagagtgttagcgggtacctagcctggtaccaacagagacctggccaggcctcccaggcctcctcttctatgatgacatccaacgagggccacgtggcactcccagccagttcagtggcggtgggtctgggacagtacttcgactctccacatcagcagcctagacgaccgtagaacgtattttagcgttaagttttacttacgttgttcgttggactaggtccgtaaggaccgtaaacgtcggtaacccttaaccgtacccgttaccgggacccgtaaacggggaaccctaacggtaaccgtagggtaaacggtaaacgttaaaccggtaacgttcgggtacggtaccgtacggtacccctaaccgttacgttaccgtttcggtttaccccttttaccgtttacccccgtttacccccggtaacccgttacgttttaccccgtagggttaaaccggtttcggtttacgggttacggttaacccggttcggggtaaaaccggggttcccggggtagggttacccgggggtaaccggggtaaccgggttaaccgggtaccccgttaaaagggtttaaggccgttacgggtaagtcg

SEQ ID NO: 165031 - DNA, 732 bp, Homo sapiens
  misc_feature: GYAE6OF01C2KHH.33.23.C01.1.454.CMB.1.raw
tcagtacacacactcacgaccggtgctcgatttagtacacgtgattagggaggttgggggaggaactgctcagttaggacccaggagggaaccatggaagccccagcgtcagcttctcttcctcctcgctactctggctccagagtaccgacggggaaacttgtgttgacacagtctccagccaaccctgtctttgtctccgaaggggaagcgccaccctctcctgcgacgggccagtcagagtcgctggcagtctaacgttagacctagtaaccaaacaaaaccgtcggaccagacctaccgaggtcctaccgacaactacctagtcgtactcgactactcccgaacgtacgggacctacgtcggcctaccgttccgacgtccgtaaggttccgaggtcggcgtaggtcggggtacgtagggtactacggtaccttcctaccgttccctaccgaacctactaccgacgtaccgacgtacccgtaaggtaccgtacgtaagaacggtttagtttacgacttttaaggttttaacctttacggttcgtacgtacgtaccgtacggttacgtaaccgtaccgtaacgtaccgggtaacccttaaccgtacccgttacgggaccgtaaacgggtacctaacgggtaacggtaacggtaacgttaaacgtaaaccggtcggtacgggtacgtcgtaacaccgtaccgtagtcccttagtccctactccgttacccg

SEQ ID NO: 165032 - DNA, 783 bp, Homo sapiens
  misc_feature: GYAE6OF01C5CD6.33.23.C01.1.454.CMB.1.raw
  modified_base (202)..(202): a, c, t, g, unknown or other
  misc_feature (202)..(202): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtctttgctccgaggggaancgcccaccctctcctgcagggccagtcagactgtagcagcggtcttactacgccgtggtaccaggccaaggaaacccgtggacccacgggtccctacccgaggtccctacctcctactaggttcggtacgcctacttaccccaccggacgggccctaaggtcggacctacgtaccccgaggtaccgtacggttcgaggtcggacgtagggttcgggtcgtacgggactacggtacctttacgacctttccgtaaccaaccgtactcccggaacgtacggtaccggtacgggaaccgtaccgttaaggtaaacggtttcgttttacggacgttacggtttacctttaacgtttaccggttacggttacctaacggtacggttaacgtttaacggttacggggttacggggtaaccggtttaccggttacccggggtaaccgggtaaacggggtaacccggttaaaggggtaacggtaaaaccgttaaccggaaaccggttaaccgttcggtacgggtacctacggaccctaccgtagttccgttccggttactttaccgacctttccccgtcccgcttaacg

SEQ ID NO: 165033 - DNA, 158 bp, Homo sapiens
  misc_feature: GYAE6OF01DP1FA.33.23.C01.1.454.CMB.1.raw
  modified_base (157)..(158): a, c, t, g, unknown or other
  misc_feature (157)..(158): n is a, c, g, or t
tcagtacacacactcacgaccggtgctcgatttagtacacgtgattagggatgggagggaccaaggtggagctcaaacgaactgtggctgcaccatctgtcttcatcttcccgccatctgaagtgtgtgtactgagcgggctggcaaggcgcatagnn

SEQ ID NO: 165034 - DNA, 570 bp, Homo sapiens
  misc_feature: GYAE6OF01B3E45.33.23.C01.1.454.CMB.1.raw
  modified_base (264)..(264): a, c, t, g, unknown or other
  misc_feature (264)..(264): n is a, c, g, or t
  modified_base (372)..(372): a, c, t, g, unknown or other
  misc_feature (372)..(372): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtctttgtctccgaggggaaagagcccaccctctcctgcagggccaatcagagtgttagcagtaacttagtctggtaccaanatagacctgaccaggcctcccaggctcctcatccatggtgcactcccaccagggccacgtcggcactcccagacaggttcagtggcaggtgggtctggacagtacttnatttcacacatcagcagactggacgccgtagaatgtttgcgtagttgtacttacgtgtacagtacgtaggttacggttgtactacgttccgtaccgtacggttcggaccgaagggtaccgaaggtacggaaactacgaaacggtacgtggtagcgtgacctacctattccttgttccttactcgttcccgttaccccg

SEQ ID NO: 165035 - DNA, 719 bp, Homo sapiens
  misc_feature: GYAE6OF01BDMI1.33.23.C01.1.454.CMB.1.raw
  modified_base (200)..(200): a, c, t, g, unknown or other
  misc_feature (200)..(200): n is a, c, g, or t
  modified_base (213)..(213): a, c, t, g, unknown or other
  misc_feature (213)..(213): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctccagataccacggagaagttgtgttgacgcagtctccaggcacctgtcttgtctcgaaggggaaancgccacctctccngcaggccagtcagagtgttagcggtactagcctaggtaccaacgagagacctggacccaggcctccgaggccttcctctttctagtcgattcgacctatacccgaacgacgggcccacgtggacctaactccccgaggtaccctaggttccgaagggttcgggaccggggttgggtccgtaggggactacggtacttccgaacttccgaccaccacgtacgacgtaccacggtaccctaggaccgtaccgttaggtaaacgtttagttttacggtactttaacgttttaacgtacgttacgttacgaacgtcgtaacggacgtaacgacgtaacgttcgggttacgttacgggtaaccggtttccgggaacggtaaaccgggtaacggtaacgggtaagaaacgtaaccgaaaacggtacgtagggtaccggtacgtacgaacctaaccgttacgttccgttacggtttaccttaccgtaaccgtttcccgtacccgtccttaacg

SEQ ID NO: 165036 - DNA, 757 bp, Homo sapiens
  misc_feature: GYAE6OF01BPRKP.33.23.C01.1.454.CMB.1.raw
  modified_base (203)..(203): a, c, t, g, unknown or other
  misc_feature (203)..(203): n is a, c, g, or t
tcagtacacacactcacgaccggtgctcgatttagtacacgtgattagggattgggggaggaactgctcagttaggaccaagagggaaccatggaagccccagctcagcttctcttcctcctgctactctggctcccagataccaccggagaagttgtgttgacgcagtctccaggccaccctgtcttgtctccgaggggaanacgccaccctctcctgcacggaccaatcagagtagttagactagtaacttagtcgtacggtaaccaactagtacgacctgaaccgaggcctacccgaggccttcctacatactacgatcgaccgtaccgaacgacgggccacgtacggcctacgtcccgacggtaccgtacggttcaagggttcggacgtcgggttcgggtaccgtaggggtaacctacggtaaccctttccgtaaccttcctaccctaacccgtataccaacggtacctaaaaccgttaacgtaacgtttaggttaaacgtttactttttaactttaatttttaacgttacttacgttaacctaacgtacttaccgtaaccgtctacggtccgtacggtccttacgtccgttaaccggtttcgggaacgggtacgggaacgtagggtacggaccgtaccgtaacgtaaaccggtacgttacggtcggtcgtacgtaccgtaaccttcgtaccgttacgttacttaccctaccgtttacccttcccgtagttaccccccccccccccccccccg

SEQ ID NO: 165037 - DNA, 597 bp, Homo sapiens
  misc_feature: GYAE6OF01B355G.33.23.C01.1.454.CMB.1.raw
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccggccaccctgtctttgtctccgaggggaaagacgccaccctctcctgcagggccagtcagagtgttagcgggtacctagcctggtaccaacagacgacctggccaggctcccgaggccttcctcttctatgatgcactaccaacgacgggccacgtggcactcccagccgaggttcaggtcggcggtgggtcgtggggacaggtaccttcacctctaccgaccatcacgcagcctagcgtctagaagtatttgacttagtttatacgtgtctgcagtcgtagactaacgtcgtacctaacgtaccgttacggaccgtaacggacgtacgaacggtacggaagtaacgttaaaacggtacgtaggtacggtcgtgacctacctacgttcgttcgttaccttactaccttcccttcccgccttacg

SEQ ID NO: 165038 - DNA, 738 bp, Homo sapiens
  misc_feature: GYAE6OF01CUB70.33.23.C01.1.454.CMB.1.raw
  modified_base (198)..(198): a, c, t, g, unknown or other
  misc_feature (198)..(198): n is a, c, g, or t
  modified_base (209)..(209): a, c, t, g, unknown or other
  misc_feature (209)..(209): n is a, c, g, or t
  modified_base (310)..(310): a, c, t, g, unknown or other
  misc_feature (310)..(310): n is a, c, g, or t
  modified_base (723)..(723): a, c, t, g, unknown or other
  misc_feature (723)..(723): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctcaggcacctgtcttgctcgaggggaangccacctctcngcaggccaagtcagtagtgtagcagttaacttagctggtaccaacatagaccagaccaggactcccgaggcctcctacatcctacgatcgcgtaccaacgngggcccagtcggactacgtcccgaacggcctagggttacacggttacggccgtagggttcggggtcctgggggaaactacgtacctttacgaccttccgtaccgaaccagttccgaacgtacctaaaccgttaacggtaaaccgtttagtaaacggttttactttttaacgtaaattttttaacgttacgttacgttaactaactacgttccgtaacggtccgttaggtttaccgtacccttacgttaccgttaacggtttaccgggtaccgggtaacggggtaaccgtaacggggttacgaacggttacctaaaccggaaaccggttacgttacgggtcgtaccgttacggacccttaaccggtaacgttcgttaccgtttacgttacccgttaacgttccccgtttacccnccgttaagttacccg

SEQ ID NO: 165039 - DNA, 556 bp, Homo sapiens
  misc_feature: GYAE6OF01A783F.33.23.C01.1.454.CMB.1.raw
  modified_base (205)..(205): a, c, t, g, unknown or other
  misc_feature (205)..(205): n is a, c, g, or t
  modified_base (262)..(262): a, c, t, g, unknown or other
  misc_feature (262)..(262): n is a, c, g, or t
  modified_base (532)..(532): a, c, t, g, unknown or other
  misc_feature (532)..(532): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtctttgtctccgaggggaaagngcccaccctctcctgcagggccaatcagagtgttagcagtaacttgctggtaccaanatagacctgaccaggcctccgaggctcctacatctacgatcgcgtaccaacgacgggccacgtggcactcccgacgccgaggttacacggtggcaggtcgggtcgtgggacagtacttcactctcaccactcacgcaaccgtagtaacttcgtaagttactttttctaattttacttacttcgtacaactactcacggctagtctcgcctctcgtacgttcggcgggacggtacgaggtcggactctacgaacgtacgtgcgctgacacnctgtctcttcacttcctccgctcg

SEQ ID NO: 165040 - DNA, 702 bp, Homo sapiens
  misc_feature: GYAE6OF01CGIVM.33.23.C01.1.454.CMB.1.raw
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtcttgtctccgaggggaaagcgcccaccctctcctgcgacggacaagtcagacgtgttagactaagttaacttagtacgtaggtaaccaacattacgaccctagaccgacggcctccgaacggcctcctacactactacgatcgaccggtacccaaacggaccgggaccctaggtccggactaccgtaccccgaaggtaccgtaggtccgtaggtcgggtaccgtaggttcgggtcgtacggggtaaccacggttaaccttcgttaactttacctaccaactagtaccgaacggactacgacggttaggaccgtacgtaggaaagttctttaggactaggttattacgttacgtacgtacgacgttacgaaggttacggttacgttacgtacgttccgtaccggtacgttaccggaaccggtaaggaccgtaaggtaacgaaataccgaaacgtacgttacgggtagacgtaggacctacgtattcgtacttccgttacacgtttcccgtccgtaaccg

SEQ ID NO: 165041 - DNA, 626 bp, Homo sapiens
  misc_feature: GYAE6OF01EMLSB.33.23.C01.1.454.CMB.1.raw
  modified_base (203)..(203): a, c, t, g, unknown or other
  misc_feature (203)..(203): n is a, c, g, or t
  modified_base (261)..(261): a, c, t, g, unknown or other
  misc_feature (261)..(261): n is a, c, g, or t
  modified_base (303)..(303): a, c, t, g, unknown or other
  misc_feature (303)..(303): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtctttgtctccaggggaaangccaccctctcctgcagggccaatcagagtgttagcagtaacttagtctggtaccaanatagacctgaccaggcctcccaggcctcctcactccatggtncactcccaccgagggcccacgtcggcctactccccgaagaccgtaggttcaggtggcgtaggttcgggtctggggacaggtaccttcgatttccaccaccattccagcagacgtggacgtctaggtaagttagtttcgactaggttagttaacttacgtgttacgagtactacggttacggttagttctacgttccgtaccggttaccggttccggaccgtaacgggtaccgtaagggtaggaaaactaccgaaaacggtacgtggtaggacgtacgacctaacctagttacctacgttaccttactcgttcccgttaccccg

SEQ ID NO: 165042 - DNA, 566 bp, Homo sapiens
  misc_feature: GYAE6OF01AWXK6.33.23.C01.1.454.CMB.1.raw
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
  modified_base (236)..(236): a, c, t, g, unknown or other
  misc_feature (236)..(236): n is a, c, g, or t
  modified_base (392)..(392): a, c, t, g, unknown or other
  misc_feature (392)..(392): n is a, c, g, or t
tcagtacacacactcacgaccggtgctcgatttagtacacgtgattagggattgggggaggaacgtgctcacgttaggacccagagggaaccatggaagccccagctcagccttctcttcctcctgctactctggctcccagataccaccggagaagttgtgttgacgcagtctccaggcaccctgtctttgctccaggggaagngccaccctntcctgcagggccagtcagagtnctggcagcaacttgcctggtaccaacaaaacctggccagactcccaggctcctcatctatgatgcagtccacagggccactggcatcccagccaaggttcagtggcagtgggtctgggacagactttcgactctacaccatcagctagccctaganccttgaacgtattttgctagttttaattactgtctcgactagtaccgtagcctaaacgtggaccttaacgacctttcggacccaaaggggtccacggtacttgggaagaacgttaaaaccgaacgttggtacggtacttacggccttaaccgattacctggttccttcgtaacc

SEQ ID NO: 165043 - DNA, 701 bp, Homo sapiens
  misc_feature: GYAE6OF01AQEVI.33.23.C01.1.454.CMB.1.raw
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtctttgtctccgaggggaaagagcccaccctctcctgcagggccaatcagagtgttagcagtaacttagtctggtaccaacatagacctgaccaggcctcccaggcctcctcactcctaacgatcgaccgtacccaaacgacgggcccacgtcggccactccccgagtcccgtaggttcaggtcggccgtaggtcggggtacgtaggggacacggtaccttcaccttcctaccaccctataccgaacgtaccctaaaccgttagtaaccgtttagtaaacgtttattttttactaaatttttacttaactcgttaaccaactattccgaacggtctacgtccgttacggcccctttacgtaccgttaccggttccggggacgggtaacgggtaacccgtaagggtcggaacgtaccgtaaccgaaacggtaccgttagggtccgtacctacggacctaacccgtactttcccggttacttacccgttactacccgtttccccttcccggtaccttacg

SEQ ID NO: 165044 - DNA, 767 bp, Homo sapiens
  misc_feature: GYAE6OF01CK02I.33.23.C01.1.454.CMB.1.raw
  modified_base (205)..(205): a, c, t, g, unknown or other
  misc_feature (205)..(205): n is a, c, g, or t
  modified_base (307)..(307): a, c, t, g, unknown or other
  misc_feature (307)..(307): n is a, c, g, or t
  modified_base (757)..(757): a, c, t, g, unknown or other
  misc_feature (757)..(757): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtctttgtctccgaaggggaaancgcccaaccctctcctgcagggccaatcagagtgttagctaagtaacttagtctaggtaccaacatacgacctgaccaggcctccgagctcctcatctacgntcgcctaccaacgacgggccacgtcggcactccccgagtcccgtaggtttccgaggtcggacgtagggttcggggtacgttaggggaacctaacgggtacctttaccaccttaccgtaccaaaccctacgtacccgaacggacccttaaaaccgttaacggttaaacgtttacgggttaaagtttacttttttttacctaaacgtttttttaacgtttaaccgttaacgttaacctaaaccgttaacgttaccgaacccgggtactacggttacgtaccggtccctttacgttacccgtttaaccggttttaccgggacggggttaacgggtaacccgtaaggggtcggtacgacgtaaccgaaaacgtacgttagggtacgtacgttacgaccgttaaccgtagttacctttacggttaccttaacccgttcgtttaccccgttccccnccgttaacgg

SEQ ID NO: 165045 - DNA, 160 bp, Homo sapiens
  misc_feature: GYAE6OF01DZWT1.33.23.C01.1.454.CMB.1.raw
  modified_base (158)..(160): a, c, t, g, unknown or other
  misc_feature (158)..(160): n is a, c, g, or t
tcagtacacacactcacgaccggtgctcgatttagtacacgtgattagggatgggagggaccaaggtggagctcaaacgaactgtggctgcaccatctgtcttcatcttcccgcatctgagtgtgtgtactggaggcgggctggcaaggcgacatagnnn

SEQ ID NO: 165046 - DNA, 673 bp, Homo sapiens
  misc_feature: GYAE6OF01CMCII.33.23.C01.1.454.CMB.1.raw
  modified_base (203)..(203): a, c, t, g, unknown or other
  misc_feature (203)..(203): n is a, c, g, or t
  modified_base (259)..(259): a, c, t, g, unknown or other
  misc_feature (259)..(259): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtctttgtctccgaggggaanagccaccctctcctgcagggccaatcagagtgtagcagtactagtctggtaccaanatagacctgaccaggcctccaggcctcctcatctacgagtgccgtaccaacgacgggccacgtcggccactcccagcccaggttcagtggacgaggttcggggtcgtaggggacaggtacctttccgaaccgttcctaccaacctacgtaccaacggtacctaaaccgttaagtaacgtttaggtaaacgtttacttttttaacttaattttttaagttaaccgttacgttactaaacgtacttaccggaacgtacgtacgtacccgttcggtacccttcttaccgttacggtttccgggacgggtaacgggaccgtaagggtcggacgtacgtaaccgaaacgtacgttggtacggcgtcgacctaacctcgttcgttacgttacttacaccgtttccctcccggtacctacg

SEQ ID NO: 165047 - DNA, 659 bp, Homo sapiens
  misc_feature: GYAE6OF01D3M3L.33.23.C01.1.454.CMB.1.raw
  modified_base (610)..(610): a, c, t, g, unknown or other
  misc_feature (610)..(610): n is a, c, g, or t
  modified_base (617)..(617): a, c, t, g, unknown or other
  misc_feature (617)..(617): n is a, c, g, or t
  modified_base (637)..(637): a, c, t, g, unknown or other
  misc_feature (637)..(637): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtctttgtctccgaggggaaagagccaccctctcctgcgagggccaatcagagtgttagcagtaacttagtctggtaccaacatagacctagaccaggcctcccaggctcctcatctacgatcgcgtaccaacgacggggccacgtcggacactccccagccgtaggttccaaggtggacgtaggtcggggtcgtaggggtacacggtactttaccacttcctaccaacccacgtaccgacgaaccctaaaccgttaacgtaaaccgttttagaaacgttttacttttttaactaaacttttttaattaaccgttagtaacctaacgtaactaccgacgtactaagtcctacggtccctcgtctaccggtttcggacgggtacggtaacgaaggtggacgtactaacggaaactagtggtcgcgtacncttaacncgttcgttactccgtttacnccctttcccgtcccgtcgtacg

SEQ ID NO: 165048 - DNA, 773 bp, Homo sapiens
  misc_feature: GYAE6OF01BQ2FE.33.23.C01.1.454.CMB.1.raw
  modified_base (209)..(209): a, c, t, g, unknown or other
  misc_feature (209)..(209): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagactaccaccggagtaagttgtgttgacgcagtctccaggcaccctgtctttcgtctccgaaggggaaacncgcccaccctcctcctcggacgacgggaccaatcgaaggtagtagttacgacgtaagttaaccgtttagtccgttacggtaaccaaacgtactaacggtacccgtacgaaccgtacggtacccttacccgacggccttcccgtactacgttacgtacggtacttaccggaccgttaacccgaaacggtaccgggaccctacggtcggacctaccgtacccgacgtaccgtacggtacgagggtcggacgtacgggttcggtacgtcgggtaactcgtacttaccgtacgttccctaccgtactacgtacgacgacgtacgtaccgtaggtaccgtacgtagttaaggtttactacgtagttagttacgtttacgttacgtacggttatacggtacgttaacggttaccgtagttcctacgttcggtaccggtccggtaccggtaacggtacgggaccggtaaggtacggtaaaccgtaacgtaccggtaacggtacggtcgtacgttacgtaccctagttaccgtcgttaccctacctttaccgtccgttcccgttccgtaacg

SEQ ID NO: 165049 - DNA, 839 bp, Homo sapiens
  misc_feature: GYAE6OF01AL1HJ.33.23.C01.1.454.CMB.1.raw
  modified_base (205)..(205): a, c, t, g, unknown or other
  misc_feature (205)..(205): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggcctcccagataccaccggagaagttgtgttgacgcagtctccaggcaccctgtctttgtctccgaggggaaangcccaccctctcctgcagggccagtcagagtgcgtgggcagacctaacgtttacggccgttacgggtaaacccaaaaccgtaaaaacccgtcgggacccaacggtaacccttccccgaacgggtccttcccgtactaacttccgttaagtaggtactcgcctaacttccccgaacccggaacgggccctaccgtcgggccctaccgtaccccgacggaccggtacggttcgaggttcggtcgtacggggttcggggtcgtaggggaacctaaggtaccttaccgaccttcctaccacctacgtccgagccgtacgtccgtaaggaccgtaccgttaggtaaacgtttcgtttttacggaccgttttaacgttttacgtttaccgttcggttactaccggtacgttaacggttaccggttaaccgtaccgttaaaccggtacccgttaaaccccgttaaacccggttaccccggtttaacccggggaacccggtaaccggggtaacccgtaaccgggtaaccggttaacgggtaaaacggttaaacccggtttaaaaccgggtacccggttagggttaccggtaccttacggtacctaacccgtacgttccctttaggttcccttaccgttaccg

SEQ ID NO: 165050 - DNA, 828 bp, Homo sapiens
  misc_feature: GYAE6OF01CIWWB.33.23.C01.1.454.CMB.1.raw
tcagtacacacactcacgaccggtgctcgatttagtacacgtgattagggattggggggaggaactgctcagttaggacccagagggaaccatggaagccccagctcagcttctcttcctcctgctactctggctccagactaccgacggggaattgtgtgacacagtctccagcccacctgttctttgtctaccggaaggggaagcgccctaccctctccgtgcgacgggccagtcaggtagtcgcgtcggacagtacctaacgttcggaccgttacggtaaaacccaaaaccgtaaaaccgtacggaccgaacggtacctacccgacggtcctacctacgtacttactacgtagtactcggaccaccgttacccgaacccggaccgggacccgtacctacggggggggggtacctacccgtaccccgaccggtaccggtacggttaccggtacggtacggtacggtacgggtacgggtcgggtacgggtacgtacgtacttaccgtaccgtacctaccgtacctacgtacacgtaccgtacgtaccgtacggtaccgtaccgtacggtaacggtttacgtttacgttacgtttacggttttacgtttacgttacgttccgtacgtaccgtacggtaccggtaccggtaaccgtaaccggtaaccgtacccgttaacccgtacccggttaccggtaacccggtaacggtaccggtaaccggtacggtaacgggtaacggttaaacgtaaacggttaacgtagggtacggtccgtacgtaaccgtaccgtacgttaccgttaccgttaccgttcctaccgttaccccg

SEQ ID NO: 165051 - DNA, 793 bp, Homo sapiens
  misc_feature: GYAE6OF01CPOIT.33.23.C01.1.454.CMB.1.raw
  modified_base (202)..(202): a, c, t, g, unknown or other
  misc_feature (202)..(202): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctccagataccaccggagaagttgtgttgacgcagtctccaggcaccctgtctttgtctccgaggggaanacgccaccctctcctgcgacgggccaatcgagagtgttagactagttaacttagtctaggtaccaagagtacgacctagaccgaggcctccgaggccttcctcactcctagacgtgaccgtaccgaacgacgggccacgtcggactactcccgacgtaccgtaggttcaggtggaccgtagggttcggggtcgtacggggaaccgtaacggtactttaccgacttcctacccgaacctaacgttaccgaaccgtaaccctaaaccgttaacgtaaaccgtttaggtaaacgtttacgttttacgtaacgtttagtttttaactttacgttcgtacgttacggtacctaacggacttacgtaacgtaaccgtaaccggttcgtaaaccccttaacggtaccccggttaacccgggtaaccggaacgggtaaccgaaccgggtacgtaaccgggtaaacgttaaaaccggtttaaaacccggtaggttaccgggttaacggtcttaacccgggtacccttaaacccgttacgtttccgttaacggtttaccctttaccggttaacccgttccccggtttaccccgtaacccgg

SEQ ID NO: 165052 - DNA, 668 bp, Homo sapiens
  misc_feature: GYAE6OF01AF061.33.23.C01.1.454.CMB.1.raw
  modified_base (200)..(200): a, c, t, g, unknown or other
  misc_feature (200)..(200): n is a, c, g, or t
  modified_base (621)..(621): a, c, t, g, unknown or other
  misc_feature (621)..(621): n is a, c, g, or t
  modified_base (662)..(662): a, c, t, g, unknown or other
  misc_feature (662)..(662): n is a, c, g, or t
tcagtacacacactcacgaccggtgctcgatttagtacacgtgattagggagttgggggaggaactgctcagttaggacccagagggaaccatggaagccccagctcagcttctcttcctcctgctactctggctccagataccaccggagaagttgtgttgacgcagtctcaggcaccctgtcttgtctcgaggggaangccacctctcctgcaggccaatcagtagtgttagctagttaacttagtcgtcggtaaccaactatacgacctcgaaccaggtcctcccaggcctcctactacttcctaacgatccggaccgtaccgaacgtacgggcccacgtcggacctacctccccgacgtacccgtaggttcgaggttcggacgtagggttcgggtccggtagggaactacggtaccttccgacttccgacctacactccgaactaccgtaaacctaggtaacttaggttaactttagttttactttaagtttttacttactacgtttaaccaacgttcgtaccacggtactacggtccgtcgtcccttactcgttacggttaccgggagggtacgaaccgagggtacggactaccgtaagacgtacgtggccgtacncgactaccgttgtcttacgttcttacgacccttcctcccgnttacgg

SEQ ID NO: 165053 - DNA, 161 bp, Homo sapiens
  misc_feature: GYAE6OF01CHTD7.33.23.C01.1.454.CMB.1.raw
  modified_base (157)..(161): a, c, t, g, unknown or other
  misc_feature (157)..(161): n is a, c, g, or t
tcagtacacacactcacgaccggtgctcgatttagtacacgtgattagggatgggagggaccaaggtggagctcaaacgaactgtggctgcaccatctgtcttcatcttcccgccatctgaagtgtgtgtactgagcgggctggcaaggcgcatagnnnnn

SEQ ID NO: 165054 - DNA, 779 bp, Homo sapiens
  misc_feature: GYAE6OF01C8V0L.33.23.C01.1.454.CMB.1.raw
tcagtacacacactcacgaccggtgctcgatttagtacacgtgattagggattgggggaggaactgctcagttaggacccagagggaaccatggaagccccagctcagcttctcttcctcctgctactctgctccagataccaccggagaagttgtgttgacgcagtctcgagcaccctgttcttgtctacgaagggaaagcgccctaccctctccgtgcgacggacaatcgagtagtagttacgactagttaacgttagtacgtacggtaaccaaacgtataacgaccctagaccgacggtccctaccgacgtcctcctctactacgtacgagtcgtaccgtacccgaacggtaccgggacctacgcggtacccaccgttacccgacgtaccggttacgggtttacgacgggtcgggacggttacgggttcgggtaacgggtacggaacgttaaccgttaccgttacccgtaacttcgtaacccgtactacggaacgaaaccgtaccgaaacgtttacggtaaacgttagttaaacgtttttctttacttttaagttttaacttacgtaacgtctaaactgaccgttaccgagtacttacccgtcggtacccttacgttaccggtccggtttacgggaaccgggtaacggtaacggtacgggaacgtaccggtaacgtaaaccgtaacgggttaacggttcgccggtaccgtacgaccgtacttaccgttacggttaccctcgtttaacccctctttacccccgcctagtttaacggg

SEQ ID NO: 165055 - DNA, 759 bp, Homo sapiens
  misc_feature: GYAE6OF01BXUHR.33.23.C01.1.454.CMB.1.raw
  modified_base (212)..(212): a, c, t, g, unknown or other
  misc_feature (212)..(212): n is a, c, g, or t
  modified_base (462)..(462): a, c, t, g, unknown or other
  misc_feature (462)..(462): n is a, c, g, or t
tcagtacacacactcacgaccggtgctcgatttagtacacgtgattagggattgggggaggaactgctcagttaggacccagagggaaccatggaagccccagctcagcttctcttcctcctgctactctcggctccagactaccacggagtaagttgtgttgacgcagtctccgaggcctaccgtgttctttgtcctccggaaggggaaancgccctaccctctcctgccgacggaccaatcgagtagtgtacgctaagttaacttagtctacggtaaccaatagtacgacctcgaaccgacggcctccgacggtcctacctacgctacgtacgactcgaccgtaccaacggacggacctacgtcgacctaccgtaccccgaggtaccgtaggttacaggtcggacgtagggtcggtacgtacgggactacgtaccgttcctaccgtacctaccgaacgtntaccgaaacgtacctaaaccgttaacgttaacctttacggttaacgttttatttttacgttttaatttttaaccgttacgttacgttaaccaacttaccgtacgaccggtacgtacgttccgtccgttacccttcgtaccgttccgggtttaccgggacgggtaaccgggtacggtaaaggggttcggaacgttaccggtaaaccgtaaaccggttacggtcggttacggtcgtacgtacccgtaacttcgttaccttcgttacctcgttaccttccccgttaccgtccgttaacgg

SEQ ID NO: 165056 - DNA, 698 bp, Homo sapiens
  misc_feature: GYAE6OF01AKRXM.33.23.C01.1.454.CMB.1.raw
  modified_base (351)..(351): a, c, t, g, unknown or other
  misc_feature (351)..(351): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggccaccctgtctttgtctccgaggggaagacgcccaccctctcctgcacgggccaatcagagtgttagcagttaacttagtctggtaccaacatacgacctgaccgaggcctcccacggtcctcctcactcctacgactcggccgtaccaacgacgggacccacgtcggacctacncccgacgccgtacggtcgaggtcggcgtaggtcgggtcgtgggactacgtaccgttcacgtcctacacctataccacgacctaaaccgtacgtaacttaggtaacgtttactttttacttaatttttacgttacttgtaaccaactacgtacgacggtctacgtcgttccggtaccttccgttaccgtacgtttaccggggaccgggtaacggggtaacccgtaaggggtacgggtactaccgtaaaccggaacgttaccggtacggttcgggtacctccgtacgacccgttacgttcgtttaccgtacctttcccgtaacctttcccgtccccgtaccgttaaccg

SEQ ID NO: 165057 - DNA, 748 bp, Homo sapiens
  misc_feature: GYAE6OF01E5FZ9.33.23.C01.1.454.CMB.1.raw
  modified_base (206)..(206): a, c, t, g, unknown or other
  misc_feature (206)..(206): n is a, c, g, or t
  modified_base (318)..(318): a, c, t, g, unknown or other
  misc_feature (318)..(318): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggccaccctgtctttgtctccgaaggggaaanagcccaccctctcctgcacgggccaatcagtagtgttagctagttaacgttagtcgttaggtaccaacatacgacctacgaccacggcctcccgaggcctcctcatctacgntcgccgtaccaacgcggccacgtcggcacctccccgagtccgtaggttccgaggtcggcacggttcggggtacgtacggggaacctaggtaccttaccgacttccctaccaacccattacccgacgtaccctaaaccgttaacgtaacgtttaacggttaatttacgtttttacttaattttttaacgttaccgttacgttaactaaccgttactaccggtaaccggtcgtaaccggtcgttaccggtcccttaccgtaccgttaccggtttaccggggaccgggtaacgggtaaccggtaagggttacgggacgtaccgtaaaccggtaaacccgtacggttagggtacggttaccgtcgaacctacccgttagttccgtttacgttccttaccgttaacccgtttccccgtaccccggtccttaacgg

SEQ ID NO: 165058 - DNA, 656 bp, Homo sapiens
  misc_feature: GYAE6OF01DLGDO.33.23.C01.1.454.CMB.1.raw
tcagtacacacactcacgaccggtgctcgatttagtacacgtgattagggattgggggaggaactgctcagttaggacccagtagggaaccatggaagccccagctcagcttctcttcctcctgctactctggctcccagataccaccggagaagttgtgttgacgcagtctccaggcaccctgtctttgtctccgaggggaaagcgcccaccctctcctgcagggccaatcagagtgttagctagtaacttagtctaggtaccaacatagacctggaccaggcctaccgaggcctcctcatctacgatcgccgtacaacgtacggcctacgtcggacactcccgagtccgtagtcaggtgcgtaggtggtcgtaggactagtacttcactctcactatcacgcacgccgtaagacgtcctaggtaacgttattttacggacttagttttacttacgtgttacgagtccgaggtacgtacgtacgttaacggtttcggttacggtttacgggtaccgggttaccggaaccgggtaaacgggtaaccggtaagggtaacggtaaaacgtaacggaaaaccggtagtgggttaccggcgtacggacctaccgtacgttaccgttcgttacttccgttacttccccgttcccgtaaccg

SEQ ID NO: 165059 - DNA, 581 bp, Homo sapiens
  misc_feature: GYAE6OF01C7C1H.33.23.C01.1.454.CMB.1.raw
  modified_base (202)..(202): a, c, t, g, unknown or other
  misc_feature (202)..(202): n is a, c, g, or t
  modified_base (260)..(260): a, c, t, g, unknown or other
  misc_feature (260)..(260): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccgggaaattgtgttgacacagtctccagccaccctgtctttgtctccaggggaaangccaccctctcctgcagggccagtcagagtgctggcagcaaacttgcctggtaccaanaaaaacctggccagactcccaggctcctcatctatgatgcatccaccagggccactggccactcccagccaggttcagttggcaggtgggtctggggacaggtacttcaccgtctaccaccatcagtcacgtcctagacgtcctagaagtatttgactaggttttatactgtactgactagcgttagctaaacgtcggacccttaaccgccgttaccggaccgaacgggtacaacggtaccgtagggaacgtaagttaaaaccgaacgttggacggtacttgaccctaccgtattcccgtggttaccttctacgttccccg

SEQ ID NO: 165060 - DNA, 842 bp, Homo sapiens
  misc_feature: GYAE6OF01D1XV7.33.23.C01.1.454.CMB.1.raw
  modified_base (218)..(218): a, c, t, g, unknown or other
  misc_feature (218)..(218): n is a, c, g, or t
  modified_base (237)..(237): a, c, t, g, unknown or other
  misc_feature (237)..(237): n is a, c, g, or t
  modified_base (799)..(799): a, c, t, g, unknown or other
  misc_feature (799)..(799): n is a, c, g, or t
  modified_base (813)..(813): a, c, t, g, unknown or other
  misc_feature (813)..(813): n is a, c, g, or t
  modified_base (836)..(836): a, c, t, g, unknown or other
  misc_feature (836)..(836): n is a, c, g, or t
tcagtacacacactcacgaccggtgctcgatttagtacacgtgattagggattgggggaggaactgctcagttaggacccagagggaaccatggaacgccccagctcagcttctcttcctcctgctactctggcctccagactaccgacggagtaagttgtgttgacgcagtctccgaggcctaccttgttctttcgtccgtaccggaaggggaaacncgccctacccgttctccgngacgacgggaccaagtcgaggtagttcgtagactaagttaaccttaggtccgtacggtaaaccaactacgtaacgtacctacggaaccgacggtacccttacccggaacggtcccttacccgtacctaacgttccgtaaaccgggtacttaccgggaacccgttacccggaaaaccgggtaccgggtacccctaacggtacgggtaccctaaccggttacccccgacggttaaccccggttagggtttaccgaaggggttacccgggtacggttaacgggggtttccgggggttaaccggtacgggtaaaccgttaacggtttaacctccgtacttaccgaccctacgtaaccgtacgtaaccgtaaccgtaaaccgttaaggttaacgtttaacgtaaagtttttacctttttaacttttaacgtttttaccgtacgttaacttaaccgtaacttaccgtacggtaccgtctaaccggttcgttaccggtcccttacgtaccgttacggtacgggacgaacggtaacggtaggcgacgtagtaccgaacgtgtcgcgctanaccgtctcgttacncgtttactaccctatcccgtacncgtacg

SEQ ID NO: 165061 - DNA, 904 bp, Homo sapiens
  misc_feature: GYAE6OF01BFQ6O.33.23.C01.1.454.CMB.1.raw
tcagtacacacactcacgaccggtgctcgattttagtacacgtgattagggaggttgggggaggaactgctcagttaggacccaggagggaaccatcggaagccccagcgtcagcttctcttcctcctgctactctggctcccagagtaccgacgggaattgtgttgaccagacgtcctccacgcctaacccttgttcgtttcgtcctaccgagggaagcgccaccctctcctcgcgacggccagtcaaggagtccgctacgggtcacggtcctaaacgtttcggtacccttaaggtaaaccccaaaaacgtaaaaccccgttcggaaccgtaaaccgtacccttaaccccgaggtaccccttccgtaacgtaaccttaccgtaagttcctaagtccgtaaccttacgtaccccgaaccgtacgggtaccctagttccgggaccctacctttaccccgggacgtaccccggttaaacgggtttccgaacggtccggggtaccgttaacgggggtttccgggttaccggtaaccgggggaccttacggttaaacccggttccctaaccccgtttcccgaaacccgttaaccaccgttacgtaacgggtaccctaaccgggtacccgtaacgggaccgttaccgggttaacggttaaacgtttaacgggttttacgtacttttaaacgggttttttaaactttccgggttactaacgggtcgtaaaccgtcggtttaacgtaaccgtacccttaaacgggtccgttaaccccaacgtttaccccgtaaggtaaccccggaacggttacgtaaccggtacggttaacgtacgtaaaccggttaaccgcggttacggtacgccgttaacgcctaaccttgttacgaccctttcctacgttcctcccgg

SEQ ID NO: 165062 - DNA, 800 bp, Homo sapiens
  misc_feature: GYAE6OF01EWMYJ.33.23.C01.1.454.CMB.1.raw
tcagtacacacactcacgaccggtgctcgattttagtacacgtgattagggattgggggaggaactgctcagttaggacccagagggaaccatggaagccccagctcagcttctcttcctcctgctactctggctcccagataccgaaccggggtaaattgtgttgacgcagtctccaggcacctgtctttgtctccgagggacagacgcccaccctctcctgacgacgggccagtcgagacgtgttacgcgagcgtcttcgtacgcgtagtaccagacaacgaacctggaccacggcctaccgacggtccttcccgtccttacgtagtcggtcgacctacacccgaccggacggaccctacgtcggactaccgtacccgaaggaccgtacggttacgacggtcggacgtacgggttcgggttacgtacgggaacgtaacgtacgttacgtaccgtcctaaccgaccgtaacgtaccgaacgtacggaccgtagggaccgtaccgttaaggttaaacgttaacgttttacgacgtttaacgttactttaacgttacgtacgtacgtaacggtacgttaacggttacggtaacgggtacggggttaacggtaaccggttaaccgggtaaaccggtaaacggggtaaccggtaaacgggttaaacggtaaaacgttaaaccgtaaaaccggttacggtaacgggtcggtaccgttaaccggtaacccgtaaaccgtcggttaaccgtttcgtttaaccgttaccgttaacccgtttccccgttacccggtaccggttaaccg

SEQ ID NO: 165063 - DNA, 862 bp, Homo sapiens
  misc_feature: GYAE6OF01CBRHY.33.23.C01.1.454.CMB.1.raw
  modified_base (214)..(214): a, c, t, g, unknown or other
  misc_feature (214)..(214): n is a, c, g, or t
  modified_base (246)..(246): a, c, t, g, unknown or other
  misc_feature (246)..(246): n is a, c, g, or t
  modified_base (249)..(249): a, c, t, g, unknown or other
  misc_feature (249)..(249): n is a, c, g, or t
tcagtacacacactcacgaccggtgctcgatttagtacacgtgattagggagttgggggagggaactgctcagttaggacccagagggaaccatggaagccccagctcaggcttctcttcctcctgcctactctggctcccagactaccaccggagaacgttgtgttgacgcagtcctccaggccaccctgtcctttagtctccgaggggaacncgcccaccctctcctgccagggccaatccagngtnttagcagtactgtctcggtacaacgatacacctgaaccacggtcctacccgaggcctccctcacttactaactcgaactcggtacctatacccgacccgtacggggccctaaccgtcggtacctaactcccccgaacgtcccggtaacgggtttccgaaggttacgggacgtagggtttcgggggtaacccgtagggggtaacccctacggttaacccgttcccgtaaaccgttcccttaacccggaacccgtacctttacccgaagggtaccctaaccggtaccgtaaacggtccgggtaccccttaaagggaaccggttttaagtttttccgggaaccctttaaaggggttttttccttaaaccggtttcggtttaacccgtttgggaaccgtaacggttaccgttaaaccgtcccgttaaaaccggtcggtttaaccccgtaaacgttaccccgtttacgggaaccgttaaccggggaccttacccggtaagtttaccggggaaaccgtttaacggtaaaaccgttacggttaaccgggtcggttacccggtaaggtacccccttaacggttacccgttacgttccgggttaacccttcgttaccccccg

SEQ ID NO: 165064 - DNA, 839 bp, Homo sapiens
  misc_feature: GYAE6OF01CKF1I.33.23.C01.1.454.CMB.1.raw
  modified_base (200)..(200): a, c, t, g, unknown or other
  misc_feature (200)..(200): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctccagataccaccggagaagttgtgttgacgcagtctccaggcacctgtcttgtctccgaggggaancgccaccctctcctgcgacggccaatcagagtgttagacagttaacttgtcgtacggtaccaactagttacgacccttgaacccgtaggccctacccgacggtaccttccctacgaacttccgtaacggtcgttccggaccgtaacccgaaacggtacggggtaccccgtaacggtcgggaaccctaccgtacccccgtaggacccccggttaaacgggttccggtaacgggtcggaccgtaggggttacggggttaccggtacgggggtaacccaggttacccctttcccgaacttcccgtaccctaaaccacttacggaacccgtaccgtaaacccgttaacggttaactttaacggttaacgtttttaattttacctttaaattttttaacttaacgttacgttaaccgtaaaccttacgttacccggtaaaccgtcgtaaccggtccgttaccgtacccgtttccttcccggttaaccggtttccggggacgggtaaccggtaccggtaacgggtacggtaccgtaccgtacgtaaacccgtacgggtacgttaccggccgttaccgacccgtccgtaaccgtttcccgtacggttacccttacgttaccttccccgttcccggtacttaaccgg

SEQ ID NO: 165065 - DNA, 943 bp, Homo sapiens
  misc_feature: GYAE6OF01A116R.33.23.C01.1.454.CMB.1.raw
  modified_base (212)..(212): a, c, t, g, unknown or other
  misc_feature (212)..(212): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggcctcccagataccgaccggagtaagttgtgttgacgcagtctcaggccaccttgtctttcgtcgtccgaagggggaaacncgccctacccctctccgtgccgacggtccaatcgagtagttgtagctagttaacttacgtcgtacgtaacaacgatacgactcgaccacggcctacccgacgtcctcctactcttacgtacgtactccggtccgtaaccgaaccggcggtacccacggtacggaccctaaccgttcccccgaaggttaccccgtagggtttacccgaggggttccggacggtttacgggtttccgggggtacggttacggggtaaaccggttacggtaacccttttcgttaacccgtttacccgtaaccctaaaccgttaccggtaccggaacggtacccggtaaacggttacccgggttacgggaaaccgttaccgggtaaggtttaacggtttaacggttttaacgggtaccttaagggtttacggtttaacgttttaccgggtagttaccggaacgttaaccggggtttaacgttaccggggtttaacgttaccgttacccggttaacccgggttaccccgggtaaccgggttttacccgggaaaccgggtaaaccgggttaaccgggttaaacggggtaaaccggttaaaacggtaaacccggttaaaacgggtaacccggttaccgggtaccggttaacggtaccccggttaaccgaaacccgttttcccgtaaaccgttttccgttaacccgtttcccgttaacccgttttacccccggtcccgttaaccccggg

SEQ ID NO: 165066 - DNA, 641 bp, Homo sapiens
  misc_feature: GYAE6OF01DM4VD.33.23.C01.1.454.CMB.1.raw
  modified_base (332)..(332): a, c, t, g, unknown or other
  misc_feature (332)..(332): n is a, c, g, or t
  modified_base (363)..(363): a, c, t, g, unknown or other
  misc_feature (363)..(363): n is a, c, g, or t
  modified_base (437)..(437): a, c, t, g, unknown or other
  misc_feature (437)..(437): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccgaccgggaaattgtgttgacacagtctccagccaccctgtctttgtctccgaggggaaacaccaccctctcctgcagggccaatcagagtgctggcagcaacttacgcctaggtaaccaaaccaaaaacctggaccaagacctcccgaggcctcctacatctatgatcgcactccaccgacggcccancggcacgtcccagccgtacgttcgaggtcgngtaggtgggtcgtagggacagtaccttcactcctacaccctatacagccagcctaagacgtaccgtagaagttnttttagacttaagttttacttacttggtctcgactacggcgttagaccgtaacgtcgtaccctaacgtcccgttacggacccggtaacgggtaacccacggtaaccggtggtaacgtaaaccgttaaacgaccggttacgtagggaccctggaaccctacgtaccgttacgtaccgtttcttaccgtacctcccgttacccccg

SEQ ID NO: 165067 - DNA, 877 bp, Homo sapiens
  misc_feature: GYAE6OF01CN7YH.33.23.C01.1.454.CMB.1.raw
tcagtacacacactcacgaccggtgctcgatttagtacacgtgattagggattgggggaggaactgctcagttaggacccagagggaaccatggaagccccagctcagcttctcttcctcctgctactctggctcccagactaccgaccggagaagttgtagttgacgcagtctccgagtccaccctgtcttgtccgtccgaaggggaaacgacgaccctaccctccgtccgtcggaccacgggtacccaaatccgaaggtacggttagttaacggacgtaaacggttaaacgtttacggttaccgtacgggtaaaccaaacgtaacggtaccgtaaaccggtccggacccgtacggggtccctacccccggacgggttaccccttaccgttaccgtttacgttaacggtcgtaaacgtccgaccctaacgttaaccccgaaacggtaaccgggtcccctaaaggttcgggacccttaacccgtaccccgaacggtacccgtacggggtttacccaagggttcggggtacgggttacggggtccgttacgggacggtacgttaccgttacctaaccgttaacccgccgtaacctacgttaccgacgtaccgacgtaccgtaagacgtaccgtagtacgtatttacgacgtattttaaccgtcgttactacggttaccgacgtacgtaccggtaacgtaacgtacggttcggtaccggttacgggtacccgtaccgggtaactaaaccggggtacgaaccgggttaaacggtaaccggtaaacgtaaacccggtgttaacggaccggttacctaaccggcctaaactccgggtcttccggtttacctaccggttaaccttccccgtaaccccgttacg

SEQ ID NO: 165068 - DNA, 844 bp, Homo sapiens
  misc_feature: GYAE6OF01BHXKX.33.23.C01.1.454.CMB.1.raw
tcagtacacacactcacgaccggtgctcgatttagtacacgtgattagggattgggggaggaactgctcagttaggacccagagggaaccatggaacgcccagctcagcttctcttcctcctgctactctcggcctccagactaccaccggagtaagttgtgttgaccgcagtcctccaggcctacccttgttctttcgtccgtccggaggggacaggacgcctaccctctccgtcgacgacggccagtcgacgtattaggtacgccgaggtccgttctttacgttaccgtccgtacggtaccgtacgaccgtaaacgtaacccggtcggacccggtacggaccctaccccgacggttcccctttccccgttcttaccgttacgtcgggttaccgaccgttacccacccgtaaccggtaccggacccgtaacggtcggaccctaccgtaccccgaaggtaccgtacggttccgtacggtcggtaccggtaagggttcggaccggtacggggaaacctcggtacccgtttaccgacccttaccgtaaccgtaacccgtacggttaacaaccggaacgttacggtaccgggaccgtaaccggtagttagttaacgtttcgtaacggttctttaccgttagttaacccgtggttaacgacggttacgaaggtttacggtaacgggttacgggtaaccgggtaccgggttaaccgggaaccggtaaacggtaccggtaagggttaaccgaaaataaacccgggtaacggttaaggtacggtacggtactccggtaacgtacgttacctagtttacccgtacgttaacctccgtttcccgtacgtacgg

SEQ ID NO: 165069 - DNA, 947 bp, Homo sapiens
  misc_feature: GYAE6OF01EYSSP.33.23.C01.1.454.CMB.1.raw
  modified_base (210)..(210): a, c, t, g, unknown or other
  misc_feature (210)..(210): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagactaccgaccggagaagttgtgttgacgcagtctccgaggcctaccctgtcttgtcctccgaaggggaaancgcccaccctctcctgcgaggccaatcagtagtgttacgctaagtaacttagtcgtacggtaccaactatacgacctacgaccgtacggtccgtacccgaggtcccttcctactactaccgtacgagtcgaccgttaccgaacggccgggaccctagtccggacctaccgtcccgaacggtccgttaggttaccgtagggtcggacgtacggggttcgggttacggtacggggtacctacggttaccctttacccgtaacccgtttccgtaaccccgacccgtttaacgtacccgaacccgtaaacccgttaaaacccggttaacggttaaaaccgttttaacggttaaacgtttttaaccgttttttaaaccgttttaaagtttttttaaaccgtttaacccggtttaacgtttaaacccttaaaccgttaaccgtttaccccggaaaccggttcccgtaccggttacccggttacccgttaccccgtttacccgtttaccggtttaaccccgggtttacccgggggttaacccgggggtaaaccggggttaacccgggtaaacggggttacgggttaacccggtaaaccgttaaccggttaaacccgggttaaaccgttccgggggtaaccgtacccgggtaacgtacccccggttaaccttaccggtttacccgtttccgttaacccgtttaccttacccccgttaccccgtttacccccgtcgtttaacccgg

SEQ ID NO: 165070 - DNA, 780 bp, Homo sapiens
  misc_feature: GYAE6OF01CJULB.33.23.C01.1.454.CMB.1.raw
tcagtacacacactcacgaccggtgctcgatttagtacacgtgattagggattgggggaggaactgctcagttaggacccagagggaaccatggaagccccagctcagcttctcttcctcctgctactctgcctccagactaccacggagtaagttgtgtgacgcagtctccaggcctaccctgtctttgtcctaccggaaggggaaacgcgaccctacccgtctccgagccgacggaccaatcgagtagtagtagactagttaacttgtcgtacgtaaccaactatacgaccgtagaccgacggtacctaccggacgtacctccgtactacgtaccgtaacgtacgtccggaccgaccgaacgaccggacccgtacggtcgggacccaaccgtacccggaaccggtccgtacggtttacggaacggtcgggtaacgtacgggttacgggtacgggttacggggaaacgtacggttaccttaccgtaacgttacctaaacccacggttaacaccggtaacctaaccgttaaccgaaagttaacgttaattaatttaacgtttttattaaacgtttttattaacgtacgtaacctaagtaaccgtcgtaaccgtagtaccgtccggtcgtaccgtttaccctcgggttaccggttacgggaacgggtacggaaccggttaggacgtaccgtaacgaaacggtaacgaaagttccggtaggacctaccggactaaccgtcgtacttccgtacttaccttaccgtccccgtccgtaccttcgg

SEQ ID NO: 165071 - DNA, 686 bp, Homo sapiens
  misc_feature: GYAE6OF01COZWG.33.23.C01.1.454.CMB.1.raw
  modified_base (202)..(202): a, c, t, g, unknown or other
  misc_feature (202)..(202): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtctttgtctccaggggaangccacctctcctgcagggccaatcagagtgttagcagtaacttgtctaggtaccaacatacgacctgaccgaggcctacccaggtcctcctcaactctacgatcgaccgtaccaacgacgggccctacgtggacactcccgagtccgaggttcagtggctaggtcgggtgtacggggactaggtaccttcgactcgtccaccgacttccgaagtaaccctaacctaacgtaacgtttagtaacgtttaactttttactaatttttacttaccttataacctaactattaccgtacgactacggtacgtccggtaccttcctacgttaacggttttccgggaccgggtaacgggaaccgttaagggtacggtaccgtaacgtaccgaaaacggtacgttgggtaccggtacgttacggaacctacccgtaagttccgttacgttccccgtttacaaccgttttccccgttacccgcccttaacgg

SEQ ID NO: 165072 - DNA, 683 bp, Homo sapiens
  misc_feature: GYAE6OF01CQOU5.33.23.C01.1.454.CMB.1.raw
  modified_base (170)..(170): a, c, t, g, unknown or other
  misc_feature (170)..(170): n is a, c, g, or t
  modified_base (217)..(217): a, c, t, g, unknown or other
  misc_feature (217)..(217): n is a, c, g, or t
  modified_base (230)..(230): a, c, t, g, unknown or other
  misc_feature (230)..(230): n is a, c, g, or t
  modified_base (310)..(310): a, c, t, g, unknown or other
  misc_feature (310)..(310): n is a, c, g, or t
  modified_base (344)..(344): a, c, t, g, unknown or other
  misc_feature (344)..(344): n is a, c, g, or t
  modified_base (347)..(347): a, c, t, g, unknown or other
  misc_feature (347)..(347): n is a, c, g, or t
  modified_base (361)..(361): a, c, t, g, unknown or other
  misc_feature (361)..(361): n is a, c, g, or t
  modified_base (621)..(621): a, c, t, g, unknown or other
  misc_feature (621)..(621): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctccagactaccacggataagttgtgttgacgcagtcnccgaggccaccgtgtcttgtctccgaagggaagcgccacctctccgngcgacggcctaancgagtacgtgttagacgtagtaactttagcgtacgacctacaagttcgacgtgaccgagccgttaccgaggtcctacctnactctacgatcgtcgaccagacgcacgtgcaccncgngtacctggcgtagnggacgtcggtcggtgtcgacgtacggtattccgacgttcaccacgtactcgtaacgtaccaacgtacgttaacgttaggtaacttttaaccgtttttgttaaaccgttttgttaacggtttctaaaccgtttacagtttaaccggaaccggtacccgtcgtcgttacccgtcccgttacgtaccggttacggtttccggggaggtaaaccggaggttacgggtcggacgttaaccgacgttaaaccggtatcggggtacncggttaacacccttgtagttacccgttcgtcgttacctacccgtttcgaaccgtccttacgg

SEQ ID NO: 165073 - DNA, 841 bp, Homo sapiens
  misc_feature: GYAE6OF01EWVGA.33.23.C01.1.454.CMB.1.raw
  modified_base (204)..(204): a, c, t, g, unknown or other
  misc_feature (204)..(204): n is a, c, g, or t
  modified_base (283)..(283): a, c, t, g, unknown or other
  misc_feature (283)..(283): n is a, c, g, or t
tcagtacacacactcacgaccggtgctcgatttagtacacgtgattagggattgggggaggaactgctcagttaggacccagaggaccatggaacgccccagctcagcttctcttcctcctgctactctgtctccagactaccacggggaattcgtgttgacactagtctccacgccacctgtctttagtctccgaaggggaanacgccctaccctctaccgtcgcgacgggcctagtacagtagtcgacgtcggcagctaacgttcggcttaggaaccaaanaaaccgtcggaccaaggtacctacccgaggtcctaccgtctaacgttctagtccgtagtcggcctaacgttacccgaccggtacgggtaccctacgtagggtaccctaccgtaccccgacggtaccgttaacgggtactagggtcgggtacgtaggggtcggggtaacgtacggggtaaccgaacggtttaccttaccggtaacctacccggttaccctaccgaaacgtttccgaacggtaacccgtacggtaaccccggtttaaggacccggttaacgttaacgggtaaaactttaaccgggtttccgtaaacggttttaaccgttttaacggtttaccgttacgtttaccggtacgtaccggttaacgggttttaaccgttacgtttaccgtaaccgttacccggtacccgggtttaacgtacccgggtaaccgtaaccgggttaacgtaaagggttaaccgaaaacgtttaaccgaaacggttacgtcgggtacgtacggctaccgaacgttactcccgtttattaccaacgtttcccgtgtaacccggttaccg

SEQ ID NO: 165074 - DNA, 786 bp, Homo sapiens
  misc_feature: GYAE6OF01B6120.33.23.C01.1.454.CMB.1.raw
  modified_base (248)..(248): a, c, t, g, unknown or other
  misc_feature (248)..(248): n is a, c, g, or t
  modified_base (747)..(747): a, c, t, g, unknown or other
  misc_feature (747)..(747): n is a, c, g, or t
  modified_base (773)..(773): a, c, t, g, unknown or other
  misc_feature (773)..(773): n is a, c, g, or t
tcagtacacacactcacgaccggtgctcgatttagtacacgtgattagggattgggggaggaactgctcagttaggacccagagggaaccatggaagccccagctcagcttctcttcctcctgctactctgctccagactaccgaccggagtaagttggtgttgacgcagtcctcaggcctacccttgttctttcgtaccgtacggaagggaaacgcgccctacctcctacgtcgacgacggaccaancgagtgtgttacacgtaagttacttgtacgtacgtaccaacagtacgtactacgaccgtacgccctacgacgtcctaccactacttcgacgtacgtcgtaccgaccgaacggtaccggtaccgaccggtttacgaccctacccgtacccgtaacgggtacccgttaccgggttagaccgggtacggtaccggtagggttcggttaccgggtaacggaccgtaccgttacccgtacctcctacccgtactaacccggtactaccgaaccgtaaccccttaaaggttaaccgttaacgtttaacgtttaactttttaacgtttttaacttaacgttttttaacctacgtttacgaaccttaacgtaacgttaccgtaaccgactaccgttcgtacgtcccttcgttaccggttcgtaaccgggcggtaaccgggacgtaacgggtacgtcgtaaaccgtacgtaacgtacgtaggtaccgtacctagacctacgtacgttnttcccgtacgttacctcccgttaccncccgttagttacg

SEQ ID NO: 165075 - DNA, 713 bp, Homo sapiens
  misc_feature: GYAE6OF01EGG8Y.33.23.C01.1.454.CMB.1.raw
  modified_base (219)..(219): a, c, t, g, unknown or other
  misc_feature (219)..(219): n is a, c, g, or t
  modified_base (231)..(231): a, c, t, g, unknown or other
  misc_feature (231)..(231): n is a, c, g, or t
  modified_base (263)..(263): a, c, t, g, unknown or other
  misc_feature (263)..(263): n is a, c, g, or t
tcagtacacacactcacgaccggtgctcgatttagtacacgtgattagggattgggggagaactgctcagttaggacccagagggaaccatggaacgccccagcgcagcttctcttcctcctgcttctctggcctccagataccgaccggaagtaattgtgttcgacgctagtcctccgaggcctacccgttgttctttcgcctaccgagggacagacncctacctcctcngcgacggcctagcagtactgtacgcaggcgtnttcgtgcgtgtacagcaacgtaaccgcgacctacggtcctccgagtcctcctaccttgagtcgcgacctacctccgaccggacggtccacgcgacctacgcccgagtacgtacggtacgtacggtcggacgtggggttcggacgtacgggaacctagtacctttccaccgttacctaccgaactacgtaccgaagaccgtacgtacgacgtacgtaagtagtttacgttacgacttacggttacttacgttaccgtacgttaacgcggtaacgtttaacgtacgggtaacgggttacggggacgttaaacccgggtacccggggtaaacggaaaggtaccgggttaaacggttaacgaaacgttaaaccgaaacgggtaacgtttcggacgttagacccgtaacgtacgtctacggtttacacctttccgaccgttacccgcccgtaacg

SEQ ID NO: 165076 - DNA, 163 bp, Homo sapiens
  misc_feature: GYAE6OF02IO8B1.33.23.C01.1.454.CMB.1.raw
  modified_base (157)..(163): a, c, t, g, unknown or other
  misc_feature (157)..(163): n is a, c, g, or t
tcagtacacacactcacgaccggtgctcgatttagtacacgtgattagggatgggagggaccaaggtggagctcaaacgaactgtggctgcaccatctgtcttcatctttccgccatctgaagtgtgtgtactgagcgggctggcaaggcgcatagnnnnnnn

SEQ ID NO: 165077 - DNA, 533 bp, Homo sapiens
  misc_feature: GYAE6OF02HBCD3.33.23.C01.1.454.CMB.1.raw
  modified_base (262)..(262): a, c, t, g, unknown or other
  misc_feature (262)..(262): n is a, c, g, or t
tcagtacacacactcacgaccggtgctcgatttagtacacgtgattagggattgggggaggaactgctcagttaggacccagagggaaccatggaagccccagctcagcttctcttcctcctactactctggctcccagataccaccggagaagttgtgttgacgcagtctccaggcaccctgtctttgtctccaggggaaagagccaccctctcctgcagggccaatcagagtgttagcagtaacttagtctggtaccaanatagacctgaccaggctcccaggctcctcatctacgatgcgtccaacagggccactggcatcccagccaggttcagtggcagtgggtctggggacaggacttcactctcaccatcagcaacctagaacttgaagtatttttcattttattactgtctaacatcacggcagctggcctctctactttcggcggtagggacctaagggtggacgcgttacaaacgtactgtggctggaccacatctgtccttcacttcctttcccgccatccg

SEQ ID NO: 165078 - DNA, 516 bp, Homo sapiens
  misc_feature: GYAE6OF02ISD7Z.33.23.C01.1.454.CMB.1.raw
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtctttgtctccaggggaagagccaccctctcctgcagggccaatcagagtgttagcagtaacttagtctggtaccaacatagacctgaccaggcctcccaggctcctcatctacgatgcgtccaacgagggccactggcatcccagccaggttcagtggcagtgggtctgggacagacttcactctcaccatcagcaacctagaacttgaagtatttttcattttatactgtaccaatatcacggcagctgcctctctactttcggcggaggaccagggtgacgctacgaacgactggtggctgcacatcgtgtcttcactccttcccgctac

SEQ ID NO: 165079 - DNA, 581 bp, Homo sapiens
  misc_feature: GYAE6OF02IC78E.33.23.C01.1.454.CMB.1.raw
  modified_base (310)..(310): a, c, t, g, unknown or other
  misc_feature (310)..(310): n is a, c, g, or t
  modified_base (371)..(371): a, c, t, g, unknown or other
  misc_feature (371)..(371): n is a, c, g, or t
  modified_base (403)..(403): a, c, t, g, unknown or other
  misc_feature (403)..(403): n is a, c, g, or t
  modified_base (421)..(421): a, c, t, g, unknown or other
  misc_feature (421)..(421): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtctttgtctccaggggaaagagccaccctctcctgcagggccaatcagagtgttagcaagtaacttagtctggtaccaacatagacctgaccaggctccaggctctcatctacgatgcgtccaaacngggccactggcactcccagccaggttcagtggcagtgggtctgggacagacttcgactctnaccatcagcaactagtaactgaagttattttntattttatactgtcaaanattacacggtcagtctcggccttctaccgtaacttttcgggacgggaacgggaccaaggggttcgaggtacctacgaaaaccggacgtggttacggacgttcggacctaacccgtagttcgttacggtctttaccgtattaccccgttcccgacctaacg

SEQ ID NO: 165080 - DNA, 159 bp, Homo sapiens; identical to SEQ ID NO: 164997
  misc_feature: GYAE6OF02FQ57D.33.23.C01.1.454.CMB.1.raw
  modified_base (157)..(159): a, c, t, g, unknown or other
  misc_feature (157)..(159): n is a, c, g, or t

SEQ ID NO: 165081 - DNA, 539 bp, Homo sapiens
  misc_feature: GYAE6OF02JXH3Y.33.23.C01.1.454.CMB.1.raw
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtctttgtctccaggggaagagccaccctctcctgcagggccaatcagagtgttagcagtaacttagtctggtaccaacatagacctgaccaggctcccaggctctcatctacgatgcgtccaacagggccactggcatcccagccaggttcagtggcaggtgggtctgggacagacttcactctcacatcagcaactagacttgaagtatttttcattttatactgtacaatatcacggcagcttggcctctcacgtttcggcggaggaccaagggtgacgcgtacgaacgactggtcggtctggaccaccgtagttccgtggttccctttacgacgtttcccttacccgactacg

SEQ ID NO: 165082 - DNA, 185 bp, Homo sapiens
  misc_feature: GYAE6OF02I96WI.33.23.C01.1.454.CMB.1.raw
  modified_base (160)..(185): a, c, t, g, unknown or other
  misc_feature (160)..(185): n is a, c, g, or t
tcagtacacacactcacgaccggtgctcgatttagtacacgtgattagggagtgggagggaccaaggtggagctcaaacgaactgtggctgcaccatctgtcttcactcttcccgccatcctgaagtgtgtgtactgagcgggctggcaaggcgcatagnnnnnnnnnnnnnnnnnnnnnnnnnn

SEQ ID NO: 165083 - DNA, 590 bp, Homo sapiens
  misc_feature: GYAE6OF02F8LIZ.33.23.C01.1.454.CMB.1.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccagccacctgtctttgtctccaggggaangccaccctntcctgcagggccagtcagagtgctggcagcaacttagcctggtaaccaacaaaacctggaccagactccaggcctcctcatctatgatgcatccaccgaggccactgcactcccagccaggttcaggtcggcaggtgggtctgggactagacttcactctcactatcagcagcctagacgcctgaacgtatttgacttagtttacttactgtacagtcagtcgtagcgtaacgtcggttacgttggtaccgtttcgggaccgtaaacgggtaccgtaagggtacgggtaaactaccggtaaaacggtaacgtacggtacgggtaccgttacgaccgtaaccgtacttacccgtaggtttacccttacgtacctttccccg

SEQ ID NO: 165084 - DNA, 608 bp, Homo sapiens
  misc_feature: GYAE6OF02G5CSC.33.23.C01.1.454.CMB.1.raw
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtctttgtctccaggggaaagagccaccctctcctgcagggccaatcagagtgttagcagtaacttagcctggtaccaacaaaaacctggccagactcccaggctcctcatctatgatgcatcccaccgacgggccacgtggccactcccagccaggttcaggtgcaggtgggtctgggacagtacttcactctcacatcagcagcctagacgtcctagaagtcttttgacttaggttttacttacgttgttactcgtacagtcgtagcctaaacgttcgggaacccttaacctacccggtttccggacccgaaacggggtaccacggtaaccgtagggaacgtaacgttaaaccgaacgttggtacggcgtacggacccgaccgtacgttcgtcgttccctttacgtaccttcccgttaccccgg

SEQ ID NO: 165085 - DNA, 632 bp, Homo sapiens
  misc_feature: GYAE6OF02HSF64.33.23.C01.1.454.CMB.1.raw
  modified_base (453)..(453): a, c, t, g, unknown or other
  misc_feature (453)..(453): n is a, c, g, or t
tcagtacacacactcacgaccggtgctcgatttagtacacgtgattagggagttgggggaggaacgttgtcgtcgagtttacggacccaaggacgggaaccactggtaacgcccctagctcagccgttcctcgttcctccgtgactacctctggctcccagactaccaccggtagaaattgtgttgactacgagtcctccggtccacctgtctttgtcttcctagggtaagcgccgaccctcgtcctgccagggccagtcagagtgttagcggtactagcctgtaccacagagacctcgcagcctcccaggctcctcttcatcgatgtcatccgaacgcgggccaagtcggcactcccagcctaggttcaggtcggcggtcgggtcccgtggggaaccaggtccttcaacttctacgaccagtctaggcagtccgtagacgccgtagtaagtntttgcttaagtttacgtactgtacagtctagtcgtagtcgacgtggtcgtcggtacgttcggaccgtaacggtaccgtaaggtacggaaacgtaccgaaacgtaacgtcgtacggtccgtcgtaccctacgtactccgttcgttaccttacgtacttcccttacccgtcgtacgtaccg

SEQ ID NO: 165086 - DNA, 496 bp, Homo sapiens
  misc_feature: GYAE6OF02F2YH2.33.23.C01.1.454.CMB.1.raw
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggagaaagagccaccctctcatgcagggccagtcagagtattagcatcttcttggcctggtaccaacagaaacctggccaggctcccaggctcctcatccagaatgcattcaacagggccactggcatcccagccaggttcagtggcagtggtctgggacagacttcactctcaccatcagcagcctagagcctgaggattctgctagtttattactgtcagcagcgtctcaactggcctccgtgcaccttcgccagggacacgattggagattagacgaactggtaggctgccaccctcg

SEQ ID NO: 165087 - DNA, 519 bp, Homo sapiens
  misc_feature: GYAE6OF02HDU3O.33.23.C01.1.454.CMB.1.raw
  modified_base (204)..(204): a, c, t, g, unknown or other
  misc_feature (204)..(204): n is a, c, g, or t
  modified_base (290)..(290): a, c, t, g, unknown or other
  misc_feature (290)..(290): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtctttgtctccaggggaaagngccaccctctcctgcagggccaatcagagtgttagcagtaacttagtctggtaccaacatagacctgaccaggctccaggctcctnatctacgatgcgtccaaacagggccactggtatcccagccaggttcagtgcaggtggtctgggacagacttcactctcaccatcagcaacctagaacttgaatatttttcattttattactgtacaaacatcacggcagctggcctctctactttcggcggaagggaccaagggtgagctacgaaacgaactgtggctgacacatctgtcttcattccttccgctatcg

SEQ ID NO: 165088 - DNA, 539 bp, Homo sapiens
  misc_feature: GYAE6OF02HUN8D.33.23.C01.1.454.CMB.1.raw
  modified_base (301)..(301): a, c, t, g, unknown or other
  misc_feature (301)..(301): n is a, c, g, or t
  modified_base (354)..(354): a, c, t, g, unknown or other
  misc_feature (354)..(354): n is a, c, g, or t
tcagtacacacactcacgaccggtgctcgatttagtacacgtgattagggattgggggaggaactgctcagttaggacccagagggaaccatggaagccccagctcagcttctcttcctcctgcttctctggctcccagataccaccggagaaattgtgttgacgcagtctccaggcaccctgtctttgtctccaggggaaagagccaccctctcctgcagggccagtcagagtgttagcgggtacctagcctggtaccagcagacacctggccaggctcccaggctcctcatccatggtncatccacagggccactggcatcccagacaggttccaggtggcaggttgggtcngggacagacttcattctcaccatccagcagactggacgcctaggaagtatttgctagtagtattactgtcagcaggttacgtagttcatctccgtacgttcggaccgaagggaccaaagggtgaagtacaaacgtaacgtaggtaggctcgacacctatcgtagttcttactacttcctaccccg

SEQ ID NO: 165089 - DNA, 158 bp, Homo sapiens; identical to SEQ ID NO: 165033
  misc_feature: GYAE6OF02G2E4K.33.23.C01.1.454.CMB.1.raw
  modified_base (157)..(158): a, c, t, g, unknown or other
  misc_feature (157)..(158): n is a, c, g, or t

SEQ ID NO: 165090 - DNA, 514 bp, Homo sapiens
  misc_feature: GYAE6OF02HZ4P9.33.23.C01.1.454.CMB.1.raw
  modified_base (203)..(203): a, c, t, g, unknown or other
  misc_feature (203)..(203): n is a, c, g, or t
  modified_base (367)..(367): a, c, t, g, unknown or other
  misc_feature (367)..(367): n is a, c, g, or t
  modified_base (372)..(372): a, c, t, g, unknown or other
  misc_feature (372)..(372): n is a, c, g, or t
  modified_base (380)..(380): a, c, t, g, unknown or other
  misc_feature (380)..(380): n is a, c, g, or t
  modified_base (433)..(433): a, c, t, g, unknown or other
  misc_feature (433)..(433): n is a, c, g, or t
  modified_base (446)..(446): a, c, t, g, unknown or other
  misc_feature (446)..(446): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccagccaccctgtctttgtctccaggggaaangccaccctctcctgcagggccagtcagagtgctggcagcaacttagcctggtaaccaacaaaaaacctggaccagactcccaggcctcctcatctatgatgcatccaccgagggccactggcactcccagccagttcagtggcagtgggtctgggacagacttnattcncacatcancagcctagacgtctgaagtatttgctaagttttacttactgttctgcagcgtncaatcgcctaacnccttcgaccaaggacacgatggacgtaataaacgacttaggcgactgcacctattctgttcttctacg

SEQ ID NO: 165091 - DNA, 659 bp, Homo sapiens
  misc_feature: GYAE6OF02G82CK.33.23.C01.1.454.CMB.1.raw
tcagtacacacactcacgaccggtgctcgatttagtacacgtgattagggattgggggaggaactgctcagttaggacccagagggaaccatggaagccccagctcagcttctcttcctcctgctactctggctcccagataccaccggggaaattgtgttgacacagtctccagccaccctgtctttgtctccaggggaaagagccaccctctcctgcagggccagtcagagtgctggcagcaacttagcctggtaaccaaacaaaaacctggaccagactcccaggctcctcatctatgatgcatccaccagggccacgtggcactcccagccaggttccagtggcaggtgggtctgggacaggtacttcgacctctaccgacatcagccacgtcccgtaagacgtcctaggtaaagttagttttcgactttagttttactttacgttagtttcgtagcgtagtcggttacgactaaccgttcgggtacccttaaaccgtcccgtttacggaacccgtaaaggggaccaacgggtaacctaggggaacgttaaacgtttaaaacccggaacgttacgggtacgggtacccgttacggtacccgtaacccgttacgttacccgttacggttttacccttacgttaaccctttcccccg

SEQ ID NO: 165092 - DNA, 532 bp, Homo sapiens
  misc_feature: GYAE6OF02GX6GW.33.23.C01.1.454.CMB.1.raw
  modified_base (203)..(203): a, c, t, g, unknown or other
  misc_feature (203)..(203): n is a, c, g, or t
  modified_base (381)..(381): a, c, t, g, unknown or other
  misc_feature (381)..(381): n is a, c, g, or t
  modified_base (408)..(408): a, c, t, g, unknown or other
  misc_feature (408)..(408): n is a, c, g, or t
  modified_base (427)..(427): a, c, t, g, unknown or other
  misc_feature (427)..(427): n is a, c, g, or t
  modified_base (511)..(511): a, c, t, g, unknown or other
  misc_feature (511)..(511): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtctttgtctccaggggaaanagcccaccctctcctgcagggccaatcagagtgttagcagttaacttagtctggtaccaacatagacctgaccaggctccaggctcctcatctacgatcgcgtccaacgacgggccaacgtggccactcccagccaggttcagtggcaggtgggtctgggacagacttcactctcacntcagcaacctagaacttgaatattttnattttatactgtacaactntcacggcagctcggcctctcctactttcgggcggtacgggacctagggtggacgtcgacaacgactgtggctgcacctatcctnttcttcacttctcccgctacg

SEQ ID NO: 165093 - DNA, 618 bp, Homo sapiens
  misc_feature: GYAE6OF02I79HQ.33.23.C01.1.454.CMB.1.raw
  modified_base (262)..(262): a, c, t, g, unknown or other
  misc_feature (262)..(262): n is a, c, g, or t
  modified_base (449)..(449): a, c, t, g, unknown or other
  misc_feature (449)..(449): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtctttgtctccaggggaaagagccaccctctcctgcagggccaatcagagtgttagcagtaacttagtctggtaccaanatagacctgaccaggctcccaggcctcctcatctacgatgtcgtaccaacgacgggccacgtggccactccccgagcctaggttccagtggctaggtcgggtctgggactagacttcactctcaccactcacgacaactagacgtcctagaagtattttagacgttagtttacttacgtgtacgtancgacgtcgtagctaacgttggttcgttagggaccgttccgggaccgtaacgggaaccgtaaagggtcggaaaacgtaccgtaaacggtacttacggtcggacgtacggacctaacctaccgttacgttcgttaccctttaccgactttcccgttaccccgaccttaacg

SEQ ID NO: 165094 - DNA, 519 bp, Homo sapiens
  misc_feature: GYAE6OF02F7O8E.33.23.C01.1.454.CMB.1.raw
  modified_base (496)..(496): a, c, t, g, unknown or other
  misc_feature (496)..(496): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtctttgtctccaggggaaagagccaccctctcctgcagggccaatcagagtgttagcagtaacttagtctggtaccaacatagacctgaccaggctcccaggctcctcatctacgatgcgtccaacagggccactggcatcccagccaggttcagtggcagtgggtctgggacagacttcactctcaccatcagcaacctagaacttgaagtatttttcattttatactgtacaactatcacggcagctggccttctctacgtttcggacggagggacctaaggtgacgctacgaacgactgcggctgcaccntcgtgtcttcactctcccgctac

SEQ ID NO: 165095 - DNA, 659 bp, Homo sapiens
  misc_feature: GYAE6OF02IUAQP.33.23.C01.1.454.CMB.1.raw
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggagaaagcgccacctctcatgcagggccagtcagagtattagcattcttcgtggcctaggtaccaacaagaaacctggccaggcctcccgaggcctcctcactccaagtaactgactattacaacgagggccagtcggacactcccagccgtaggttcaggtcgacgaggtcgggtctgggactagtaccttcaccgttctaccgaacctatacgacgacacggtccctaaggaccggtcctagggaacggtactttccgtgtaccgttaagtttttactaccgtgtaccgagcctagtacgtacgacgttaacgttcgggttacgttcggggtaccgtttccgggaaccggaaacggggtaaccgtaaggggtaacggtaaacgtaaccggaaaaccggtaacgttgggtaccggtacgtaacggccctaaaccgtacgttcgtttacggttaccttaccgg

SEQ ID NO: 165096 - DNA, 615 bp, Homo sapiens
  misc_feature: GYAE6OF02GEKCK.33.23.C01.1.454.CMB.1.raw
tcagtacacacactcacgaccggtgctcgatttagtacacgtgattagggattgggggaggaactgctcagttaggacccagagggaaccatggaagccccagctcagcttctcttcctcctgctactctggctcccagataccaccggggaaattgtgttgacacagtctccagccaccctgtctttgtctccgaggggaaagagccaccctctcctgcagggccagtcagagtgctggcagcaacttagcctaggtaacccaaacaaaaaccgtggaccagacctcccaggctcctcatctatgatgcactccaccgacggccacgtggccacgtacccacgccgaggttccgaggtcggcgtaggtcgggtcgtacggggacacggtacttacaccttctaccacctactcgacgcacgacctaggacgtccgtaggtaagttatttacgacttagtttacgttactgttactgacgtagtacgtagactacgtcgtacctaaccgtccgttaccggacgtaacggacaacgtacgtacggataacgttaaacgacgtagtacggtactacggtaccctacgtacttcgtacgttacttactaccgttcccg

SEQ ID NO: 165097 - DNA, 729 bp, Homo sapiens
  misc_feature: GYAE6OF02I0BKY.33.23.C01.1.454.CMB.1.raw
  modified_base (206)..(206): a, c, t, g, unknown or other
  misc_feature (206)..(206): n is a, c, g, or t
  modified_base (264)..(264): a, c, t, g, unknown or other
  misc_feature (264)..(264): n is a, c, g, or t
  modified_base (291)..(291): a, c, t, g, unknown or other
  misc_feature (291)..(291): n is a, c, g, or t
tcagtacacacactcacgaccggtgctcgatttagtacacgtgattagggagttgggggagggaactgctcagttaggacccagagggaaccatggaagccccagctcagcttctcttcctcctgctactctggctcccagataccaccggagaagttgtgttgacgcagtctccaggcaccctgtctttgtctccgaggggaaangccaccctctcctgcagggccaatcagagtgttagcagtaacttagtctggtaccaanatagacctgaccaggctccaggcctcncatctacgatcgctaccaaacgacgggccactggccaactccccgaaggcccaagggttcagggtcggctaggtggggtctaggggactaaggtctttacacttctaccgaacctagtccaacggacctaaacccgtagtaaaccgtttagaaagtttacttttttacgtaattttttaacgtaaccttggtaaccaaacttacttaccgaaccggactaacgtccgttcgggtccccttacgttacccttaaccggttttccggggacgggtaaccgggtaaacccgtaaggggttaccggaaacgtaccccgttaaacgaaaaacccgggtaccgttagggtaccgggtacttaaccggacctaaaccccgttacgttaccgtttcgtttacccgttaccttaacccgtttcccggtttacccccgagtttaaccg

SEQ ID NO: 165098 - DNA, 566 bp, Homo sapiens
  misc_feature: GYAE6OF02IUTVZ.33.23.C01.1.454.CMB.1.raw
  modified_base (203)..(203): a, c, t, g, unknown or other
  misc_feature (203)..(203): n is a, c, g, or t
  modified_base (312)..(312): a, c, t, g, unknown or other
  misc_feature (312)..(312): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtctttgtctccaggggaaangccaccctctcctgcagggccaatcagagtgttagcagtaacttagtctggtaccaacatagacctgaccaggctccccaggcctcctcatctacgatgcgtccaacgngggccactggcactcccagccctaggttcaggtcggctaggttcggggtctggggacagtacttcactctccactatcagccaacctagaacttagaagttatttttactattttattacttagtacaactatcgacgtcagctcgcctctctacgtttccggcggacgggacctaagggtcggacgctacgaacgtacgtggtcgcgtagtcacctattcgttcttccttcactttcccttcccgaccttacg

SEQ ID NO: 165099 - DNA, 509 bp, Homo sapiens
  misc_feature: GYAE6OF02GPFFU.33.23.C01.1.454.CMB.1.raw
  modified_base (203)..(203): a, c, t, g, unknown or other
  misc_feature (203)..(203): n is a, c, g, or t
  modified_base (463)..(463): a, c, t, g, unknown or other
  misc_feature (463)..(463): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtctttgtctccaggggaaanagccaccctctcctgcagggccaatcagagtgttagcagtaacttagtctggtaccaacatagacctgaccaggctcccaggctcctcatctacgatgcgtccaacagggccactggcatcccagccaggttcagtggcagtgggtctgggacagacttcactctcacatcagcaacctagaacttgaagtatttttcattttatactgtacaacatcacgcagctggcctctctacttcggcggaggaccgaggtggancgtacaacgactgtggctgcacatctgtcttcattcttcccgctac

SEQ ID NO: 165100 - DNA, 579 bp, Homo sapiens
  misc_feature: GYAE6OF02GDA8A.33.23.C01.1.454.CMB.1.raw
  modified_base (204)..(204): a, c, t, g, unknown or other
  misc_feature (204)..(204): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtctttgtctccaggggaaagngccaccctctcctgcagggccaatcagagtgttagcagtaacttagtctggtaccaacatagacctgaccaggctcccaggctcctcatctacgatgccgtaccaacgacgggcccacgtggcactccccgaagccctaggttccagtcggacaggtcggggtctggggactagtacttcactctccacatcagcaaacctagaacttgaaagttatttttacatttttacttacttgtaccaaactattacacggcacgtctcggtcctctcgtactttcgggcggacgggaccgaagggtgacgctaaccaacgtacgtggtcggtctagccaccgtatcgttacgttcttacctatcccgttacccgctacg

SEQ ID NO: 165101 - DNA, 799 bp, Homo sapiens
  misc_feature: GYAE6OF02HCTT2.33.23.C01.1.454.CMB.1.raw
tcagtacacacactcacgaccggtgctcgatttagtacacgtgattagggattgggggaggaactgctcagttaggacccagagggaaccatggaagccccagctcagcttctcttcctcctgctactctggcctccagataccaccggagaagttgtgttgacgcagtctccaggcaccctgtcttgtctccgagggaagcgccacctctcctgcagggaccaatcgagagttgttagcgtaacgttaactttacgtcgttacggtaaccaaactagttaacggaccttacggaacccgacgggtccttaccccgaacggcccttcccgtactaacgttccgtaaccgtacgttcggaccgtacccgaaacgtacggggaccctacggttacggccacgtaccccgacgaccgttacggttcgtaggtcggacgtaggttcggggtacgttacggggactacggtaccttaccgtaacttccgtaccaacctacgtacgaacgtcgtaaccgtccgtaaggtaccgtacccgttaggtaaacgttttacgttttacggaaccgtttaacggtttttaactttaccggttaggttaccgttagccggttaacggtccgttaagacccgttaaccgtacgggtaacccttaaccgtacccgtttaccgggaaccggtaaacgggtaacccgtaacggtaaccggttaggaacgtttacgttaacggaacggtaacgttggtacggtacgttccgaccctaccgttccgtcgttacccttacgtacctttcccgtaccccg

SEQ ID NO: 165102 - DNA, 690 bp, Homo sapiens
  misc_feature: GYAE6OF02H85CW.33.23.C01.1.454.CMB.1.raw
  modified_base (202)..(202): a, c, t, g, unknown or other
  misc_feature (202)..(202): n is a, c, g, or t
  modified_base (272)..(272): a, c, t, g, unknown or other
  misc_feature (272)..(272): n is a, c, g, or t
  modified_base (661)..(661): a, c, t, g, unknown or other
  misc_feature (661)..(661): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtctttgtctccaggggaanagccaccctctcctgcagggccaatcagagtgttagcagtaacttagtctggaccaacatagtacctacncgacgcgcccaccgcgtccctctactacttaccgactcgtcgtacccgtaaccgaacggtccggaccctacgggtccgacctacccgaccgccgtacggttacggtacgtaggcgtaacggtcggggttcggtacggtacggaacgtacgttacgtacctccctacgtaccaactcacgactaaaccctaactaacggtttaacgttagtaacttttttacctttaacgtttttaattttacgttaacgttccttaaaccaacgttacccgtacggaccgtaccgtcgtccggtaccttccttacgtaaccgtttcggtaccgggacgggtaaccgaagggtacggcggaacttccgaaacgaaccgtgttacggcgtcgtcacctacngttacgttctactctaccttcccgcgtac

SEQ ID NO: 165103 - DNA, 682 bp, Homo sapiens
  misc_feature: GYAE6OF02IKLOR.33.23.C01.1.454.CMB.1.raw
  modified_base (297)..(297): a, c, t, g, unknown or other
  misc_feature (297)..(297): n is a, c, g, or t
  modified_base (679)..(679): a, c, t, g, unknown or other
  misc_feature (679)..(679): n is a, c, g, or t
  modified_base (681)..(682): a, c, t, g, unknown or other
  misc_feature (681)..(682): n is a, c, g, or t
tcagtacacacactcacgaccggtgctcgatttagtacacgtgattagggattgggggaggaactgctcagttaggacccagagggaaccatggaagccccagctcagccttctcttcctcctgctactctggctcccaggggaaagagccaccctctcctgcagggccagtcagagtgttagcgggtacctagcctggtaccaacagacgacctggccaggctcccaggctccgtcttacatgatgcatccaaagcggccacgtgcatcccagcctaggtcaggtggcggtcggtntcggggaactacgtactttccaactttccacaacctatcgaacggccaaagtcccttaaaggctaccgtaggtaaacgtatttttcgacgttaaagttttaactttaaccgtgtaccgagaccgtaggtacgtaacgacctaaacgtttcggggttacgttcgggtacggttttaccgggaaccgtaaacgggaaccgtaaacgggttaacgggaaaacttaccgaaaaacggaacgttacggtacggtacgtacgtaccgaacgtacttacgtacgttactttacacttaccgttcccgtacctaacttcgtaacgtaacggtgttcgttacgtacgtaggcggtacgggcgtaggacgtacgggagacgtacgtaggacngnn

SEQ ID NO: 165104 - DNA, 591 bp, Homo sapiens
  misc_feature: GYAE6OF02GQW8H.33.23.C01.1.454.CMB.1.raw
  modified_base (413)..(413): a, c, t, g, unknown or other
  misc_feature (413)..(413): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtctttgtctccaggggaagagccaccctctcctgcagggccaatcagagtgctggcagcaacttagcctggtaccaaacaaaacctggaccagactccaggctcctcatctatgatgcatccaccgacgggccacgtggccactccccagccctaggttccaggtggacaggtcggtctgggacacgacttcactctcaccatcagcacgcctagacgtcctagtaagtntttcgacttagtttaacttacgtgtctgacgacgtcgtagctaacgtccggtacctaaccgtccgttaccgggaccgaaacgggaccgtaaccgacgtacgggaacgttaacgtaaaaccgtaacgttcgggtacgtacgtccgaccaacctacgttacttcgttacttaccctaccg

SEQ ID NO: 165105 - DNA, 625 bp, Homo sapiens
  misc_feature: GYAE6OF02IZ8UQ.33.23.C01.1.454.CMB.1.raw
  modified_base (203)..(203): a, c, t, g, unknown or other
  misc_feature (203)..(203): n is a, c, g, or t
tcagtacacacactcacgaccggtgctcgatttagtacacgtgattagggagttgggggaggaactgctcagttaggacccagagggaaccatggaagccccagctcagcttctcttcctcctgctactctggctcccagataccaccggagaagttgtgttgacgcagtctccaggcaccctgtcttgtctccaggggaagngccaccctctcctgcagggccaatcagagtgttagcagtaacttagtctaggtaaccaacatacgacctgaccaggcctcccgaggcctcctcactccagtaatgacattcaacgacgggccacgtggcactcccagccgtaggttcgagtcggactaggtcgggtcgtcgggacaggtacttctattcctaccacctataccagcaacgtacgtaggacgtccgtagtaacgttagtttcgacgtaggttacgttactttacgtgttacagtacgtaacggttacgggttacgtttcgtacgttccgtaccgtacggttaccggaccgtaacgggaccgtaagggtagtaacgtacgaaacgtacgtggtacgcgtacgacctacgtacgttacgtacgttactactacgttccttccccg

SEQ ID NO: 165106 - DNA, 586 bp, Homo sapiens
  misc_feature: GYAE6OF02GW4WN.33.23.C01.1.454.CMB.1.raw
  modified_base (202)..(202): a, c, t, g, unknown or other
  misc_feature (202)..(202): n is a, c, g, or t
  modified_base (375)..(375): a, c, t, g, unknown or other
  misc_feature (375)..(375): n is a, c, g, or t
  modified_base (429)..(429): a, c, t, g, unknown or other
  misc_feature (429)..(429): n is a, c, g, or t
tcagtacacacactcacgaccggtgctcgatttagtacacgtgattagggattgggggaggaactgctcagttaggacccagagggaaccatggaagccccagctcatcttctcttcctcctgctactctggctcccagataccaccggagaagttgtgttgacacagtctccagccaccctgtctttgtctccaggggaanagccaccctctcctgcagggccagtcagagtgctggcagcaacttagcctaggtaaccaaacaaaacctggaccagacctcccaggcctcctcatctatgtatgctactcccaccgacgggcccacgtcggcactcccacggccaggttcagtggcgaggtgggtctgggacncggtacttcactctcaccatcgagcacgcctaagcgcctagaaacgttgtttanacgttaagttttacttcgttgtacttgcgtaggcgttacgacgtaacgtcggtaccctaacgtccgttaccgaccgaaagggaccacgacgtaggaactaacgttaaacgacgtcggacggtcttagacctacgtactcgttcgttaccttgtaccg

SEQ ID NO: 165107 - DNA, 619 bp, Homo sapiens
  misc_feature: GYAE6OF02GQJHJ.33.23.C01.1.454.CMB.1.raw
  modified_base (202)..(202): a, c, t, g, unknown or other
  misc_feature (202)..(202): n is a, c, g, or t
  modified_base (421)..(421): a, c, t, g, unknown or other
  misc_feature (421)..(421): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtctttgtctccaggggaangccaccctctcctgcagggccaatcagagtgttagcagtaacttagtctggtaccaaacaaaaacctggaccagacctcccaggcctcctcattcctatgatgcatcccaccgacgggccacgtggcactcccagccaggttcagtcggctaggtcgggtcgtgggacagtacttcactctaccactatcacgcacgcctagacgtccgtagaacgttnttttgacttaagttttacttacgtcgttcgtgacgtagtcgtagacctaacgtcggtacctaaccgtccgttccggacgaaacgggtaccaacggtacgtagggaactaacgttaaaccggacgttcggacggtacgtacgtacccgaaccgttacttccgttacggttccctttacgttaccttcccgttacccccg

SEQ ID NO: 165108 - DNA, 727 bp, Homo sapiens
  misc_feature: GYAE6OF02JYCGJ.33.23.C01.1.454.CMB.1.raw
tcagtacacacactcacgaccggtgctcgatttagtacacgtgattagggagttgggggaggaacgtgcgtcagttaggaccagagggaaccatggaagccccagctcagcttctcttcctcctgctactctggctcccagataccaccggagaagttgtgttgacgcagtctccaggccaccctgtctttgtctccgaggggtaaagcgcccaccctctccgtgcacgggcaatcagacgtgttagcagttacttaggtctggaaccaatatacgacctagaccaggtctccccgaggcctcctcatcctacgatcggaccgtcccaaacgtacggccctacgtacggccaacgtccccgaacggtcccgtaacgggttccgaggttccgggtacagggttcggggtaccgttacggggaaccgtaggtttaccctcgtaaccgtccctcacccgtactacggaactaccctaaacccgtaggtaaccgttacgttaacggtttacttttaacgttaagtttttacttaaccgttagtaactaacgtataccgtacgactcgtactcgtacctcgttacctcgttacgggtccggtaacggaccgtaagggcgtacgtacgtaaccgtaaacgcgtacgggtacggtccgtacgtactaacccgttaacgtccgttttacgttcccgttaaccgttcgtttaccccgttacccgtaaccttaacgg

SEQ ID NO: 165109 - DNA, 574 bp, Homo sapiens
  misc_feature: GYAE6OF02FRKIJ.33.23.C01.1.454.CMB.1.raw
  modified_base (203)..(203): a, c, t, g, unknown or other
  misc_feature (203)..(203): n is a, c, g, or t
  modified_base (569)..(569): a, c, t, g, unknown or other
  misc_feature (569)..(569): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtctttgtctccaggggaaangccaccctctcctgcagggccaatcagagtgttagcagtaacttagtctggtaccaacatagacctgaccaggcctcccaggcctcctcatctacgatcgcgtccaacgagggcccacgtggcactccccagccaggttcagtcggcaggtgggtctggggacagacttcactctcaccatcacgcaacctagaactgaatatttttcattttatactgtacaactatcacggtcagctcggccttctctacgtttccgggacgggtacggaccgtaagggtcggacgtactacgaaacgtacgttggtacggctacgaccaaccgtattccgttacgttccttaccacgtttcccgttaccccgntaccg

SEQ ID NO: 165110 - DNA, 720 bp, Homo sapiens
  misc_feature: GYAE6OF02FNP7T.33.23.C01.1.454.CMB.1.raw
  modified_base (203)..(203): a, c, t, g, unknown or other
  misc_feature (203)..(203): n is a, c, g, or t
  modified_base (213)..(213): a, c, t, g, unknown or other
  misc_feature (213)..(213): n is a, c, g, or t
  modified_base (289)..(289): a, c, t, g, unknown or other
  misc_feature (289)..(289): n is a, c, g, or t
  modified_base (312)..(312): a, c, t, g, unknown or other
  misc_feature (312)..(312): n is a, c, g, or t
  modified_base (457)..(457): a, c, t, g, unknown or other
  misc_feature (457)..(457): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtctttgtctccaggggaaanagccaccctntcctgcagggccaatcagagtgttagcagtaacttagtctggtaccaacatagacctgaccagctcccagctcctnatcctacgatcgcgtaccaacgngggcccacgtggccactcccgagcccgtaggtttcacggttggccaaggttcggggtcgtaggggaccaaggtacccttacaccgttctccaaccctagtacccaaggaaccctaacccgtaagtaaacctttaggaaacgtttnttttttactaagttttttaactacttcgttaaccaaacgttacttaccgaccgggtcaacggtccgttacggcccttccttaccgtaccggttttccgggaccggggtaacgggtaacccggtaaaggggttccggaaacgtccgtaaccgtaaaacggtaccgttcgggacgggttacctacggtaccctaacccgttacggtcgtttaccgtttaccgttttacccgacctttttccccggttaccccgtcgtttaacccg

SEQ ID NO: 165111 - DNA, 507 bp, Homo sapiens
  misc_feature: GYAE6OF02F9PTA.33.23.C01.1.454.CMB.1.raw
  modified_base (293)..(293): a, c, t, g, unknown or other
  misc_feature (293)..(293): n is a, c, g, or t
  modified_base (504)..(504): a, c, t, g, unknown or other
  misc_feature (504)..(504): n is a, c, g, or t
tcagtacacacactcacgaccggtgctcgatttagtacacgtgattagggtagttgggggaggaactgctcagttaggacccagaggaaccatggaagccccagctcagcttctcttcctcctgctactctggctcccagataccaccggagaagttgtgttgacgcagtctccaggcaccctgtctttgtctccaggggaaagagccacccgtctcctgcagggccaatcagagtgttagcagtaacttagtctggtaccaacatagacctgaccaggctcccaggctcctnatctatgatgcatccaccgaggccactggcatcccagccagttcagtggcagtgggtctgggacagacttcactctcaccatcagcagtcctagacgcctgaagtatttgctagtttattactgtctgctagtcgtagcaactcggacctaacaccgttcggccaagggacacgactggagagtaaacgactgcgctgcacatctgtcctntac

SEQ ID NO: 165112 - DNA, 666 bp, Homo sapiens
  misc_feature: GYAE6OF02GY8RL.33.23.C01.1.454.CMB.1.raw
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcacctgtcttgtctccaggggaaagagccaccctctcctgcagggccaatcagagtgttagcagtaacttagtctaggtaccaacatagacctgaccaggctaccccgaggcctcctcatctacgatcgccgtccaacgacgggccacgtggccactcccagccgacggttcagtcggctaggtgggtcgtgggacagcttcactctcactatcacgaccaaccgtacgtaacttagtaaagtttactttttacttaattttaacgtttacttacggttacctaaacgtacttaccgtaacggtacctaggtccgtcggtcccttacgtccgttaccgtttcgggaccgggtaacgggtaaccgtaagggttacgggacgtaccgttaacgaaaacgttccggttacggtacgggtctacggacccgtaacctacgttaccgttacggttccgtttactacccgtttcccgtttccccgtccgttaaccg

SEQ ID NO: 165113 - DNA, 757 bp, Homo sapiens
  misc_feature: GYAE6OF02GG99O.33.23.C01.1.454.CMB.1.raw
  modified_base (205)..(205): a, c, t, g, unknown or other
  misc_feature (205)..(205): n is a, c, g, or t
  modified_base (244)..(244): a, c, t, g, unknown or other
  misc_feature (244)..(244): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccgaggcaccctgtctttgtctccgaaggggaancgcccaccctctcctgcgagggccaatcagagtggttanctagtaacttagtcgtacggtaaccaacatagacctgaccgaggcctcccgaggtcctcctacacttcctacgatcgccgtaccaacgacgggcccacgtcggacactcccgacgccgtaggttcaggtcggacgtaggtcggggtcgtagggactacggtaccttacgaaccttccgtaccaaccgtactccgaaccgtaaccctaaacccgttaagtaaacccgtttaggtaaacgttttaactttttttacttaaagttttttaaccgtaacgtttacgtaacctaaaccgttagttaaccgaccgggttactaacgtccgttggtaccccttcgttaccgttaccgggtttacccgggacggggtaaaccggtaccggtaaaggggttcgaacgtaccgttaaacgaaacgggttccttagggtaccggtaccttaacgacctaaccgttacgttaccgttacggtttccttaaccgtaccgtttcccccttccggtaacccttaacgg

SEQ ID NO: 165114 - DNA, 656 bp, Homo sapiens
  misc_feature: GYAE6OF02IAIWU.33.23.C01.1.454.CMB.1.raw
  modified_base (202)..(202): a, c, t, g, unknown or other
  misc_feature (202)..(202): n is a, c, g, or t
  modified_base (262)..(262): a, c, t, g, unknown or other
  misc_feature (262)..(262): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtctttgtctccaggggaanagcccaccctctcctgcagggccaatcagagtgttagcagtaacttagtctggtaccaanatagacctgaccaggctcccaggctcctcattctacgatgccgtaccaacgagggccacgtggcactcccagcctaggttcaggtggcaggtgggtctaggggacagtcttcacttctacacctatccagcctaaacctagtacttagaagtttatttttacgtaatttttactacttacgttactaactacttacgacggtactacgtcttcggacccttcgttaccgttaccggttttccgggaccgggtaacgggtacccgtaaaggggttcggaaacgtcgttaaccgaaacggtacgttaggtcggtaccttacggtaccctaacccgttaagttccgttacgttccctttaccgttaaccgtttcccgtttaccccgacgttaaccgg

SEQ ID NO: 165115 - DNA, 523 bp, Homo sapiens
  misc_feature: GYAE6OF02FWR0I.33.23.C01.1.454.CMB.1.raw
  modified_base (523)..(523): a, c, t, g, unknown or other
  misc_feature (523)..(523): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggctcctcatctatgatgcatccaccagggccactggcatcccagccaggttcagtggcagtgggtctgggacaggacttcactctcaccatcagcagcctagagcctgaagtattttgctagtgtattactgtcagcagcgtagcaactggtcttggacgttcggaccaagggaccaagggtaggaaatacgaaaacgaactgtaggctgccactatcgtgtcttacattccttcccgcctatctgtagtgtcggtgtaacttggagtcgggcgtggaccgaaggcgacgtatagn

SEQ ID NO: 165116 - DNA, 560 bp, Homo sapiens
  misc_feature: GYAE6OF02HMCTP.33.23.C01.1.454.CMB.1.raw
  modified_base (201)..(201): a, c, t, g, unknown or other
  misc_feature (201)..(201): n is a, c, g, or t
  modified_base (260)..(260): a, c, t, g, unknown or other
  misc_feature (260)..(260): n is a, c, g, or t
  modified_base (419)..(419): a, c, t, g, unknown or other
  misc_feature (419)..(419): n is a, c, g, or t
  modified_base (454)..(454): a, c, t, g, unknown or other
  misc_feature (454)..(454): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtctttgctcaggggaaanagccaccctctcctgcagggccaatcagagtgttagcagtaacttagtctggtaccaanatagacctgaccaggcctccaggctcctcatctatgatcgctatcccacagggccctacgtcggcaactcccagcccgtaggttcaggttcggctaggtgggtctaggggacaggtacttcacgtctacacctatcagcagcctagacgcctaggaatntttgacttagtttacttacttgtctgcagtcgtancaacgtcgaccctaagtccgttcggaaccgaacggacaacgcgtaggaacgtaacgtaaacgtacgtggtacggtgtacgtacactattcgtacttcgtactaccg

SEQ ID NO: 165117 - DNA, 675 bp, Homo sapiens
  misc_feature: GYAE6OF02IABXF.33.23.C01.1.454.CMB.1.raw
  modified_base (482)..(482): a, c, t, g, unknown or other
  misc_feature (482)..(482): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggcctcccagataccgaccggagaagttgtgttgacgcagtcctccaggccacccttgttctttcgtcctccgaagggggaaaagcgccctacccttctccgtggccgaggggcccaaggtcaaggtagtgccgtggacaggacctaaacgttcgccgttaggaaacccaaaaccaaaaaccgtcggaccaacgacctacccgaaggcctcctactactactatagatcgacctactacccgaccgacgggccctacgtcggaccacgtacccgacgtcgtacggttcaggttcggcgggttcgggtcgagggtaacacggtacttcacgttccacacctagtcactcgacncgtagcgtcgtagtaagttactttagacttacgtttacttacgtcgttcttacgcgtacgtacgtacgctaaccggtacgaccttaccgtaccgttaccgaacgggttaacgacgtaacgtgtacggaactaacgtaacggtaacgtgacgtacgcgacgtactacgttacggtacttcgtactaccttaccg

SEQ ID NO: 165118 - DNA, 762 bp, Homo sapiens
  misc_feature: GYAE6OF02JUHQ4.33.23.C01.1.454.CMB.1.raw
  modified_base (235)..(235): a, c, t, g, unknown or other
  misc_feature (235)..(235): n is a, c, g, or t
tcagtacacacactcacgaccggtgctcgatttagtacacgtgattagggattgggggagggaactgctcagttaggacccagagggaaccatggaagcccagctcagcttctcttcctcctgctactctgctccagataccaccggagagttgtgttgacgcagtcctccaggtcaccctgttctttgtctccgaaggggaaagacgccaccctctcctcgccgacgggccaanccgagtacgttagtacgcaacgttaacgttacgtctcggtaccaacatacgactacgaccgacggtcctaccgacggtccaccttcgacttctaccgatcgccgtaccaacgaccgggccaccgtcgccacttcccgacgtacccggtcgttacgtacggtcggtacgagggtttcgggggtcgtaggggaccgttacgtaccgttaccgactcccgttaccactaacggtccaaacggtacctaaaccgtaattaccggtttaacgtaacgtttttaacttttacgtttactttttaactttaacgtcttaacctaacgtacgttaccggacgttacgccgttacgttactcccgttactttaacccgttaccggttaccggggtaaccgggtaacggtaaccgggttaaagggtcggtaaacctacgttaaccgtaacgttaccggttaggcggtacgtttccgacctacttaccgttcgttaaccgtttcgtactacccggttttccctacccggtccttacgg

SEQ ID NO: 165119 - DNA, 810 bp, Homo sapiens
  misc_feature: GYAE6OF02GEX62.33.23.C01.1.454.CMB.1.raw
  modified_base (203)..(203): a, c, t, g, unknown or other
  misc_feature (203)..(203): n is a, c, g, or t
  modified_base (237)..(237): a, c, t, g, unknown or other
  misc_feature (237)..(237): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccacctgagaagttgtgttgacgcagtctccaggcaccctgtctttgtctccaggggaaangccacctctcttgtagggccagtcagagtgttancagcaactacttagcctggtaccagcagacacctggccaggcctacccaggcctcccgtcactcccgattgggtcgcctaactcccgaacccgaggggccccaacgttcgggaccctacgttcccccgaaggtaccgtaacgggtttccgaagggttcgggacgtaacgggttcgggggtttaccgttacgggggaacctaacgggttacccttttaccgtaaaccgttttcctaaccccgaacccgttaacgttacccgaacggtaccgtaacggtaaccgttacggggaacggtacccgttaagggtaaacggttaacgtttttcggaaccgttaaggtttggtttaacgtttacgttacgttacgtaaggtacgttaacgggttaaccggtttacggttttactaacggtttacccgtttacccgggtaaccggtttcccgggacccgtaaaccggggtacccgttaaacggggtacggtaaaaccggtaaccggtaaaacggttaaccgttagggttacggtacgtacggtacccgtaaccttacggtacctttagttacctttaaccg

SEQ ID NO: 165120 - DNA, 529 bp, Homo sapiens
  misc_feature: GYAE6OF02F58Y3.33.23.C01.1.454.CMB.1.raw
  modified_base (527)..(528): a, c, t, g, unknown or other
  misc_feature (527)..(528): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccaggggaaagagccaccctctcctgcagggccagtcagagtgttagcgggtacctagcctggtaccaacagagacctggccaggctcccaggcctcctcttctatgatgcatccaacagggccactggcatcccagccaggttcagtggcggtgggtctgggacagacttcactctcaccatcagcagcctagacgcctagaagtattttgctagtttattactgtcagcagcgtagctaacgtggtcttggacgttcggaccaagggaccgaaggtggaaatcgaaaacgactggtggctgccactatctgtctctactccttcccgcctatctagagttgtgttgtacgtggaggcgggcgtcggacgaacggtcgcgtaagtaggctnng

SEQ ID NO: 165121 - DNA, 162 bp, Homo sapiens
  misc_feature: GYAE6OF02FTQ7T.33.23.C01.1.454.CMB.1.raw
  modified_base (158)..(162): a, c, t, g, unknown or other
  misc_feature (158)..(162): n is a, c, g, or t
tcagtacacacactcacgaccggtgctcgatttagtacacgtgattagggatgggagggaccaaggtggagctcaaacgaactgtggctgcaccatctgtcttcatcttcccgccatctagaagtgtgtgtactgagcgggctggcaaggcgcatagnnnnn

SEQ ID NO: 165122 - DNA, 692 bp, Homo sapiens
  misc_feature: GYAE6OF02J11LF.33.23.C01.1.454.CMB.1.raw
  modified_base (326)..(326): a, c, t, g, unknown or other
  misc_feature (326)..(326): n is a, c, g, or t
  modified_base (413)..(413): a, c, t, g, unknown or other
  misc_feature (413)..(413): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtcttgtctaccgaggggaagacgccaccctctcctgaccgacgggccaatcaggagttgttacgactaagttaacttagtctcggtaccaacatagacctcggaccacggctcccgacggccttaccctcacgttcctaacgnttacggccgtaccaacgacggccacgtcgccaacgtcccagtcccgtaggttaccgagtcgggacgtaggtcgggttcgaccggganacggtacttccacgttccaccaacctacttccgacgtacctaaccgtagtaaccgtaggtaaaccgttttatttacttattttacgtactacgtaaccgtaatacgtcgtaccgtctacgtcgtccggtcttccgttcgttaccgttccggggaccggtacgggtaaccggtaaggtgtaacggtaccgtaccgtaaacggtacttacggtcggtcacggccttaccgtacgtttaccgtacggtttcttaccgacgtttccccctaccggtcttaacg

SEQ ID NO: 165123 - DNA, 700 bp, Homo sapiens
  misc_feature: GYAE6OF02H2AGJ.33.23.C01.1.454.CMB.1.raw
  modified_base (205)..(205): a, c, t, g, unknown or other
  misc_feature (205)..(205): n is a, c, g, or t
  modified_base (321)..(321): a, c, t, g, unknown or other
  misc_feature (321)..(321): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggcctccagatacccaccggagtaagttgtgttgacgcagtctcaggcaccctgtctttgtctccgaggggaaancgcccaccctctccgtgcgacgggccagtcaggagtgcgtgggacagctaacgttacgccttacggaaccaaaccaaaaaccgtggacctaacgacctacccgaggtcctacctanacttcctagtgatcgacctactacccgaaccggacggccacgtcggcctaacctccacggtcctaagggttcacggtggccgtagggttcgggtacggtgggaacgtaacgtacgttcctaccgtctacccgactacgtacgagtaccgacgtactacggtacgcgtaagtattactttacgacttagttacttacggtctacgtactacgtactagttagtacgggtagggtaccgtacgggttaaccggacggtaaaccgggtaacgtaaagggaacgttaaacctaccggtaaacggtaacgttgggtaacgtcgtaaccaccggtaactacgttacggttacttaccgttaccgtaccttcccgttacccggaac

SEQ ID NO: 165124 - DNA, 706 bp, Homo sapiens
  misc_feature: GYAE6OF02F1Z46.33.23.C01.1.454.CMB.1.raw
  modified_base (200)..(200): a, c, t, g, unknown or other
  misc_feature (200)..(200): n is a, c, g, or t
  modified_base (216)..(216): a, c, t, g, unknown or other
  misc_feature (216)..(216): n is a, c, g, or t
  modified_base (342)..(342): a, c, t, g, unknown or other
  misc_feature (342)..(342): n is a, c, g, or t
  modified_base (698)..(698): a, c, t, g, unknown or other
  misc_feature (698)..(698): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagatacccaccggagaagttgtgttgacgcagtctccaggcaccctgtcttgtctcagggaangccacctctcctgccnggccaatcagagtcgttagctagtactagtctcggtacaacataacgcctagaccgagccgtcccaggtccctactcgacttcgtaacgctcgccgtaccgaacgcgggtacccacgtgactaccncccgaagccctacgggtcgaacggtggacctaggtcgggtcgtacgggaacaacgtacgttcaccgtacctacgtaccacttaccacgacctaaaaccgttacgaaaaccgtttggaaacgttttaaaccgtttttcctttaattttaaaccgtttaccgttagttaacctaacgttacttaacgtacccggtagtaacggtctacggtcccttacgttacgttaccgtttccggaccgggttaaccggaacgtaaccggtgggacacccgtaacgaaccgtcgttaggtaccgggtctaccgtacgtaaccccgttatccgttcgtttactccggtaacctccgtttacccccgngttaaccc

SEQ ID NO: 165125 - DNA, 726 bp, Homo sapiens
  misc_feature: GYAE6OF02HH4JG.33.23.C01.1.454.CMB.1.raw
tcagtacacacactcacgaccggtgctcgatttagtacacgtgattagggattgggggaggaactgctcagttaggacccagagggaaccatggaagccccagctcagcttctcttcctcctgctactctggctccagataccaccggagaagttgtgttgacgcagtctccaggcaccctgtctttgtctccgaggggaaagcgcccaccctctcctgcgagggccaatcagtagtgttagctagttaacttagtctggtaccaacatacgacctgaccaggcctccgaggcctcctcatctacgatcgccgtaccaacgacggcccacgtcggctactcccgagtcccgtacggttacgaggtcgacggtaggttcggggtcgtacgggaacacggtaccttccgacttcctacccaacctatccgaaccgtacctaaaccgttaagtaaaccgttaggtaaacgttttacttttttacgttaactttttaattaccgttacgtaacctaacgtacgttaccgtaccggtacacgttcgtaccggtccccttacgttaccgttacccgggtttacgggggaccggtaaacggggtacccgtaaggggttcggaccgtacctaaccggtaaacggtaccgtgggtaccggtcctacggtaaccctaacgtcgttaccgttaccgttccttccgtacccgttttccccgttacccggcttaaccgg

SEQ ID NO: 165126 - DNA, 823 bp, Homo sapiens
  misc_feature: GYAE6OF02GBK6Y.33.23.C01.1.454.CMB.1.raw
tcagtacacacactcacgaccggtgctcgatttagtacacgtgattagggattgggggaggaactgctcagttaggacccagagggaaccatggaagccccagctcagcttctcttcctcctgctactctggctcccagataccacggagaagttgtgttgacgcagtctccaggcaccctgtctttgtctccgagggaagcgcccaccctctcctgcgacgggaccaacgtcaaggagttagttagcgtaagttaacttagtcgtacggtaaccaactataacgacctcgaaccgacggacctcccgaaggtcctcctctactcctacgatcgccgtaccgaacgacggggcctacgtcggaccactaccccgacgtacccgtacgggttacacgggtcggacgtagggtcgggttcggtacgggacctacggttacccttactaccgtacctaccgaacctagtaccgacgtaacctaaccgtaacgtaaccttaaggttaaacgtttacttttttacgtaactttttaacgtacttacgttaaccaaacgttacgtacccgtaaccgggtcttaacggtaccgttaccggttcccttacccgttaccggttaaccgggtttaccggggtaacccggggttaaaccgggtacgttaaaccgggggtacggtaaccggttaacccgttaaaccgggaaacccgttacgggtttacccgggacgggtaaccggttacccgtaccggtaaacccttacggttcccgtttaccgttacctttcccgttaacccgttcccccggtttaccgacccgtttaacccgg

SEQ ID NO: 165127 - DNA, 684 bp, Homo sapiens
  misc_feature: GYAE6OF02J1LF6.33.23.C01.1.454.CMB.1.raw
  modified_base (199)..(199): a, c, t, g, unknown or other
  misc_feature (199)..(199): n is a, c, g, or t
  modified_base (523)..(523): a, c, t, g, unknown or other
  misc_feature (523)..(523): n is a, c, g, or t
  modified_base (537)..(537): a, c, t, g, unknown or other
  misc_feature (537)..(537): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctccagataccacggagaagttgtgttgacgtcagtctccaggcacctgtcttgtctccgagggaangccacctctcctgcaggccaatcagagtgttacgctagttaacttagtctaggtaaccaacagttacggaccttggaacccgtaggtcccttacccgaagggccctttaccgtactaacgtttccgtaaacgaagttccggaccgttacccaaaacggtccgggacctaacgtcggctaaaccgtccccgtaagcccgttaggtttacgacggtcggtacgagggttcgggtacgtgggaacctacgggttaaccttcgaacgttcacccaaccgtctacgacgtactaacgtagtactagtatttactttctatttatacgtntacactctgacgtntagtcgtcgtactcgtcgtacgtcgggacgacggtaccgtaggtccgtaacgtccgtaacgaacgtcgtaggttaccgccttacggaacctccgttaacgttcgttaccgttcttaccgttaccgttcccttaccccgtataaccgg

SEQ ID NO: 165128 - DNA, 659 bp, Homo sapiens
  misc_feature: GYAE6OF02IUC5H.33.23.C01.1.454.CMB.1.raw
  modified_base (202)..(202): a, c, t, g, unknown or other
  misc_feature (202)..(202): n is a, c, g, or t
  modified_base (654)..(654): a, c, t, g, unknown or other
  misc_feature (654)..(654): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctccagataccacggagaagttgtgttgacgcagtctcaggcaccctgttctttgtctccgaggggaaanagccaccctctcctgcagggccaatcagagttgttagcagttaacttagtctaggaccaacatagacctagaccaggtcctccaggtcctcctacaacttctacgtatcgaccgtaccgaaacgacgggaccctacggtcggcctaacctccccgaaggcccgtagggtttcaaggtcgggctagggttcgggtaccgtaggggaactacggttaccttacaaccgttccaccgaacccgtattcgaacggtacctaaaccgttagtaacctttaggtaaagttcttttttacgtaatttttactacgtattaccgaactgtacgtcggactaggtctcgtacctctacgttaccgttcgggacggtaacggacgaggttcgagtaccagtaaccgtagtcggtaggctggacctacgtagttctcgttactccgtacgtttcccctaccgnttacg

SEQ ID NO: 165129 - DNA, 720 bp, Homo sapiens
  misc_feature: GYAE6OF02JCUXK.33.23.C01.1.454.CMB.1.raw
  modified_base (204)..(204): a, c, t, g, unknown or other
  misc_feature (204)..(204): n is a, c, g, or t
  modified_base (271)..(271): a, c, t, g, unknown or other
  misc_feature (271)..(271): n is a, c, g, or t
tcagtacacacactcacgaccggtgctcgatttagtacacgtgattagggagttgggggaggaactgctcagttaggacccagagggaaccatggaagcccagctcagcttctcttcctcctgctactctggctccagataccaccggagaagttgtgttgacgcagtctccaggcaccctgtctttgtctaccgaggggaaanacgcccgaccctctccgtgaccagggccaatcagagttcgtagcagtacttagtctacggtaccaanatacgacctagaccaggcctccgaggctccctcactctacgattcgccgtaccaacgacggcctacgtggacctactccgagcccgtaggttccgaacggtgggtaccgacgggttcggggttacgtacgggtaaccgagtccctttacgaccgttacctacccgaccgtaatcccggatacccgaaaccgttaacgtacgtttaggaaacgttttaacgtttttctaaactttttacgttaccgtagttaccgaacttagttaccgtaacggaccgtaagtccgttaccggtccccttattcccgttaacgtttcggggacgggtaaccggaacggtacgggttagacccgttagaaccgaacggttacgtacggtccggtctaaccgcgtaacctgttccgttagttacccgtattacccgttccccggttaccgacccgttaacgg

SEQ ID NO: 165130 - DNA, 855 bp, Homo sapiens
  misc_feature: GYAE6OF02G11DF.33.23.C01.1.454.CMB.1.raw
  modified_base (203)..(203): a, c, t, g, unknown or other
  misc_feature (203)..(203): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtcttgtctccgaggggaaangccaccctctcctgcagggccagtcagagtgctggcagcaacttgcctgtaccaacaaaaccgtgaccagacctccagctcctcatctatgatcgctactcccacgacggccacgtgccacgtcccacgtccgtaggttccagtcggcgtaggtcgggtccgtgggactacgtacttccgaaccttcctaccaccgtactaccgacgtaccgaccgtaccgttaacggaccgtacccgttagggtaaaccgtttcgtttttacggaaccgttttaaggtttttaaccgtttaccgtttacggtttacccgttaggtaccgttaacggtaccgggtttaaaccgacccgttaaaccggttacccggggttaaaccccctttaaaacccggttaccccgggttttaacccggggaaaccccgggtaaaaccggggttaaaaccccgtaaacccggggttaaaccgggttttaaccggggaaaaccggtttttaaaaacccgggttttaaaaaacccggggttaaccccggttttacggggttaacccgggtaacccggttttaaacccggtaaaccccgttaaccccggtttaccgttttaacccgggttttaccccggttttaaccccgttttaccccgtttaaaccccccgg

SEQ ID NO: 165131 - DNA, 680 bp, Homo sapiens
  misc_feature: GYAE6OF02G4OAE.33.23.C01.1.454.CMB.1.raw
  modified_base (204)..(204): a, c, t, g, unknown or other
  misc_feature (204)..(204): n is a, c, g, or t
  modified_base (612)..(612): a, c, t, g, unknown or other
  misc_feature (612)..(612): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtctttgtctccgaggggaaanagccaccctctcctgcagggccaatcagagtgttagctagtaacttagtctaggtaccaacatacgacctgaaccaggcctcccaggtcctccgtcactctacgatcgaccgtaccaacgacgggcccactcgggaccactaccccgacgacccgtagggttccaaggttcgggacgtaggttcgggggtactacggggaacctaacggttacctttaccgaacctttccgtaacccaaaccccgtatacccgaacgacccgtaaaaccctaagtaaacccgtttaggtaaacgtttacttttttactaaattttttaactacttagtaacctaacctattaccgacggtcacgtctcggtccttctacgttacgttccgggacggtacgggtacgtaagggtcgganccgtaacgaacgcgttaggtcgctcggactacctacgttctcttctaccgtacttcccgtccgctacg

SEQ ID NO: 165132 - DNA, 570 bp, Homo sapiens
  misc_feature: GYAE6OF02F6WU4.33.23.C01.1.454.CMB.1.raw
  modified_base (204)..(204): a, c, t, g, unknown or other
  misc_feature (204)..(204): n is a, c, g, or t
  modified_base (429)..(429): a, c, t, g, unknown or other
  misc_feature (429)..(429): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccggccaccctgtctttgtctccaggggaaagngccaccctctcctgcagggccagtcagagtgttagcgggtacctagcctaggtaccaacagagacctggccaggctcccaggctcctcttctatgatgcatccaacgagggccacgtggacatcccagcctaggttcaggtggcggtggggtctggggacagtatttcactctcaccatccagcacgtctgctaactgaagtagtttgtactaactttacttctntcaacactattaacatctaccctactactttcggaccgacgggaaccaacggtcgtaggagactcgagggacgtacgtggtacggtctagtccgaaccgtacgttcttacgttccttcctacttcccgttcccgtcctacg

SEQ ID NO: 165133 - DNA, 600 bp, Homo sapiens
  misc_feature: GYAE6OF02FQAIF.33.23.C01.1.454.CMB.1.raw
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (302)..(302): a, c, t, g, unknown or other
  misc_feature (302)..(302): n is a, c, g, or t
  modified_base (321)..(321): a, c, t, g, unknown or other
  misc_feature (321)..(321): n is a, c, g, or t
  modified_base (350)..(350): a, c, t, g, unknown or other
  misc_feature (350)..(350): n is a, c, g, or t
  modified_base (360)..(360): a, c, t, g, unknown or other
  misc_feature (360)..(360): n is a, c, g, or t
  modified_base (413)..(413): a, c, t, g, unknown or other
  misc_feature (413)..(413): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccaggcaccctgtctttgtctccagggaaanagccaccctntcctgcagggccaatcagagtgttagcagtaacttagtctggtaccaacatagacctagaccaggcctcccgaggcctcctcatctacgntgcgtccaacagggccacnggcatccccagcctacggttcagtggacnggtgggtcgngggacagacttcactctacactactcacgactaacctagtaacttgaaacttntttttactaattttacttactactacaactattaccgacggtactacgcgttccggtaccctcgttaccgtacggtttccgggacggggtacggaccgtaagggtcgaacggcttaacgaaaccgtatcggtaggcctagacccaacttacgtctacgttctaccgtattcccgtcccgtacttacg

SEQ ID NO: 165134 - DNA, 774 bp, Homo sapiens
  misc_feature: GYAE6OF02GSR0N.33.23.C01.1.454.CMB.1.raw
  modified_base (141)..(141): a, c, t, g, unknown or other
  misc_feature (141)..(141): n is a, c, g, or t
  modified_base (229)..(229): a, c, t, g, unknown or other
  misc_feature (229)..(229): n is a, c, g, or t
  modified_base (235)..(235): a, c, t, g, unknown or other
  misc_feature (235)..(235): n is a, c, g, or t
  modified_base (439)..(439): a, c, t, g, unknown or other
  misc_feature (439)..(439): n is a, c, g, or t
tcagtacacacactcacgaccggtgctcgatttagtacacgtgattagggagttgggggaggaactgctcagttaggacccagagggaaccatggaagccccagctcagcttctctcctcctgctactctggcctaccganactaccaccggagtaacgttgtcgttgaccgctagtcctccaggcctaccctgtcttgtcctccgaaggggtaaccgaccctaccctnttccgngcgtacgggacctaactcgagtacggtgttacgacgaataaccttggcgtacggtaaccaaagtggtacaacctcgaccaacgggtcctacccgtacggtacttccacgtattccaacggtacgtcgaccgttaccaaacggtcggaccctaaggtcgactacccgtaccgaaccgtcccgggtataccggaacggttccgggntaacggggttccggtaccggtacggtaaccggtaaccttaaacgttcccgtaacgtcgttaaccctaaacacgtaccgttacgaaaccttacgtaacgtaacgtagtaaccgttatttacttaacgtttaacttacgttactaaccgaattaacgtacgacgtacgtacgtacgtccgtactaccgtacttaccgttacgcgggaaacggtaccggttaagggacccgtaggttacccgaagtaaccggtacgtacggtcggtaacgtacccgtagtacccgtaagttaccgtacgttaccggttacctaccgttaccgtacccgtctaacccgg

SEQ ID NO: 165135 - DNA, 814 bp, Homo sapiens
  misc_feature: GYAE6OF02FN1PI.33.23.C01.1.454.CMB.1.raw
  modified_base (170)..(170): a, c, t, g, unknown or other
  misc_feature (170)..(170): n is a, c, g, or t
  modified_base (236)..(236): a, c, t, g, unknown or other
  misc_feature (236)..(236): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccacggagaagttgtgttgacgcagtcnccaggcacctgtctttgtctccgagggaagacgccaccctctcctgcgacgggccaatcaggtagngaagtacggacacgtttaacttacggttcgttacgggtaacccaacaagtacgaacccgtacgaaccgtaacggccctaccccgaggtcctaccgtcacgttcctaacgattcggacccgtacccggaaaccgacgggcctacggtaccggccaaccgtcccgaacgtacccgtaggttcgaaggtcggacgtaggtcggggttcgtaggggaactacggtaccttcgtaaccgttcctaccacctaagtaccgtaacgtaacctaaaaccggttaaccgtaaacgtttaacgggttaaaccgtttttaatttttttaccgtttaaacttttttaaacgtttaccgtttaacggttaacccgttaaccttacggttaacccgtaccgaccgttaaccggtctttccgggttaccctttccgttaacccgtttacccggtttacggggtaccgggtaacgggtaccgttacggtacggaaccgtacgtaaccgtaacgtcgtacggtacggacgttaccgaccgttaaccgtgttccgttaacgttccctttaacgtccttacccgtacccgttacccg

SEQ ID NO: 165136 - DNA, 853 bp, Homo sapiens
  misc_feature: GYAE6OF02GUBVN.33.23.C01.1.454.CMB.1.raw
  modified_base (322)..(322): a, c, t, g, unknown or other
  misc_feature (322)..(322): n is a, c, g, or t
tcagtacacacactcacgaccggtgctcgatttagtacacgtgattagggattggggggaggaactgctcagttaggacccagagggaaccatggaagccccagctcagcttctcttcctcctgctactctggctcccagataccaccggagaagttgtgttgacgcagtctccagcccacccttgtctttcgtcctccgagggtacaaagacgacccctaaccctcctacatcgaccgacgggccaggtccaggtagtcgtagaccgagacctaacttacttacgccgtacggtaccagaccagaccacctcggcacgccncccgacggtccttccacacgtccgtagtcggtctaccacgtaccccgaccgacggtcccgagtccggacctaccgtacccaggtaccgttaacgggtacgtagggtcggacgtcgggttagggtccggtagggaccgtaactaccgtttcgtacgtttaccctccgtaacctacgccgtaacgtacgtacggtaccggtacggaccggtaccgttaaggtacgtttacggttaacgtacggttaacgtttacggttaaaccttaccggtttaagggttacccgtaaagggttacccgtttaaacggggtttaacccgtttaacgtttacccggttaacccggttttaccccggtaaacccggggtttaaccccgggtttacccgggtaaaacccgggggtaacccggggtaaaaccggttaacggggttaaaaccgaaaaccgggtttaccggtaaaaccgggttaacggtacccggttaccggaccggtttacccggacccttaaccggttaccgtttaccgttaaccgg

SEQ ID NO: 165137 - DNA, 736 bp, Homo sapiens
  misc_feature: GYAE6OF02GAKNY.33.23.C01.1.454.CMB.1.raw
  modified_base (205)..(205): a, c, t, g, unknown or other
  misc_feature (205)..(205): n is a, c, g, or t
  modified_base (313)..(313): a, c, t, g, unknown or other
  misc_feature (313)..(313): n is a, c, g, or t
  modified_base (322)..(322): a, c, t, g, unknown or other
  misc_feature (322)..(322): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagagttgtgttgacgcagtctccaggcaccctgttctttgccgtccagggggaaanacgcccaccctctcctgcacgggccaatcgagtagtgttagcagttaacgttgtcgtaggtaaccaacgatacggtactcggacctaggcctacccgaggcctccctnactctacgntcgccgtaccaacgcgggccagtggcacctccaaggccgtaggttcgacggtgcgaggttcgggcgtacgggactagtaccttcacttcctacaccagtaccacgtaacctaaccgtaagtaaccttaggtaaattttaccgttttactttacttttaacttacgttaccttacaaacttaccggttaacacggttactacgtcccgttcggtacccttccttaccggttaccggtttacgggaaccgggggttaacggtaccggttaacggggaacgtaaccggttacgttaaaacccgggtaaccgtacgggttcggttacgggtacccggttacgaacccgtaccggttacggttaccgtttacggttaccctttaccgtcccttttacccggtaccccgttagttacccg

SEQ ID NO: 165138 - DNA, 567 bp, Homo sapiens
  misc_feature: GYAE6OF02GPCFU.33.23.C01.1.454.CMB.1.raw
  modified_base (203)..(203): a, c, t, g, unknown or other
  misc_feature (203)..(203): n is a, c, g, or t
  modified_base (213)..(213): a, c, t, g, unknown or other
  misc_feature (213)..(213): n is a, c, g, or t
  modified_base (349)..(349): a, c, t, g, unknown or other
  misc_feature (349)..(349): n is a, c, g, or t
tcagtacacacactcacgaccggtgctcgatttagtacacgtgattagggattgggggaggaactgctcagttaggacccagagggaacccatggaagccccagctcagcttctcttcctcctgctactctggctcccagataccaccggagaagttgtgttgacgcagtctccaggcaccctgtctttgtctccaggggaanagccaccctntcctgcagggccaagtcagagtgttagcagttactgtctggtaccaacatagacctgaccaggctccagctcctcatctatcgatcgcatccacgagggaccactggcatcccagcctaggttccaggtcggacgnggtcgggtctaggggactagacttcactccgtacacgactcgacgtcacgcgtacgacgtcctagaagtacgtttgacgttagttactttactgttacgtcacgtgcgttaacgctaacgtcggacctaacctcgttcggaccgacggacacgactaggagtaacgtaaacgtactcggtcgtacgtagaccgactacgtccgtcgttcttcctaccg

SEQ ID NO: 165139 - DNA, 800 bp, Homo sapiens
  misc_feature: GYAE6OF02IZBZ2.33.23.C01.1.454.CMB.1.raw
  modified_base (205)..(205): a, c, t, g, unknown or other
  misc_feature (205)..(205): n is a, c, g, or t
  modified_base (300)..(300): a, c, t, g, unknown or other
  misc_feature (300)..(300): n is a, c, g, or t
  modified_base (761)..(761): a, c, t, g, unknown or other
  misc_feature (761)..(761): n is a, c, g, or t
  modified_base (778)..(778): a, c, t, g, unknown or other
  misc_feature (778)..(778): n is a, c, g, or t
  modified_base (795)..(795): a, c, t, g, unknown or other
  misc_feature (795)..(795): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagtaagttgtgttgacgcagtctccaggcaccctgtctttgtctcgaggggtaaancgcccaccctctcctgcgagggccaatcgagagtgttagctagtacttgtctcggtaaccactatacgcctgaccaggcctcccgaggccttccncgtactccgtacgagttcgccggtaaccaacggacggggaccctacggtcggaccctaaccgttaccccgaaccggtcccgttaagggttccgaacgggtttcggacgttacggggttcggggttacgtacggggacctaacgggttaccctttaccgaccgtttacctaacccgacctaacgttacccgaacgtaaacccttaaaacccgttaacggtttaaaccggtttaacggtaaacggttttaacctttttttaaccgtttaagttttttaaccttaccggttaaccggttacctaaacgtttaaccgtaccgtaacccggtacgtaaccggttccgtcccgggttacccttaccgttaccgttaacccggtttcgggaccggtaacgggtaaccggtacgggtaccgtcggtaacccgtaacgtaacgtaccggtgtacggctcgacctaccgtnttcgtacttcggttacnccgttacccgttcccgntaccg

SEQ ID NO: 165140 - DNA, 820 bp, Homo sapiens
  misc_feature: GYAE6OF02IE4HP.33.23.C01.1.454.CMB.1.raw
  modified_base (203)..(203): a, c, t, g, unknown or other
  misc_feature (203)..(203): n is a, c, g, or t
  modified_base (245)..(245): a, c, t, g, unknown or other
  misc_feature (245)..(245): n is a, c, g, or t
  modified_base (339)..(339): a, c, t, g, unknown or other
  misc_feature (339)..(339): n is a, c, g, or t
tcagtacacacactcacgaccggtgctcgatttagtacacgtgattagggattgggggaggaactgctcagttaggacccagagggaacatggaagcccccagctcagcttctcttcctcctgctactctggctcccagataccaccggagaagttgtgttgacgcagtctccaggccaccctgtctttgctccgagggaagngcccaccctctcctgacagggacctaatcgagtagtgttagntacgtaacgttgtctaggtaaccaaatataacgacctaggaaccgaggtcccctcccgaacggccttccctaccgtacttacccgtaaccggtntccggtacccgttaacccgaaacggtaccggggaccctaacggttccgggaccttaaccgtacccccgaccggtacccgttaacgggttaccgaacgggttcggccggtaacggggttcgggggttacgtacgggggtaaccgaacggttacccgtttacgaacccgttaccctacctaaccggtacctaccgaacctaacccgtaaaccgtaacgttaacgtttaacggtaaacgttttactttttaacgtttagttttttaaactacgttactaacctaacgtaccttacgaccggtacgacgttccgtccgtaccgttcgttaccgttaccggttccgggaccggggtaacggtaccgggtaacgtacggtacgacgtaaccgaacgtacgttcgggtaccgcggtaccgtaccgaccgttactttaccgtacgtttccgttaaccgtaccctttaccggttaccccctagttaccgg

SEQ ID NO: 165141 - DNA, 705 bp, Homo sapiens
  misc_feature: GYAE6OF02GKML8.33.23.C01.1.454.CMB.1.raw
  modified_base (187)..(187): a, c, t, g, unknown or other
  misc_feature (187)..(187): n is a, c, g, or t
  modified_base (200)..(200): a, c, t, g, unknown or other
  misc_feature (200)..(200): n is a, c, g, or t
  modified_base (265)..(265): a, c, t, g, unknown or other
  misc_feature (265)..(265): n is a, c, g, or t
  modified_base (393)..(393): a, c, t, g, unknown or other
  misc_feature (393)..(393): n is a, c, g, or t
  modified_base (401)..(401): a, c, t, g, unknown or other
  misc_feature (401)..(401): n is a, c, g, or t
  modified_base (447)..(447): a, c, t, g, unknown or other
  misc_feature (447)..(447): n is a, c, g, or t
  modified_base (649)..(649): a, c, t, g, unknown or other
  misc_feature (649)..(649): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggcctccgagatacccaccggagaagttgtgttgacgcagtctcagcacctgtcttnctacgagggaacngcctacctctcgtgcagggcctaatcagtagttgttagctaagtaacttgtcgtacgtaaccaanagttacgacgtacgaacgacggcctaccgacggtcctcccgtacaacgttaccgtaacggacttcgacccgtaacgtaaccgacgggtaccctagcggtacacctacccgtagccgttacggttacgngttccggngtacgtcgggtcgtacgggactagtacgttcaactctaccaacgtnacgataaccgtaacgtagtaaccgtaagtaacttttactttttacgtaacttttaacgtacgtaacgtactaactacggtaaccacggtacgtaacgtctacggttcctacgtaacccgttacgggtttccggaaggtaacgaaccggtaaggttcgaacggtaaccttaacggaaccggtataccggtacgtacgtaaccnccttacgtaacgttcgttaccgtcttacccgtacccgtcgacccggttattacggg

SEQ ID NO: 165142 - DNA, 729 bp, Homo sapiens
  misc_feature: GYAE6OF02FL17L.33.23.C01.1.454.CMB.1.raw
  modified_base (174)..(174): a, c, t, g, unknown or other
  misc_feature (174)..(174): n is a, c, g, or t
  modified_base (203)..(203): a, c, t, g, unknown or other
  misc_feature (203)..(203): n is a, c, g, or t
  modified_base (243)..(243): a, c, t, g, unknown or other
  misc_feature (243)..(243): n is a, c, g, or t
  modified_base (318)..(318): a, c, t, g, unknown or other
  misc_feature (318)..(318): n is a, c, g, or t
  modified_base (356)..(356): a, c, t, g, unknown or other
  misc_feature (356)..(356): n is a, c, g, or t
tcagtacacacactcacgaccggtgctcgatttagtacacgtgattagggattgggggaggaactgctcagttaggacccagagggaaccatggaagccccagctcagcttctcttcctcctgctactctggctcccagataccaccggagaagttgtgttgacgcagtctccnggccacctgttctttgctccgaggggaanacgccacctctcctgacgacggccaagtcagagttgttanacgtaagttaacttagtcgtacggtaccaacgatacgacctacgaaccaggcctccgacgcctctcagttcacgntcgactaccgaacgcgggcctagcggtcacgtacccgngtaccgtaggttcacggtggacgtcggtcggttacgtacgggaccacggtaccttacgtacctccgtacaacctgtaaccgacgtaaccaacgttaagtaaccgtagttaagttactttttaccgttatttttaaccggtcttaacgtacctaaactacgttaccggaaaccggttcttaaacggccgtttaccgacccggttttacctacggtaccggggttttaccggaacgggtaaccgggtaaccggttaggggtaaccgtacgtaccgtaaaccgtaaacgggccgtttagtccgggtaccgtacgtacccgtacgttacgtaccggtttcttaccggttactacccggtttcccgtacccgtatacg

SEQ ID NO: 165143 - DNA, 711 bp, Homo sapiens
  misc_feature: GYAE6OF02HARMS.33.23.C01.1.454.CMB.1.raw
  modified_base (210)..(210): a, c, t, g, unknown or other
  misc_feature (210)..(210): n is a, c, g, or t
  modified_base (431)..(431): a, c, t, g, unknown or other
  misc_feature (431)..(431): n is a, c, g, or t
tcagtacacacactcacgaccggtgctcgatttagtacacgtgattagggagttgggggaggaactgctcagttaggacccagagggaaccatggaagcccagctcagcttctcttcctcctgctactctcggctcccagactacctaccggagaagttggtgttcgacgtcagtctccgagtccaccctgttctttgtctcgagggaancgcctacctctcgtgcgacggcaatacgagtacgtgtaacgctaacgttaacgttgtacgttcggtaaccaatacgttaacgacccgtagaaccgtcgtacctccgagtcctccgtactacgtactacgacgtcgtaccgtaccgaacggtacgggtccacggtcgtacaccgtcccagcccgtagtcgacggtcggtcgtaggttcgggcgtaggtaccncggtaccgttcacgtcctaccgaacttcgtacaaccgtactaaaccgtagttaacttaggtaacgtttacttttacttaaacgtttcttaacgtacgttaacctaaacttacgtaaccggcgtacctacggttacgtccgttaccttactccgttaacggttccgggacggtaaccgtaggtaacggtcgaaccgtcgtaaaccgaaccgggttctggtacggtcaccgttacctcgtaccttgtaccttcgttcgttcccgtaccgttccgtacgtacg

SEQ ID NO: 165144 - DNA, 820 bp, Homo sapiens
  misc_feature: GYAE6OF02GHFDS.33.23.C01.1.454.CMB.1.raw
  modified_base (200)..(200): a, c, t, g, unknown or other
  misc_feature (200)..(200): n is a, c, g, or t
  modified_base (208)..(208): a, c, t, g, unknown or other
  misc_feature (208)..(208): n is a, c, g, or t
tcagtacacacactcacgaccggtgctcgatttagtacacgtgattagggattggggaggaactgctcagttaggacccagaggaaccatggaagccccagcctcagcttctcttccgcctcgctactctggctcccagataccaccggagaagttgtgttgacgtcagtctccaggcacctgtctttgctccagggaangccacctntctgcagggccagtcagagtcgttagcgggtacctagacctggtaccaacgtagtaagacccttaggtaccaagggtcctacccgtaaggtcctacctaccgttactaacgttcggtaacttcgacaactttcccgaaacgacggggccctaaacggttcgggacctaacttccccgaagtcccgttaaagggttccgtagttacgggccggggtttcggaccgttaggggggaacctaacgggttacttttaccggaacgttcccgtaccgtaacccgtaagtttaccccgaagtcccgttaacgacccgttagtacgaccctaggaaacgtcgtttttaacggctaacgtttaacgtttaccgtagtttaccgaacggtaccttaacgggtaccgttacgacggttaaaccgttacggttacgttacggtaaccggttccggtaacccggtaaagggggtaaccccgtaaaggggttaccggttaaaagttacccggaaaacggttaaccggttaacggtacgggttaaccggacggtaccgtaacccgtagttaccgttacgttaccgttaccttaaccggtcccttttacccccgggcccgttaaccg

SEQ ID NO: 165145 - DNA, 849 bp, Homo sapiens
  misc_feature: GYAE6OF01D09HV.29.76.G10.1.454.CMB.1.raw
tcagatagagtactcacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgagggaagcgcccaccctctccgtggccacgggccagtcagtagttggttaacgcaggtacgtacttacggcccgttagggtacccaaggtaccgtaaacggaaaacccgttcgggacccgtacgggacccttccccggaaggtcccttccctactacttccgttagtgtacgttacggacctacgtacccgaacggtaaccgggccctaacgtggtaaccttaccgtccccgtaacggacccgttacgggttaccgtagggttacgggccggtaagggtttcggggttacgtacggggtaacgtaacgggttaccgttcccgtaaaccttccgttacccaaccgttagacccgaggtaccggaaccgtcccctaggtaccgtacgttacggttacgttaaggtttacttttaacggtaacttttaacgtttttacttaaccggttgtaacgtacgtaaacggttaattaacttaagggttaacccgtccggttaccccttttaacccggtacgttttacccgggtttaccggggaaccggtaaccggggtaaccgtaacgggttcggtaaacggtaacggttaaaccctaaaccggggtaaaaccgtttaccgggttacgggttaccgaccgggttaccctaaccccggtacgttaacccgg

SEQ ID NO: 165146 - DNA, 899 bp, Homo sapiens
  misc_feature: GYAE6OF01ELV9I.29.76.G10.1.454.CMB.1.raw
  modified_base (198)..(198): a, c, t, g, unknown or other
  misc_feature (198)..(198): n is a, c, g, or t
tcagatagagtactcacgaccggtgctcgatttagtcactcatacaggggaggaactgctcagttaggacccagacggaaccatggaagcccccagcgcagcttctcttcctcctgcctactctggctcccagataccactgggagaagtagtgatgacgcagtctccagcccacctgtctgtgtctacgaggggaancgccaccctctccgtgcgacggccagtcaggtacgttgtacgcaggcctacgttacgccgttacggaccaggacaacgtaacccgtcggacccgacggtcccgtacccgacggtccctacctaccgtattacgttacgttgtacgtcgacccgtaactacccgaaccgggaccggtaaccctacgttaccgtaactaccccgtacccgtaccggtacccgtttaacggtttaccgaggggtttacgggaccgttagggggtcgggttaccgggtaggggaacccgttaaagggtttacccgtttaccggtaccctttacccggtaacccaccgttaacgtacccgtaacgggaccgtacccggttcctacggtacgttacggttacggttaaggtttaacgttttcgtttaacgtttaaaccgttttaagtttccttttaccgtaggttaccgtaacggttaactttaaacggttaaaacccttacgggtttaccgttttaccccggtaacccgttttaacccggtttaccccggtttaaccgggttttacccggggaaccggttaaaccccgggggtaacctaacggggttaccggttaaaggaacccggttaaaccgggttaaaccccgtaaaccggttaaccgggttacggttaccggtaacccgttacccgggtaacccgtttacccggttaaccgg

SEQ ID NO: 165147 - DNA, 516 bp, Homo sapiens
  misc_feature: GYAE6OF01CHPQY.44.73.G07.1.454.CMB.1.raw
  modified_base (323)..(323): a, c, t, g, unknown or other
  misc_feature (323)..(323): n is a, c, g, or t
tcagacagtatatacacgaccggtgctcgatttagctctacgctcaggggggaactgctcagttaggacccagagggaaccatggaagccccagctcagcttctcttcctcctgctactctggctcccagattccaccggcgaaattgtgttgacacaatctccagccaccctgtctttgtctccgggggaacagccaccctctcttgcagggccggccagactgttgacgacgacttagcctggtaccaacagaagcctggccaggctcccagactcctcatctatgatacttctagtagggcctctggcatcccagcccgnttcagtggcaggtgggtctggggacagacttcactctcaccatccaccagccctagacgcctagaagtattttgctagtttattactgtctacacgtaagagtgcctcatatcacttcgcctggaccaagtgatatacaacgactgtcgctgccacctatctgtcttcacttccttcccgctactcctgtaac

SEQ ID NO: 165148 - DNA, 524 bp, Homo sapiens
  misc_feature: GYAE6OF01DSK8P.44.73.G07.1.454.CMB.1.raw
  modified_base (378)..(378): a, c, t, g, unknown or other
  misc_feature (378)..(378): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacagtctccaggcaccctgtctttgtctccaggggagagagccaccctctcctgtagggccagtcggagtgttgctaagtacctagcctggtaccaacagaaacctggccaggctcccaggctcctcatctatgatgcatccaacagggtcactggcacccagacaggttcagtggcagtggtctgggacagacttcactctcaccgtcagcaatgtaacngcctgagtatttgctagtttattactgtcagcagtcgttcctccacggccgctcgtaccgtttcgggcgggggtaccgtaagggtggagagtcgagacgacgtgtggcgtgcaccactctgtcttctacttccttcccgcctatcg

SEQ ID NO: 165149 - DNA, 499 bp, Homo sapiens
  misc_feature: GYAE6OF01DN9LD.44.73.G07.1.454.CMB.1.raw
tcagacagtatatacacgaccggtgctcgatttagctctacgctcagggggatcaggactcctcagttcaccttctcacaatgaggctccctgctcagctcctggggctgctaatgctctgggtctcagggtccagtggagatattataatgactcagtctcccctctccctggccgtcacccctggagagccggcctccatctcctgtaggtctagtgagagtcttggaggtcagaacatctatgtggactggtacttgcagaagaccgggcagtctccacaactcctgatctatttgggttccactcgggcctccggggtctctgacaggttcagtgccagtgcatcacacacagatttcacactgcacatcagcagagtggaggctgacgatggttggggtcttattactgcatccaagttctacaaacccgttcaccttcgggacaagggacacgacttgagtattaagcgaaactgaggtctagcaccatctcg

SEQ ID NO: 165150 - DNA, 288 bp, Homo sapiens
  misc_feature: GYAE6OF01CEK05.44.73.G07.1.454.CMB.1.raw
  modified_base (284)..(288): a, c, t, g, unknown or other
  misc_feature (284)..(288): n is a, c, g, or t
tcagacagtatatacacgaccggtgctcgatttagctctacgctcaggggtcccggatcggttctctggctccaagtctggcaacacggcctccctgaccgtctctgggctccaggctgacgatgaggctgattattactgcagctccgatggaggcacctatgatttgcttttcggcggagggaccagactgaccgtcctaggtcagcccaaggctgccccctggtcactctcgttcccacctcctctatatactgtctgagcgggctggcaaggcgcatagnnnnn

SEQ ID NO: 165151 - DNA, 506 bp, Homo sapiens
  misc_feature: GYAE6OF01BCFSD.44.73.G07.1.454.CMB.1.raw
  modified_base (500)..(500): a, c, t, g, unknown or other
  misc_feature (500)..(500): n is a, c, g, or t
tcagacagtatatacacgaccggtgctcgatttagctctacgctcagggggatcaggactcctcagttcaccttctcacaatgaggctccctgctcagctcctggggctgctaatgctctgggtctcagggtccagtggagatattataatgactcagtctcccctctccctggccgtcacccctggagagccggcctccatctcctgtaggtctagtgagagtcttggaggtcagaacatctatgtggactggtacttgcagaagaccgggcagtctccacaactcctgatctatttgggttccactcgggcctccggggtctctgacaggttcagtgccagtgcatcacacacagatttcacactgcacatcagcagagtggaggctgacgagtggttgggtctattactgcatccaagttcctaactaaccccgttcacccgttcgggacgaacgggacaccgacttggagtattaagcgaactggcgctgcacctntcttcg

SEQ ID NO: 165152 - DNA, 529 bp, Homo sapiens
  misc_feature: GYAE6OF01CX87A.44.73.G07.1.454.CMB.1.raw
  modified_base (410)..(410): a, c, t, g, unknown or other
  misc_feature (410)..(410): n is a, c, g, or t
tcagacagtatatacacgaccggtgctcgatttagctctacgctcagggggatcaggactcctcagttcaccttctcacaatgaggctccctgctcagctcctggggctgctaatgctctgggtctcagggtccagtggagatattataatgactcagtctcccctctccctggccgtcacccctggagagccggcctccatctcctgtaggtctagtgagagtcttggaggtcagaacatctatgtggactggtacttgcagaagaccgggcagtctccacaactcctgatctatttgggttccactcgggcctccggggtctctgacaggttcagtgccagtgcatcacacacagatttcacactgcacatcagcagagtggaggctgacgagtgtgggtctattacngctataccaagttacctaacctaaaccccgttctaacccgttcgggacgaacgggaccacggtacttaggagtaattaacggcgtaaacgtggtacggtctacggacacctagtcttcg

SEQ ID NO: 165153 - DNA, 634 bp, Homo sapiens
  misc_feature: GYAE6OF01CP6PD.44.73.G07.1.454.CMB.1.raw
  modified_base (280)..(280): a, c, t, g, unknown or other
  misc_feature (280)..(280): n is a, c, g, or t
tcagacagtatatacacgaccggtgctcgatttagctctacgctcagggggatcaggactcctcagttcaccttctcacaatgaggctccctgctcagctcctggggctgctaatgctctgggtctcagggtccagtggagatattataatgactcagtcctcccctctccctggccgtccaccccgtggagacgccggcctccatctcctgtaggtctagtgagagtcgttgggaggtcagaacatctatgtggactggtacttgcagaacgaccgggnacgtctcacaactcctgacttcttagtttcgggttaccacgtccgggtccgttccggggtctcgtgaccgtggttcagtcgccagtcgactactcacacacagtactttcacactgaccactactcgagtacgaggtacggtgggaacggcgtaggaacgtaggttgggtttcggggtacttagtttacgtcgactacttacccgttaacgtttaccctaaacccgttaaacccccgtttctacccggttacgggaaccgtaaacgggacctaacgtacgttagaacggtaagttaaacggccgttaaacgtgggttacgtaccgttacggaccctaaccgtgttccgttacgg

SEQ ID NO: 165154 - DNA, 510 bp, Homo sapiens
  misc_feature: GYAE6OF01EIN8B.44.73.G07.1.454.CMB.1.raw
  modified_base (323)..(323): a, c, t, g, unknown or other
  misc_feature (323)..(323): n is a, c, g, or t
tcagacagtatatacacgaccggtgctcgatttagctctacgctcagggggaactgctcagttaggacccagagggaaccatggaagccccagctcagcttctcttcctcctgctactctggctcccagattccaccggcgaaattgtgttgacacaatctccagccaccctgtctttgtctccgggggaacgagccaccctctcttgcagggccggccagactgttgacgacgacttagcctggtaccaacagaagcctggccaggctcccagactcctcatctatgatacttctagtagggcctctggcatcccagcccgnttcagtggcagtgggtctgggacagacttcactctcaccatcaccagcctaagagcctgaagattttgctagtttattactgtctacaccgtaagagtgcctcaatattcactttcgcctggaccaagtgatatacaacgactgtgctgacacatctgtcttcactccttacccgccactctgtaac

SEQ ID NO: 165155 - DNA, 510 bp, Homo sapiens
  misc_feature: GYAE6OF01CQJR5.44.73.G07.1.454.CMB.1.raw
  modified_base (274)..(274): a, c, t, g, unknown or other
  misc_feature (274)..(274): n is a, c, g, or t
  modified_base (504)..(504): a, c, t, g, unknown or other
  misc_feature (504)..(504): n is a, c, g, or t
tcagacagtatatacacgaccggtgctcgatttagctctacgctcagggggatcaggactcctcagttcaccttctcacaatgaggctccctgctcagctcctggggctgctaatgctctgggtctcagggtccagtggagatattataatgactcagtctcccctctccctggccgtcacccctggagagccggcctccatctcctgtaggtctagtgagagtcttggaggtcagaacatctatgtggactggtacttgcagaagaccggggnagtctccacaactcctgatctatttgggttccactcgggcctccggggtctctgacaggttcagtgccagtgcatcacacacagatttcacactgcacatcagcagagtggaggctgacgagtggttggggtctattactgcatcctaagttcctaacctaaccccgttcacccgttcgggacgaacgggacacgtacttgagtattaagcgaactggtcggctgcaccntcgtcg

SEQ ID NO: 165156 - DNA, 544 bp, Homo sapiens
  misc_feature: GYAE6OF01BR03G.44.73.G07.1.454.CMB.1.raw
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagaagcctgggtcctcggtgaaggtctcctgcacggcttctggaggcatcttcagaaactatcttatcacctgggtgcgacaggcccctggacaagggcttgagtggatgggtgggctcgtccccaattttggacaagcaaactacgacacagaaattccagggcagactcacgattaccgcggacgaatccacgagtgcacgcctatatggagctgcgcaacctgagatctgacggacacggccctatacttctgcgcgaagtaactaaaattcctacctacgttttgggcgtagtgagtgacttagtgtattagttggggtacaagggtacaacgttcggtacaccgttctccgtacgcgtccgttccctaaacccgg

SEQ ID NO: 165157 - DNA, 519 bp, Homo sapiens
  misc_feature: GYAE6OF01APFUT.44.73.G07.1.454.CMB.1.raw
  modified_base (514)..(514): a, c, t, g, unknown or other
  misc_feature (514)..(514): n is a, c, g, or t
tcagacagtatatacacgaccggtgctcgatttagctctacgctcaggggggaactgctcagttaggacccagagggaaccatggaagccccagctcagcttctcttcctcctgctactctggctcccagattccaccggcgaaattgtgttgacacaatctccagccaccctgtctttgtctccaggggagagagccaccctctcctgtagggccagtcggagtgttgctaagtacctagcctggtaccaacagaaacctggccaggctcccaggctcctcatctatgatgcatccaacagggtcactggcaccccagacaggttcagtggcagtgggtctgggacagacttcactctcaccgtcagcaatgtacagcctgaagtatttgctagtttattactgtcagcagtcgttcctccgacggccgctctacgtttcgggccgggggtaccgaagggtggagatcgagacgaacgtgtggctgcacatctgtcttctactcttcccgctntctag

SEQ ID NO: 165158 - DNA, 588 bp, Homo sapiens
  misc_feature: GYAE6OF01DM4O0.44.73.G07.1.454.CMB.1.raw
tcagacagtatatacacgaccggtgctcgatttagctctacgctcagggggatcaggactcctcagttcaccttctcacaatgaggctccctgctcagctcctggggctgctaatgctctgggtctcagggtccagtggagatattataatgactcagtctcccctctccctggccgtcacccctggagacgccggcctccatctcctgtaggtctagtgagagtcttggaggtcagaacatctatgtggactggtacttgcagaagaccggcagtctccacaactcctgatctagtttcgggtccacgtccgggcctccggggtctcgtgactaggttcagtcgccagtgcatcacacacagtactttcacactgacacatcagcagagtggaggctgacgtagtggttgggtcttagttactcgctaactaccgtaacgtttacctaacccgtaaaccccgtttccgtaaccggtttccgggacgtaaacgggtacgtaccggtacgttaggtaaacggtaacgtttaaacggaccgtaaacgttggttacggtaccgttacgacctaaccgtagttccgttacgg

SEQ ID NO: 165159 - DNA, 515 bp, Homo sapiens
  misc_feature: GYAE6OF01CTMCE.44.73.G07.1.454.CMB.1.raw
  modified_base (510)..(510): a, c, t, g, unknown or other
  misc_feature (510)..(510): n is a, c, g, or t
tcagacagtatatacacgaccggtgctcgatttagctctacgctcagggggatcaggactcctcagttcaccttctcacaatgaggctccctgctcagctcctggggctgctaatgctctgggtctcagggtccagtggagatattataatgactcagtctcccctctccctggccgtcacccctggagagccggcctccatctcctgtaggtctagtgagagtcttgggaggtcagaacatctatgtggactggtacttgcagaagaccgggcagtctccacaactcctgatctatttgggttccactcgggcctccggggtctctgacaggttcagtgccagtgcatcacacacagatttcacactgacacatcagcagagtggagctgacgagtggttggggtcttagttactgctatacctaagtttacctaccgaaaccccgtttcaccgttcgggacgaaagggaccacgacttagagaattaaggcgaactgtgctagccacntctcg

SEQ ID NO: 165160 - DNA, 769 bp, Homo sapiens
  misc_feature: GYAE6OF01CC0ZD.44.73.G07.1.454.CMB.1.raw
tcagacagtatatacacgaccggtgctcgatttagctctacgctcagggggaggaactgctcagttaggacccagagggaaccatggaagccccagctcagcttctcttcctcctgctactctggctcccagattccaccggcgaaatttgtgtttacgacaactaactcctaccgacgaccctaccgttgtttcgtttcgtccgggtaccgggggaacgaccgacccctacccttcttcgttcgacggaccggggcccgacgaacgtacgttggtacgaaccggacgttacgttaccgccgttacggtaaccaacgaagacgtccgtcggaccgacggtccctaccgacgtaccctcctactacttactagtggtcactactacccgacggacggcctacggttacgtaccctccgacgtaccgtacgttacgaggtcggacgtagggtcggtacggtacggaacgtacggttacgtacctactttccaaccaacgtacgtacgacgacgaccgtccgtacgacgtacgttcgtaaggtaacgttttagtttcgtacttttaagttttaactacgttcgtacacgtataacgttaattaacgtcgtacggttacccgttcccttacccggttaccggaaaccgggtaacggtaccgaaaccgttacggaggtaacgttaaaaccgtaaacgtacgttggtacgtcgtacggacctaacgttcgttcgttaacgttccttaacttccttacccgtcccgattcgttacg

SEQ ID NO: 165161 - DNA, 524 bp, Homo sapiens
  misc_feature: GYAE6OF01DJH2A.44.73.G07.1.454.CMB.1.raw
  modified_base (328)..(328): a, c, t, g, unknown or other
  misc_feature (328)..(328): n is a, c, g, or t
  modified_base (490)..(490): a, c, t, g, unknown or other
  misc_feature (490)..(490): n is a, c, g, or t
  modified_base (498)..(498): a, c, t, g, unknown or other
  misc_feature (498)..(498): n is a, c, g, or t
  modified_base (517)..(517): a, c, t, g, unknown or other
  misc_feature (517)..(517): n is a, c, g, or t
  modified_base (520)..(520): a, c, t, g, unknown or other
  misc_feature (520)..(520): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccgggggaacagccaccctctctgcagggccggcagactgttgacgacgacttagcctggtaccaacagaagcctggccaggcctcccagacctcctcatctatgatacttctaggtggcctcgtggcactcccagccccgtnttcaggtcggcaggtgggtctgggacagacttcactctcacatccaccagccctagacgtcctagaagtatttgctagtttattactgtactacacgtaagtagtcgtcctactaatattctacgtttcggcctggaacctaagtgtatatacaacgtatgngctgcacntctgtcttctactcctccnctntcta

SEQ ID NO: 165162 - DNA, 546 bp, Homo sapiens
  misc_feature: GYAE6OF01C4PJI.44.73.G07.1.454.CMB.1.raw
  modified_base (416)..(416): a, c, t, g, unknown or other
  misc_feature (416)..(416): n is a, c, g, or t
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagaagcctgggtcctcggtgaaggtctcctgcacggcttctggaggcatcttcagaaactatctatcacctgggtgcgacaggcccctggacaagggcttgagtggatgggtgggctcgtccccaattttggacaagcaaactacgacacagaaattccagggcagactcacgattaccgcggacgaatccacgagtgcagcctatatgagctgcgacacctgagatctgaggacacggccctatactttcncgcgcgagactaaaatttactacctacgttttgggacggagttgatgctttatgtagttagtttcggggcctaaaggggtacaagttcgggtacaccgttccttactttccacgccctccgtaaacccgg

SEQ ID NO: 165163 - DNA, 669 bp, Homo sapiens
  misc_feature: GYAE6OF01CQCAD.44.73.G07.1.454.CMB.1.raw
  modified_base (364)..(364): a, c, t, g, unknown or other
  misc_feature (364)..(364): n is a, c, g, or t
tcagacagtatatacacgaccggtgctcgatttagctctacgctcaggggccctgggagcacagctcatcaccatggactggacctggaggttcctctttgtggtggcagcaactacaggtgtcccagtcccaggtgcgtctggtgcaatcgtggggctagaaatgaaagaagccctggggtcctcggtgaaggtctccgtagcacggcttctggagcagtctcagaaactatctatcaccgtgggtgcgacaggcccctggacaagggcttgagtggatgggtggctcgtccccaattttggaacaagcaaactacgacaacagaaattccagggcagactcacgacttaccgcggaacgaanccacgaggtgacacgcctaatagtggagctcgacgccaaaccttggagactcgtcgaaggacacgggaccccttaagttatttacctagtaccgtacgaagtaaacctaaaaaattttaccgtaacccgtttaacgttttttacggggacccgggttaaggtacgtaacgtacggtacttttaacgtacggtaagttaacggtttacgggggtacccgtaaaaggggtactaaacgtacgggttaaccaacccgggtttaccttacgtttaccgaacggtccccgtaacccgtaaaacccccggg

SEQ ID NO: 165164 - DNA, 516 bp, Homo sapiens
  misc_feature: GYAE6OF01ETJTP.44.73.G07.1.454.CMB.1.raw
  modified_base (241)..(241): a, c, t, g, unknown or other
  misc_feature (241)..(241): n is a, c, g, or t
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagaagcctgggtcctcggtgaaggtctcctgcacggcttctggaggcatcttcagaaactatcttatcacctgggtncgacaggcccctggacaagggcttgagtggatgggtgggctcgtccccaattttggacaagcaaactacgcacagaaattccagggcagactcacgattaccgcggacgaatccacgagtgcagcctatatggagctgcgcaactgagatctgaggacacggccctatatttctgcgcgagacaaaatttactacctacgttttgggacgtagtgatgcttatgatatttggggcctaagggacaagtggtcaccgtctcttcagcctccaaccg

SEQ ID NO: 165165 - DNA, 496 bp, Homo sapiens
  misc_feature: GYAE6OF01EIHCD.44.73.G07.1.454.CMB.1.raw
  modified_base (482)..(482): a, c, t, g, unknown or other
  misc_feature (482)..(482): n is a, c, g, or t
  modified_base (491)..(491): a, c, t, g, unknown or other
  misc_feature (491)..(491): n is a, c, g, or t
tcagacagtatatacacgaccggtgctcgatttagctctacgctcagggggatcaggactcctcagttcaccttctcacaatgaggctccctgctcagctcctggggctgctaatgctctgggtctcagggtccagtggagatattataatgactcagtctcccctctccctggccgtcaccctggagagccggcctccatctcctgtaggtctagtgagagtcttggaggtcagaacatctatgtggactggtacttgcagaagaccgggcagtctccacaactcctgatctatttgggttccactcgggcctccggggtctctgacaggttcagtgccagtgcatcacacacagatttcacactgcacatcagcagagtggaggctgacgatggttggggtctattactgcataccaagttctaaccaaacccgttcaccgttcgggacaagggacacgactgagtattaagcgaactgngctgacacntctcg

SEQ ID NO: 165166 - DNA, 684 bp, Homo sapiens
  misc_feature: GYAE6OF01BPXLW.44.73.G07.1.454.CMB.1.raw
  modified_base (246)..(246): a, c, t, g, unknown or other
  misc_feature (246)..(246): n is a, c, g, or t
tcagacagtatatacacgaccggtgctcgatttagctctacgctcgaggggccctgggagcacagctcatcaccatggactggacctggaggttcctctttgtggtggcagcaactacaggtgtccagtcccaggtgcgtctggtgcaatctggggctgaaatgaagagcctgggtcctcggtgaaggtcctcctgcacggcttcgtggaggcatcttcagaaactatcttaatcaacctgggttncgacaggcccctggacaaggcttgagtggatgggtgggctcgtccccaattttggactaagcaaactacgcacagaaattccagggcagactcactgtactaccggacggactactaccgaacgagtcgacgacgaccttaagtagtaggacgtccgtacgaccgacaaccgttgagtagtacgtaggaacggaccgtaccgggtacccttagtttaacgtttcgtacggccggtaacgaacgtaaacgttaaaacttttaccgttaccgtttaacggttttttacggggacgggttacggtacggtagttacggttaccgtttaagttacgttaacggttacggtttacgggggtaaccgtaaacggggtacgtaacggttccgggttaccgtacccggttccttaccgttaccgtacccgtcccgttaaaccccgg

SEQ ID NO: 165167 - DNA, 500 bp, Homo sapiens
  misc_feature: GYAE6OF01D5HVK.44.73.G07.1.454.CMB.1.raw
  modified_base (433)..(433): a, c, t, g, unknown or other
  misc_feature (433)..(433): n is a, c, g, or t
  modified_base (467)..(467): a, c, t, g, unknown or other
  misc_feature (467)..(467): n is a, c, g, or t
  modified_base (475)..(475): a, c, t, g, unknown or other
  misc_feature (475)..(475): n is a, c, g, or t
  modified_base (485)..(485): a, c, t, g, unknown or other
  misc_feature (485)..(485): n is a, c, g, or t
  modified_base (496)..(496): a, c, t, g, unknown or other
  misc_feature (496)..(496): n is a, c, g, or t
  modified_base (498)..(498): a, c, t, g, unknown or other
  misc_feature (498)..(498): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccgggggaacagccaccctctcttgcagggccgccagactgttgacgacgatttagcctggtaccaacagaagcctggccaggctcccagactcctcatctatgatacttctagtagggcctctggcatcccagcccgcttcagtggcaggtgggtctgggacagacttcactctcaccatcaccagcctagacgcctagaagtattttgctagtttattactgtactacacgtaagagtgcctcatntcacttcgcctggacaagtgatatcaacgactgngctgcacntctgtctctntcctcccgctntntg

SEQ ID NO: 165168 - DNA, 525 bp, Homo sapiens
  misc_feature: GYAE6OF01AHSUH.44.73.G07.1.454.CMB.1.raw
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagagcctgggtcctcggtgaaggtctcctgcacggcttctggaggcatcttcagaaactatcttatcacctgggtgcgacaggcccctggacaagggcttgagtggatgggtgggctcgtccccaattttggacaagcaaactacgcacagaaattccagggcagactcacgattaccgcggacgaatccagagtgcagcctatatggagctgcgcacctgagatctgaggacacggccctatattctgcgcgagaactaaaatttactacctacgtttttgggacgtagtgtatgtcttatgtatagttggggccgtaagggacaagtcggtcacggtctcttcacgcctccgaacccgg

SEQ ID NO: 165169 - DNA, 518 bp, Homo sapiens
  misc_feature: GYAE6OF01CSU6W.44.73.G07.1.454.CMB.1.raw
  modified_base (407)..(407): a, c, t, g, unknown or other
  misc_feature (407)..(407): n is a, c, g, or t
  modified_base (510)..(510): a, c, t, g, unknown or other
  misc_feature (510)..(510): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccgggggaacgagccaccctctcttgcagggccggcagactgttgacgacgacttagcctggtaccaacagaagcctggcccaggctcccagactcctcatctatgatacttctagtaggcctctggcatcccagcccgcttcagtggcagtggtctgggacaggacttcactctcaccatcaccagcctagacgcctgaagtatttgctagtttattactntctacacgtaagagtgcctacaatattcactttccgcctgggaacctaaagtggatagtacaaacgactgtaggctgcaccatctgtcttctacttcttcccnctatctag

SEQ ID NO: 165170 - DNA, 553 bp, Homo sapiens
  misc_feature: GYAE6OF01C2H6E.44.73.G07.1.454.CMB.1.raw
  modified_base (412)..(412): a, c, t, g, unknown or other
  misc_feature (412)..(412): n is a, c, g, or t
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagaagcctgggtcctcggtgaaggtctcctgcacggcttctggaggcatcttcagaaactatcttatcacctgggtgcgacaggcccctggacaagggcttgagtggatgggtgggctcgtccccaattttggacaagcaaactacgcacagaattccaggcagactcacgattaccgcggacgaatccacgagtgcagcctatagtggagctgcgcaacctgagatctgagacacggcctatattcngcgcgagaactaaaatttactacctacgttttgggcgtagtgatgtacttagtagtattagtttaggggaccgtaaagggactaaagtcgggttacccaccggttccttacttccacgtccccgttcccgtaaaccccggg

SEQ ID NO: 165171 - DNA, 584 bp, Homo sapiens
  misc_feature: GYAE6OF01CJBUG.44.73.G07.1.454.CMB.1.raw
  modified_base (286)..(286): a, c, t, g, unknown or other
  misc_feature (286)..(286): n is a, c, g, or t
  modified_base (467)..(467): a, c, t, g, unknown or other
  misc_feature (467)..(467): n is a, c, g, or t
tcagacagtatatacacgaccggtgctcgatttagctctacgctcagggggatcaggactcctcagttcaccttctcacaatgaggctccctgctcagctcctggggctgctaatgctctgggtctcagggtccagtggagatattataatgactcagtcctcccctctccctggcccgtccaccccgtggagacgcccggcctccatcctcctgtaggtctagtgagtagtcgttgggagtcagaacatctatggtggactggtacttgacaaggaacgccgggnacgtctaccaacaactccgtgatcttagtttcgggtccacgtccgggtccgttccggggtctcgtgacgtggttcagtcgccagtgcactcaacacacagtactttccaactactcgaccactatccgagacaggaggtgggacggtcgtaggacgtggttgggttgggtacttagttcgngactactacctacgtttaccctaacccgttaaccccgttctaccggtcgggacgaacggaccacgtagtaggataagtagcgtaacgtggtacggtcacggaccacctgttcgtacg

SEQ ID NO: 165172 - DNA, 542 bp, Homo sapiens
  misc_feature: GYAE6OF01A427D.44.73.G07.1.454.CMB.1.raw
  modified_base (331)..(331): a, c, t, g, unknown or other
  misc_feature (331)..(331): n is a, c, g, or t
tcagacagtatatacacgaccggtgctcgatttagctctacgctcagggggagggaactgctcagttaggacccagagggaaccatggaagccccagacctcagcttctcttcctcctgctactctggctcccagattccaccggcgaaattgtgttgacacaatctccagccaccctgtctttgtctccgggggaacagccaccctctcttgcgagggccggcagactgttgacggacgacttagcctggtaccaacagaagcctggccaggcctcccaagtactcctcatctatgatacttctagtaggcctctggcatcccagcccgnttcagtgcaggtagggtctagggacagcttcactctcaccatccgacaggacctagacgcctagaagtagttttgacctagttttatacgtgtactacaccgtaagaagtggcctaccaatactctactttccggacccttgggaacctaaagtcggtatactacaaacgactgtggctgcacagtctagtcttacatctccgctatctag

SEQ ID NO: 165173 - DNA, 511 bp, Homo sapiens
  misc_feature: GYAE6OF01B1GC4.44.73.G07.1.454.CMB.1.raw
  modified_base (437)..(437): a, c, t, g, unknown or other
  misc_feature (437)..(437): n is a, c, g, or t
tcagacagtatatacacgaccggtgctcgatttagctctacgctcaggggggaactgctcagttaggacccagagggaaccatggaagccccagctcagcttctcttcctcctgctactctggctcccagattccaccggcgaaattgtgttgacacaatctccagccaccctgtctttgtctccgggggaacagccaccctctcttgcagggccggccagactgttgacgacgacttagcctggtaccaacagaagcctggccaggctcccagactcctcatctatgatacttcagtagggcctctggcatcccagcccgcttcagtggcaggtgggtctggggacagacttcactctcaccatccaccagccctaagacgcctagaagtattttgctagtttattactgtctacaccgtaagagtggcctcaatnttcacttcgcctggacaagtgatatacaacgactgtgctgcacatctgtcttcactccttcccgcactctgtac

SEQ ID NO: 165174 - DNA, 500 bp, Homo sapiens
  misc_feature: GYAE6OF01E1V22.44.73.G07.1.454.CMB.1.raw
  modified_base (196)..(196): a, c, t, g, unknown or other
  misc_feature (196)..(196): n is a, c, g, or t
  modified_base (495)..(495): a, c, t, g, unknown or other
  misc_feature (495)..(495): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccgggggaacngccaccctctcttgcagggccgccagactgttgacgacgacttagcctggtaccaacagaagcctggccaggctcccagactcctcatctatgatacttctagtagggcctctggcatcccagcccgcttcagtggcagtgggtctgggacagacttcactctcaccatcaccagcctagacgcctgaagtatttgctagtttattactgtctacacgtaagagtgctcatatcacttcgcctggacctaagtgatatacaacgatgtagctgcaccatctgtcttcattctcccgctntctag

SEQ ID NO: 165175 - DNA, 552 bp, Homo sapiens
  misc_feature: GYAE6OF01AG9W1.44.73.G07.1.454.CMB.1.raw
  modified_base (196)..(196): a, c, t, g, unknown or other
  misc_feature (196)..(196): n is a, c, g, or t
  modified_base (415)..(415): a, c, t, g, unknown or other
  misc_feature (415)..(415): n is a, c, g, or t
tcagacagtatatacacgaccggtgctcgatttagctctacgctcagggggaggaactgctcagttaggacccagagggaaccatggaagccccagcgcagcttctcttcctcctgctactctggctcccagacaccactggagaaatagtgatgacgcggtctccagccaccctgtctgtgtctccaggggaaanagccaccctctcctgcagggccagtcagagtgttagcagcaacttgcctcgtaccagcagaaatctggccaggctcccaggcctcctcatctatggtgcatcccaccgacgggcccacgtcggtactccccgagccctagggtttcaggttcggcgtaggtcggggtctggggacaggtagttcactctcaccatcagcagcctgcagtctagaagttntttgcttagtttatactgtcagctagtataatgtactcggtcccttccgttcggaccgaagggccacggtaccgtaggaacgtaacgttaaacggacgttggtacggtctacgaccacctattcttgttccttaccg

SEQ ID NO: 165176 - DNA, 690 bp, Homo sapiens
  misc_feature: GYAE6OF01DT15G.44.73.G07.1.454.CMB.1.raw
tcagacagtatatacacgaccggtgctcgatttagctctacgctcgtagggggatcagggactcctcagttccaccttctcacaatgaggctccctgctcagctcctggggctgctaatgctctgggtctcgagggtcagtggagatattataatgactcagtcctcccctctccctggccgtccacccgtggagacgccggcctcatctcctgtaggtctagtgagagttcgttggaggtcaagaacatctatgtggactggtacttgacagaacggaccggcacgtcctccactaactcctgtacttcttagtttcgggttccacggtccgggtccgttccggggtctcgtgacgtaggttcagtcgccgtagtcgactactcaacacacagtactttcactactgacacatcagacgtaggaggtgggacggtacgtacgggaacggttacggttcggggtttacggggttacctttaacgtttaccgtacgtaccgttaaccgttaacccgttaacgtttaccccttaaaccccgttaaacccccggtttaccgttaaccccgggttaccggggaaccggaaaccggggtaaccgtaaaccggtaacgtttacggaaacggttaaagttaaacggacggtaaccggttggtaccggtacgtacgaccctaaccgtattccgttacg

SEQ ID NO: 165177 - DNA, 526 bp, Homo sapiens
  misc_feature: GYAE6OF01D03CR.44.73.G07.1.454.CMB.1.raw
  modified_base (303)..(303): a, c, t, g, unknown or other
  misc_feature (303)..(303): n is a, c, g, or t
  modified_base (499)..(499): a, c, t, g, unknown or other
  misc_feature (499)..(499): n is a, c, g, or t
  modified_base (523)..(523): a, c, t, g, unknown or other
  misc_feature (523)..(523): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccgggggaacgagccaccctctcttgcagggccggccagactgttgacgacgacttagcctggtaccaacagaagcctggccaggctcccagactcctcatctatgatgcatccaacngggtcactggcaccccagacaggttcagtggcagtgggtctgggacagacttcactctcaccgtcagcaatgtaacagcctagaagtatttgctagtttattactgtcagcagtcgttcctccgacggccgctcgtacgtttcgggcgggggtaccgtaagggtggagagtcgagacgacgtgtggcgtcgacacntctgtcttcacttccttcccgctntcg

SEQ ID NO: 165178 - DNA, 582 bp, Homo sapiens
  misc_feature: GYAE6OF01DEUCM.44.73.G07.1.454.CMB.1.raw
  modified_base (226)..(226): a, c, t, g, unknown or other
  misc_feature (226)..(226): n is a, c, g, or t
  modified_base (377)..(377): a, c, t, g, unknown or other
  misc_feature (377)..(377): n is a, c, g, or t
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatcgtggggctagaaatgaagaagcctgggtcctcggtgaaggtctcctgcacggcttcgtggagcatcttcagaactntcttatcaccgtgggtcgcgacacggccccgtggacgaagggcttggagtggatgggtggctcgtcccaatttggacaagcaaactacgcacagaattcaggcagactcacgatacgcgagactccgagagtgacagacctatagtggacnctcgcgacacctagagactcgtaggaacggtacgacggtaccctagttactttcgtacgtcgaacgaagtaactaaaacgtttctaccttacggttttagggacgtagtagtactgtacttagtagtagttaggttacgggaccgtaagggacgtaagttcggtactaccgtaccttcgttacacgtcccgtaccgtaaccccgg

SEQ ID NO: 165179 - DNA, 524 bp, Homo sapiens
  misc_feature: GYAE6OF01ETP8D.44.73.G07.1.454.CMB.1.raw
  modified_base (322)..(322): a, c, t, g, unknown or other
  misc_feature (322)..(322): n is a, c, g, or t
  modified_base (376)..(376): a, c, t, g, unknown or other
  misc_feature (376)..(376): n is a, c, g, or t
  modified_base (390)..(390): a, c, t, g, unknown or other
  misc_feature (390)..(390): n is a, c, g, or t
  modified_base (487)..(487): a, c, t, g, unknown or other
  misc_feature (487)..(487): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccgggggaacgagccaccctctcttgcagggccgccagactgttgacgacgacttagcctggtaccaacagaagcctggcaggctccagactcctcatctatgatacttcagtagggcctctggcatcccagcccgnttcagtggcaggtgggtctgggacagacttcactctcaccatcaccagcctagngcctgaagtatttnctagtttattactgtctacacgtaagaagtcgacctaccaatacttctactttcggaccctacgggaacctaaagtgtatatacaaacgaactgtgntgcaccatctgtcttacacttcttcccgctactctag

SEQ ID NO: 165180 - DNA, 502 bp, Homo sapiens
  misc_feature: GYAE6OF01CMCSX.44.73.G07.1.454.CMB.1.raw
  modified_base (324)..(324): a, c, t, g, unknown or other
  misc_feature (324)..(324): n is a, c, g, or t
  modified_base (468)..(468): a, c, t, g, unknown or other
  misc_feature (468)..(468): n is a, c, g, or t
  modified_base (476)..(476): a, c, t, g, unknown or other
  misc_feature (476)..(476): n is a, c, g, or t
  modified_base (494)..(494): a, c, t, g, unknown or other
  misc_feature (494)..(494): n is a, c, g, or t
  modified_base (497)..(497): a, c, t, g, unknown or other
  misc_feature (497)..(497): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccgggggaacgagccaccctctcttgcagggccggccagactgttgacgacgacttagcctggtaccaacagaagcctggccaggctcccagactcctcatctatgatactctagtaggcctctggcatcccagcccgnttcagtggcagtgggtctggacagacttcactctcaccatccaccagcctagacgcctagaagtatttgctagtttattactgtactacacgtaagagtgcctcaatatcacttcgcctggacctaagtgatatcaaacgatgngctgcacntctgtcttcatccttccnctntctag

SEQ ID NO: 165181 - DNA, 591 bp, Homo sapiens
  misc_feature: GYAE6OF01CUUXG.44.73.G07.1.454.CMB.1.raw
  modified_base (241)..(241): a, c, t, g, unknown or other
  misc_feature (241)..(241): n is a, c, g, or t
tcagacagtatatacacgaccggtgctcgatttagctctacgctcagggggatcaggactcctcagttcaccttctcacaatgaggctccctgctcagctcctggggctgctaatgctctgggtctcagggtccagtggagatattataatgactcagtctcccctctccctggccgtcacccctggagacgccggcctccatctcctgtaggtctagtgagagtcttggaggtcagaacntctatgtggactggtacttgcagaagaccgggcagtctccacaactcctgatcttatttgggtccacgtcgggccgtccggggtctcgtgacaggttcagtgccagtcgcatcacacactagatttcacactgacacatcagcagtagtaggaggtctaggacgtagttaggttggggtacttagttactgctaactacccgtaagttacctaaccgtaaaccccgttacgtacccgttcggggaccaaacggggtaacccgtacgtaacgttaggtaaacggtaattaaacgggacccggtaaacgttgggtacggtacctacggaccaaccctagttcgtttaacccg

SEQ ID NO: 165182 - DNA, 606 bp, Homo sapiens
  misc_feature: GYAE6OF01CB625.44.73.G07.1.454.CMB.1.raw
  modified_base (390)..(390): a, c, t, g, unknown or other
  misc_feature (390)..(390): n is a, c, g, or t
tcagacagtatatacacgaccggtgctcgatttagctctacgctcaggggggaactgctcagttaggacccagagggaaccatggaagccccagctcagcttctcttcctcctgctactctggctcccagattccaccggcgaaattgtgttgacacaatctccagccaccctgtctttgtctccgggggaacgagcccaccctctcttgcagggccggccagactgttgacgacgacttagcctggtaccaacagaagcctggccaggctcccagacctcctcatctatggaacatcccacagggccactggactcccacctaggttcagtggcaggtcgggtccggacaggacgttcactctcaaccatcagcgctgcagtctgagtntttgctagtttatactgtcagtcagtatgggttcgtctaccgtcgtgtacggttcggaccgtaaaggggacctaagggtacggaaactacgaaaacggtaacttggtacgacgtggaccctaccgtaagtttccgttcggtttacctttacctaccgtttccccgttaccccgtaccctacttacccgttagtaactttaacgttacgttaacccg

SEQ ID NO: 165183 - DNA, 670 bp, Homo sapiens
  misc_feature: GYAE6OF01D1E20.44.73.G07.1.454.CMB.1.raw
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatcgtggggctgaaatgaagaagcctgggtcctcggtgaaggtctcctgcacggcttctggagcatcttcagaaactatcttatcaccgtgggtgcgacacggcccctggacaagggcttgagtggagtgggtggctccgtcccctaagttttggacaaggacaaactacgacaacagaaacttccgaggcagactcacgacttaccgcggaacgaatccacgagtcgcagcctaatagtggagctgacgacaacctgagtatcgtagacggacgaccgggtacccttaagttactttcgtacgcgtacgtaagtaaaccttaaaaacgtttccttaaccgtttaacgtttttacgggggacggttaacggttacgtacgttagtaccgtttaagttacgtaagttaaggtttacggggtaaccgtaaaggggtaaccgttaaacggttaccgggttaaccgtacccggttaccgtttaccgttaccgtaaccggtccccgttaccccgtaaaacccccgggg

SEQ ID NO: 165184 - DNA, 580 bp, Homo sapiens
  misc_feature: GYAE6OF01DIOFM.44.73.G07.1.454.CMB.1.raw
  modified_base (322)..(322): a, c, t, g, unknown or other
  misc_feature (322)..(322): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtcgtccgggggaacgagccacctctctgcgagggccgcagactgtgacaccaccacagcttctagcctggtaccagcagaacgccgtggccaggcctcccgaggcctcctacatactacgatgcatccagccaaggccgntcggcactcccgagactaggttcaggtggacaggtcgggtcgtgggactaggtacttcactcgtcaacgcatccgaggcggactcgggagtccgtagaggtacttcgtcgtcgttaagtttacttacgttgtactagcgtaagttacgttgggttcgtactaccgttcgtaggtaccgttcggaccgaagggaccgtaagggtacgtaaactacgaaacgtcgtaggtacgactcggactacctactcgttcgttacc

SEQ ID NO: 165185 - DNA, 556 bp, Homo sapiens
  misc_feature: GYAE6OF01C2K7P.44.73.G07.1.454.CMB.1.raw
  modified_base (323)..(323): a, c, t, g, unknown or other
  misc_feature (323)..(323): n is a, c, g, or t
tcagacagtatatacacgaccggtgctcgatttagctctacgctcaggggggaactgctcagttaggacccagagggaaccatggaagccccagctcagcttctcttcctcctgctactctggctcccagattccaccggcgaaattgtgttgacacaatctccagccaccctgtctttgtctccgggggaacagccaccctctcttgcagggccggccagactgttgacgacgacttagcctggtaccaacagaagcctggccaggctcccagactcctcatctatgatacttctagtagggcctctggcatcccagcccgnttcagtgcagtggtctgggacagacttcactctcaccatccaccagccctagacgccttgaagtatttgactagttttatacttgtctaacaccgtaagagtcggacctacaattacttcactttcggcccttagggacccaaagttggaattactacgaacgtaactgtaggcttgacctaaccgattccttgttccttcctacttcccttaccccgcctaagtcctgtaac

SEQ ID NO: 165186 - DNA, 531 bp, Homo sapiens
  misc_feature: GYAE6OF01BNL6D.44.73.G07.1.454.CMB.1.raw
  modified_base (214)..(214): a, c, t, g, unknown or other
  misc_feature (214)..(214): n is a, c, g, or t
  modified_base (367)..(367): a, c, t, g, unknown or other
  misc_feature (367)..(367): n is a, c, g, or t
tcagacagtatatacacgaccggtgctcgatttagctctacgctcaggggccctgggagcacagctcatcaccatggactggacctggaggttcctctttgtggtggcagcagctacaggtgtccagtcccaggtgcagctggtgcagtctggggctgaggtgaagaagcctgggtcctggtgaggtctcctgcaaggcttctggagcaccttnttcagctatgtcttttagtttgggtgcgacacggcccctggacaagggcttgagtggctgggaggatcatcctatctttggtgcatcgaattacgcacagacgtttcaggacagagtcaccattaccgcgacgactccacgagtacagcctanatggagctgagcgaggtctgagatcgtagaagaccacggacctatacttatttcgtgtcgcgagacgtccctacgtctactttacattcgtcctctactactacgtcccacactagtaggtaacttcggtacccgtcccggtacggggccgtcgggtaaccccg

SEQ ID NO: 165187 - DNA, 866 bp, Homo sapiens
  misc_feature: GYAE6OF01AEVWH.44.73.G07.1.454.CMB.1.raw
  modified_base (205)..(205): a, c, t, g, unknown or other
  misc_feature (205)..(205): n is a, c, g, or t
  modified_base (348)..(348): a, c, t, g, unknown or other
  misc_feature (348)..(348): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtcgtccggggaacagccaccctntctgcaggccgcagactgttgacgacgacttagcctaggtaccaacaggaacgcctggccaggcctcccgagacctcctacatctatgtaacttaccttcgtaaggtacgggccctcgtcggcctactccccaggtccccgtntttccgaggtcggacgtagggttcggggtccgtaggggaacctagggtaaccctttccgaaccgtttcccttacccgaaccctaacttacccgaaccccgtaggtaccccgttaacgggaccggtacccgttagggtaaacgttaacgttttttacgggtaccgtttaaggttttttaacgttttaaccgtttaccggtttaacccgtttaaacccggtaaacccgggttaaacgggttaaacgggttacccgggttaacccctttaacccgttaaaacgttttaccgttttaacccgtttaacccgtttttacccggggtaccccggttacggggtaaacccgtaaacgggttacggttaaacgttaaaccgttaaccgtaaaaaccggttaaccgttcgggttaacgggtccgttacggtacccgtaacccgttaacgttcccgtttacgtttacccgtttaccgttaaccctttaccccggtttacccccgtacccttaccgttaccgtttaacg

SEQ ID NO: 165188 - DNA, 521 bp, Homo sapiens
  misc_feature: GYAE6OF01ES07H.44.73.G07.1.454.CMB.1.raw
  modified_base (329)..(329): a, c, t, g, unknown or other
  misc_feature (329)..(329): n is a, c, g, or t
  modified_base (441)..(441): a, c, t, g, unknown or other
  misc_feature (441)..(441): n is a, c, g, or t
  modified_base (493)..(493): a, c, t, g, unknown or other
  misc_feature (493)..(493): n is a, c, g, or t
  modified_base (497)..(497): a, c, t, g, unknown or other
  misc_feature (497)..(497): n is a, c, g, or t
  modified_base (516)..(516): a, c, t, g, unknown or other
  misc_feature (516)..(516): n is a, c, g, or t
  modified_base (518)..(518): a, c, t, g, unknown or other
  misc_feature (518)..(518): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgtttgacacaatctccagccaccctgtctttgtctccgggggaacagccaccctctcttgcagggccgccagactgttgacgacgacttagcctggtaccaacagaagcctggccaggcctcccagactcctcatctatgatacttctagtagggcctcgtggcactcccagcccgtnttcagtggcaggtgggtctgggacagacttcactctcatcatcaccagcctagacgcctgaagtatttgctagtttactactgtacctacaccgtaagagtcgcctacaatntctacgtttccggccctgggacctaagtgatatacaaagactgtgctgcacntctntacttcacttccttcccgntntcg

SEQ ID NO: 165189 - DNA, 649 bp, Homo sapiens
  misc_feature: GYAE6OF01C1H0X.44.73.G07.1.454.CMB.1.raw
  modified_base (203)..(203): a, c, t, g, unknown or other
  misc_feature (203)..(203): n is a, c, g, or t
  modified_base (284)..(284): a, c, t, g, unknown or other
  misc_feature (284)..(284): n is a, c, g, or t
  modified_base (290)..(290): a, c, t, g, unknown or other
  misc_feature (290)..(290): n is a, c, g, or t
  modified_base (300)..(300): a, c, t, g, unknown or other
  misc_feature (300)..(300): n is a, c, g, or t
  modified_base (318)..(318): a, c, t, g, unknown or other
  misc_feature (318)..(318): n is a, c, g, or t
  modified_base (388)..(388): a, c, t, g, unknown or other
  misc_feature (388)..(388): n is a, c, g, or t
tcagacagtatatacacgaccggtgctcgatttagctctacgctcaggggggaactgctcagttaggacccagagggaaccatggaagccccagctcagcttctcttcctcctgctactctggctcccagattccacggcgaaattgtgttgacacaatctccagccacctgtctttgtcgtccgggggaacacgccaccctntcttgcagggccggccagactgtgacgacgacttagcctggtaccaacgagaacggcctggccaggcctccgagactcctnatctangtactacttntaggtaggccttcgcgcnctcccgagccctacttcgagtcggctagggtcggtctggggactagtcttacactctacactatccaacngtcctagacgtcctagaagtacttttgaccttagtttacttacgtacgttactaaccgtacgtacgccgtacgtcggtcctaagggttacgttacggttttcgggaccggtaacggggtaaccaacggtacggtacggtacgtaccgtaacgaaacgtaacgtggtacgtaccgtacgtacctaacccgagttacccgttcgttaccgttccgttaaccgttcccctttaccccgaaccttacgttccgttagttaaaccg

SEQ ID NO: 165190 - DNA, 579 bp, Homo sapiens
  misc_feature: GYAE6OF01CQOIG.44.73.G07.1.454.CMB.1.raw
  modified_base (225)..(225): a, c, t, g, unknown or other
  misc_feature (225)..(225): n is a, c, g, or t
  modified_base (562)..(562): a, c, t, g, unknown or other
  misc_feature (562)..(562): n is a, c, g, or t
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagaagcctgggtcctcggtgaaggtctcctgcacggcttctggaggcatcttcagaaactntcttatcacctgggtgcgacacggcccctggacaagggcttggagtggagtggggtggctcgtcccctaagttttggacaagcaaactacgcacagaacttcgaggcagactcacgattaccgcgacgatccacgagtgcagcctatagtggagcgtgccgacaaccgtgagatctaggacggacgaccggtaccctattacttcgtcgccgacgaagtaaacctaaaacttttccgtaccttacgttttggggacggtagttgtagttgtacttagtgtagttagttcggggaccgtaagggtactaacggttcggtacctaccgttcttcttacncgccctcccgaacccgg

SEQ ID NO: 165191 - DNA, 699 bp, Homo sapiens
  misc_feature: GYAE6OF01BZ4S6.44.73.G07.1.454.CMB.1.raw
  modified_base (227)..(227): a, c, t, g, unknown or other
  misc_feature (227)..(227): n is a, c, g, or t
  modified_base (245)..(245): a, c, t, g, unknown or other
  misc_feature (245)..(245): n is a, c, g, or t
tcagacagtatatacacgaccggtgctcgatttagctctacgctcaggggccctgggagcacagctcatcaccatgactggacctggaggttcctctttgtggtggcagcaactacaggtgtccagtcccaggtgcgtctggtgcaatcgtggggctgaaatgaagagcctgggtcctcggtgaaggtctcctgcgacggtcttcgtggagcatcttcaagaaactntcttatccaccgtgggtncgacgacggccctggacgaaggcttgagtggagtggggtggcctccgtcccctaagttttcggactaacggcaaactaccggacaacaagaacttccgaggtcagactacgacgtacgtaccggacggaacaacgtcccgaacgagtcgacgacgtacctagtagtggacgcgtacggccgacgtaaccgtggacgtacgttccgtaggaacggaccgaccggtacccttaagttacgtttcgtcggtacgtaacggtaacgtaaaaccttaaaacgtttcccgttaccgtttacggttttacggggacggttagttacggtacgttacgttacgttaagttagttaacgtttagggtttacgggtaaccggtaaacggggtaacgtaacggttacggttaccgtacccggttccttaccgttacccgacgttccccgtaccgtaaaccccggg

SEQ ID NO: 165192 - DNA, 669 bp, Homo sapiens
  misc_feature: GYAE6OF01A6KIH.44.73.G07.1.454.CMB.1.raw
  modified_base (275)..(275): a, c, t, g, unknown or other
  misc_feature (275)..(275): n is a, c, g, or t
tcagacagtatatacacgaccggtgctcgatttagctctacgctcagggggatcaggactcctcagttcaccttctcacaatgaggctccctgctcagctcctggggctgctaatgctctgggtctcagggtccagtggagatattataatgactcagtcctcccctctccctggcccgtcacccctggagacgccggcctccatcctcctgtaggtctagtgagagtcttggaggtcagaacatctatgtgactggtactgcagaagaccgggnagtcctccacaactcctgactcgtagtttcgggtccacgtccgggcctccggggtctcgtgacgtaggttcagtcgcagtgcatccacacacgtagtactttaccactactcgacaacactacagacgaggtaggtagggacgggtctagggtacggtagttgggtttacggggttacttaacgtttacgtacgacctaacgttaacccgttaacgtttacccttaaaccccgttaaacccccggtttacccgtaacccggttaccggggaaccgtaaacggggtaacccgtaaccggttaacggttaggtaacggttaaagttaacggaaccggttaaaccgttagggttaccgggtacgtacggaccctaacccgtaacgttccgtttaccg

SEQ ID NO: 165193 - DNA, 621 bp, Homo sapiens
  misc_feature: GYAE6OF01CWZW2.44.73.G07.1.454.CMB.1.raw
  modified_base (381)..(381): a, c, t, g, unknown or other
  misc_feature (381)..(381): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccgggggaacagccaccctctcttgcagggccgccagactgttgacgacgacttagcctggtaccaacagagcctggccaggctcccagactcctcatctatgataccttctagtacggcctctggccactcccagcccgcttcagtgcagtgggtctgggacagtacttcactctcaccatccacagcctagacnctagaagtatttgactagtttattactgtactacaccgtaagaacgtcgaccttcctaattcttacctacgttttccgggacccttagggaaccctaaaaggttcggaaacttaacgtaccgaaaacgtaaccgttaggtccggtaccgttaggtacccaacccgtaacttcccgttacggttacccttttaccgtaacgtttacccctttcccccgggacccttaacgttccgttacgg

SEQ ID NO: 165194 - DNA, 663 bp, Homo sapiens
  misc_feature: GYAE6OF01C7DHJ.44.73.G07.1.454.CMB.1.raw
  modified_base (659)..(659): a, c, t, g, unknown or other
  misc_feature (659)..(659): n is a, c, g, or t
tcagacagtatatacacgaccggtgctcgatttagctctacgctcaggggggaggaactgctcagttaggacccagagggaaccatggaagccccagctcagcttctcttcctcctgctactctggctcccagattccaccggcgaaattgtgttgacacaatctccagccaccctgtctttgtcgtccgggggaacacgccaccctctcttgcgagggccgccagactgtgacgagacttagcctggtaaccaacagaacgccgtggccaggctccagactcctcatctatcgatacttctaggtaggccttcgcggcactccccacggccctcttcgaggtcggactaggtcgggtccgtagggaactagtaccttcaacctttccaccaacctaataccaacccgaaacgcccgtaaaggacgtacctaggtaaagttatttttcgacttaaggtttttaacttaacgtcgtacgtaaccaaaccggttaaagtaacggtcggtaacctaccgaaatttactaccttaacgtttccggacccgttagggaaaccctaaaggttaggaacttaacgtaacgaaaaccggtaactgggtccggactacggacctactacttgttcgtactttacgacttacccttccccgacttactntaag

SEQ ID NO: 165195 - DNA, 594 bp, Homo sapiens
  misc_feature: GYAE6OF01A7MBD.44.73.G07.1.454.CMB.1.raw
tcagacagtatatacacgaccggtgctcgatttagctctacgctcagggggaggaactgctcagttaggacccagagggaaccatggaagccccagctcagcttctcttcctcctgctactctggctcccagagatcaccggagatattgtgttgacacagtctccaggcaccctgtctttgtctccgagggggagagacgcccaccctctcctggtaggccagtcggagtgttgctaagtacctagcctggtaccaacagaaacctggccaggcctccgaggcctcctcatctatgatgcactccaacgagggtcacgtcggaccaccccagactaggttcaggtggctaggtgggtctgggacagtacttcactctcaccgtcagcaatgtacagcctagaagtatttgacttaagtttattacgtgtacgagtctacgtccgttcctccgacgccgtcgtccgtaccggtttccgggggaccggggtaaccgtaggggtacggacgtaacgtcgaacggacggtaacgtcggtacggtctcggaccgacctacgttcgttcgttaccttactacgttcccgttcccgtacc

SEQ ID NO: 165196 - DNA, 592 bp, Homo sapiens
  misc_feature: GYAE6OF01ARM2X.44.73.G07.1.454.CMB.1.raw
tcagacagtatatacacgaccggtgctcgatttagctctacgctcagggggaggaactgctcagttaggacccagagggaaccatggaagccccagctcagcttctcttcctcctgctactctggctcccagataccactggagaaatagtgatgacgcagtctccagccaccctgtctctgtctccgaggggaaagcgccaccctctcctggtacgggccagtcggagtgttgctaagtacctagcctggtaccaacagaaacctggccaggctcccaggctcctcatctatgatgcatccaacgacgggtcacgtggccaccccagacaggttcagtgctaggtgggtctgggacaggaccttcactctcaccgtcacgcaatcggtacagcctagaagtattttgactagtttattacgtgtcagcacgtccgttcctacgcggtccgtctacgtaccggtttccggggaccgggggtaccgtaagggttcgggacgtaacgtcggaacgtacggtaacgttggtcgggagttcggaccgaccctagttccttcggttacctttctaccttcccgtttccccgtacccg

SEQ ID NO: 165197 - DNA, 666 bp, Homo sapiens
  misc_feature: GYAE6OF01E3PL8.44.73.G07.1.454.CMB.1.raw
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatcgtggggctgaaatgaagaagcctgggtcctcggtgaaggtctcctgcacggcttctggaggcatcttcaagtaaactatcttatccaccgtgggtcgcgacgacggcccctggacaagggtcttgagtggagtgggtggctcgtcccctaatttggacaagcaaactacgcaacagaaacttccgaggcagactcaacgacttaccgacggacgaatcccacgagtcgcagtccctaatacgtggagctgccgaccaaccgtgagactcgtaggaacggaccgaaccggtacccttagttatttccgtaggtccgacgtaacaaaccgtaaaaattttcctaacccgttacgtttttcggggacggtacggttagtacgtgtacttagtacgttagttacggtttacggggtacccggtaaaggggtaacctaaacggtttcgggttacccgtaaccccggtttccgtttacccgttaccgttacccgtccccgttaccccgtaaaacccccgggg

SEQ ID NO: 165198 - DNA, 557 bp, Homo sapiens
  misc_feature: GYAE6OF01BIUWZ.44.73.G07.1.454.CMB.1.raw
  modified_base (195)..(195): a, c, t, g, unknown or other
  misc_feature (195)..(195): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagataccaccggggaaattgtgttgacacaatctccagccaccctgtctttgtctccaggggaanagccaccctctcctgcagggccagtcagagtgttaggaactactagcctggtatcaacagacacctggccaggcctcccaggctcctcatctatgatgcatccaagtaggggccgcgggcactccccgagcccaggttcaggtggcaggttgggtctgagacagtcttcactctcaccatcagcggctagagcggagtatttgctagtttactactcgtacaactaccgtagcgacgtcggaccttaggtactaggtttcggaccgaggggtaccgagtcgtagggacgtcgtacgaaacgtaccgtggtcggcgtagactacctacgtctcgttcttactacttcccgttcccgtcctacg

SEQ ID NO: 165199 - DNA, 701 bp, Homo sapiens
  misc_feature: GYAE6OF01C0VQJ.44.73.G07.1.454.CMB.1.raw
tcagacagtatatacacgaccggtgctcgatttagctctacgctcagggggatcaggactcctcagttcaccttctcacaatgaggctccctgctcagctccgtggggctgctaatgctctggactccctggacccagtgcagatgttgtgctgacccagacctcccctctctctgtcccgtcacccgtggacacgccgcctcatcgtcctgcaagtctagtcagcgcctcctgctagtagtagagtaaggaaatactaattagtttgtacgtgggtaaccctggacgaaggtgggtaccgacggtcctaacggttcctccgacgacgtccctacctactacttctagtacgttacttttaccttacgaacggtccgccttcgtcggtggtacgtcgacgtaagttagtcggttaccggaggttacgggcggtaacgggggtccgggggtaacgggacgttaacgttacgtttaaccgaaacgtaacgtaaaacgaaaacgttccggaacggggtcggggttaacgggacggtcgtagggaaggttaggtttacggttaagtttaacgtttagtaccgtagtaacctaggttacgacggtacgtacgttacgttaccgttacccggttacccggtaccgtaccgggacgaacgggtacgtaacgggtaagaacgtaacgaacggagtaacgtggtcgtacg

SEQ ID NO: 165200 - DNA, 566 bp, Homo sapiens
  misc_feature: GYAE6OF01C1IO4.44.73.G07.1.454.CMB.1.raw
  modified_base (271)..(271): a, c, t, g, unknown or other
  misc_feature (271)..(271): n is a, c, g, or t
  modified_base (276)..(276): a, c, t, g, unknown or other
  misc_feature (276)..(276): n is a, c, g, or t
tcagacagtatatacacgaccggtgctcgatttagctctacgctcagggggatcaggactcctcagttcaccttctcacaatgaggctccctgctcagctcctggggctgctaatgctctgggtctcagggtccagtggagatattataatgactcagtcctcccctctccctggcccgtcacccctggagacgcccggcctcatctcctgtaggtctagtgagagtcttggaggtcagaacatctagtgtgactggtactgcagagcggnagtcncacactcctgctcttagtttcgggtccacgtccgggccgttccggggtctcgtgacgtggttcaggttcgacctaggtgacatccaacacactagtacttacacgtactgacacatccgagcgaggacggtgggaacggtctaggacggtagttcgggtacgggtacctagttacgtcgacgtacgtacctacgttacctaacccgtaacccgttcgttaccgtacgggacgaaggtaccacgtacgtagagtaataggacgacgttggcgtctacgacactgtcgttcg

SEQ ID NO: 165201 - DNA, 805 bp, Homo sapiens
  misc_feature: GYAE6OF01DJHFZ.44.73.G07.1.454.CMB.1.raw
  modified_base (470)..(470): a, c, t, g, unknown or other
  misc_feature (470)..(470): n is a, c, g, or t
tcagacagtatatacacgaccggtgctcgatttagctctacgctcagggggatcaggactcctcagttcaccttctcacaatgaggctccctgctcagctcctggggctgctaatgctctgggtctcagggtcagtggagatattataatgactcagtcctcccctctccctggccctccaccctggagacgccggcctccatcctcctggtaggtctagtgagtacgttcgtttggggacggtacaagaactatcttaatggtggacgtggttaacttggacaaggaacggacccgggctacggttccacccctaactaacctccttagttacgttaccttaggttttcgggtaccctaccgggtccggcccggttccgggtactcgtcgacgtcggtcagtcgcctagtcgactactcaacacctacgagtactttaccaactacgttacgaccaacgtactaaccgngtaaccggtaaggtaaggggtcgggaagggtccggtaacggttaccgggttaggtttacggggtttacggggtttacttaacgtttaaccgtcgtaaccgttaaccgttaacccgttaaaccggtttacccgttaaaacccccggttaaaccccccggttttaccgttaaccccgggggtttaccgggaaaccggtaaaaccgggggttaccctaaaccgggttaaaccggttacgggtaaaacggttaaacggtttaaacggtcccgggtaaaccgtttggggaccggtaccgtaaccggtacccgtaacccttaggttcccgttttaacccgg

SEQ ID NO: 165202 - DNA, 705 bp, Homo sapiens
  misc_feature: GYAE6OF01A9GJE.44.73.G07.1.454.CMB.1.raw
  modified_base (308)..(308): a, c, t, g, unknown or other
  misc_feature (308)..(308): n is a, c, g, or t
tcagacagtatatacacgaccggtgctcgatttagctctacgctcaggggggaactgctcagttaggacccagagggaaccatggaagccccagctcagcttctcttcctcctgctactctggctcccagattccaccggcgaaattgtgttgacacaatctccagccaccctgtctttgtctccgggggaacagccaccctctcttgcagggccggccagactgttgacgacgacttagcctggtaccaacagaagcctggccaggcctcccagacctcctcatctatgatacttctaggtggcctntggccatcccacgcccgcttccaggtcggcgtaggtgggtcctggggaaccaggtacctttcaaccgttctaccgaaccatccgaaccacggcccgtaaggacgtccctaggtaaacgttattttacggtacttaaggttttaagtttaaccttacggtaccttaaaccgtaacccggttaaaggtaacggttacgggtaccccttaaccctaaagttacgtttaccctaaccgttttccgggtaccccgttaggggtaacccgtaaaagggttacggtaaacttacgtaaccgaaaaccgtaacgttacggtacgggtccttacggcctaacccgtagttccgttagttcccgttactacttcccgttacccccgaccttacttccgtagtaaacg

SEQ ID NO: 165203 - DNA, 773 bp, Homo sapiens
  misc_feature: GYAE6OF01DOH63.44.73.G07.1.454.CMB.1.raw
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatcgtgggctgaaatgaagagcctgggtcctcggtgaacggtctccgtgcgtacggtcttcgtggaggctatcttacaagtaaactattcttatccgaccgtgggtcgcgacgacggccccgtaggaccgaagggtcttggaggtggagtggggtcggtccgtccgtcccctaagttttacggacaacggtacaaaccgtacgccaacgaacgtaaacgttaccgagggacgaacgtactaccgaacgtaaccgttaaccggaccggaacgaactaccgaacggagtcgtacacgtacctacgtagtcggaacgcgtacgaccgacgtaaccgtagaacgtaacgttccggtaggtaaccgggaaccgtacccggtacccttaacgtttactttaccgtacgtaccggacggtaacgtaaaccgtttaaaaactttacccgttaaccgtttaccggttttacggggtaccggttaaggttacggtaactttacggtacctttaggttagttaacgtttagggtttaccggggaaccgttaaagggtaacgttaacggttaccgggttaccttaccccggttacttacccgttacgtaaccgtcccccgtaaccgtaaacccccggg

SEQ ID NO: 165204 - DNA, 677 bp, Homo sapiens
  misc_feature: GYAE6OF01D859A.44.73.G07.1.454.CMB.1.raw
  modified_base (298)..(298): a, c, t, g, unknown or other
  misc_feature (298)..(298): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccacctgtctttgtcgtccgggggaacagccaccctctcttgcagggccgcagactgtgacgacgacttagcctggtaccaacagaacgcctggccaggcctcccagacctcctcatctatgtatacttntaggtacggcctcgtggcctactccccaggcccctctttcgaggtcggcagggttcgggtcctagggaaccagtaccttcgaccttcctcaccatcccaaccgagccctaagacgtcctagtaagttattttgacttagttttaatttacgtacgttactaaccgtaaccggttaaagtaacgttcggtacccttaaccgtaaacttactttacctaaccgttttcccgggtacccgttacgggaacccgtaaaggttacggtaactaacgtaaccgtaaaacggtaacgttaggtacggtacctacgtacctacctacttcgttacgttcctttaccgtacttccctttacccccggtacccttacgttccgttaacg

SEQ ID NO: 165205 - DNA, 543 bp, Homo sapiens
  misc_feature: GYAE6OF01DA09H.44.73.G07.1.454.CMB.1.raw
  modified_base (410)..(410): a, c, t, g, unknown or other
  misc_feature (410)..(410): n is a, c, g, or t
  modified_base (423)..(423): a, c, t, g, unknown or other
  misc_feature (423)..(423): n is a, c, g, or t
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagaagcctgggtcctcggtgaaggtctcctgcacggcttctggaggcatcttcagaaactatcttatcaccgtgggtgcgacacggcccctggacaagggcttgagtggagtgggtgggctcgtccccaattttggacaagcaaactacgacacaagaattccgagggcagactcacgacttaccgcgacgaaatccacgagtgcacgcctatagtggagctgcgacaacctgagatctgaggacncggcctatattcngcgcgacaactaaattactacctacgttttgggcgtagtgatgtcttagtgattagttcgggaccgaagggactaaagtggtactaccgttcttacttcgaacgcccgtcctaaacccgg

SEQ ID NO: 165206 - DNA, 548 bp, Homo sapiens
  misc_feature: GYAE6OF01C21FV.44.73.G07.1.454.CMB.1.raw
  modified_base (224)..(224): a, c, t, g, unknown or other
  misc_feature (224)..(224): n is a, c, g, or t
  modified_base (236)..(236): a, c, t, g, unknown or other
  misc_feature (236)..(236): n is a, c, g, or t
  modified_base (384)..(384): a, c, t, g, unknown or other
  misc_feature (384)..(384): n is a, c, g, or t
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagaagcctgggtcctcggtgaaggtctcctgcacggcttctggagcatcttcagaaactntctatcactggncgacagccctggacaagggcttgagtggatgggtggctcgtccccatttggactaagcaaactcgcacagaacttcagggcacgactcacgattaccgcggacgaatccacgagtgcagcctatacgtggagcgtgcgacacctgagntctgaggacacgctatcttctgcgcgacgaactaaactttactaccgttacgttttggggacgtagttagtacgtgtacgttatagtagttagttcggggaccgtaagggaccgtaagtcggttacgaccgttacgttacttgaccgtccgtaccgtaacccgg

SEQ ID NO: 165207 - DNA, 628 bp, Homo sapiens
  misc_feature: GYAE6OF01BEY5B.44.73.G07.1.454.CMB.1.raw
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccgggggaacgagccaccctctcttgcagggccggccagactgttgacgacgacttagcctggtaccaacagaaacctggccaggctcccgaggcctcctcatctatgatgcatccaacgaggtcactggaccacccagacaggttcaggtgcgtaggtcgggtcgtgggactagtacttcactctaccgaccgtcacgtacaatcggtacagcctagtaagttatttacgacttaagttttatacgtgtacagtctacgtcgttccctccgacggtccgtctccgttacggtttccggggaccggggggtaaccgaaggggtggaagtagtacgaacggtaaccggaacgttggtcggtcgtacggccctaacgtcgttaccgttcgttacccttacgttaaccgttcccccgtttaccccggcccttacgttcgttaacgg

SEQ ID NO: 165208 - DNA, 783 bp, Homo sapiens
  misc_feature: GYAE6OF01CBCUA.44.73.G07.1.454.CMB.1.raw
  modified_base (211)..(211): a, c, t, g, unknown or other
  misc_feature (211)..(211): n is a, c, g, or t
  modified_base (266)..(266): a, c, t, g, unknown or other
  misc_feature (266)..(266): n is a, c, g, or t
  modified_base (364)..(364): a, c, t, g, unknown or other
  misc_feature (364)..(364): n is a, c, g, or t
  modified_base (471)..(471): a, c, t, g, unknown or other
  misc_feature (471)..(471): n is a, c, g, or t
tcagacagtatatacacgaccggtgctcgatttagctctacgctcagggggaggaactgctcagttaggacccagagggaaccatggaagccccagctcagcttctcttcctcctgctactctggctccagattccaccggcgaaattgtgttgacacaatctccagcccaccctgtctttgtccgtccgggggaacgacgcccacccttntcgttgcgagggccggcaggactgttgacgacgtacttagccgtaggtaaccaanacggagccgtggaccaggccctacccgagtacctcctacacttctaatgacttacttcgtaggtacggccttcgtcggactaccgtcccagccccgtnttacgaggtcggacgtaggtgggtccgtagggactaggtaccttccgactcctaccgaactactacccacccgtagacccgttagaccgtccgtaggtaaacgtttnttttcggactttaaggttttaacttaccgttacgttaacctaacggtaaccggtaagtaaccggtccgtacccttagtaaactactttacccgtaccggtttacccggtacccggttaacgggtaaaccgttaagggttaaccggtaattaaacccgttaccgtaaaaaaccggtaacggttttccgggaaccggtaggttacccggtaacccgtaacccgtttaaacgttcccggttttaacggtttacccttacccgtacccggtttttacccggttaccccccttaccgtaacgtttcccgttaaaagg

SEQ ID NO: 165209 - DNA, 569 bp, Homo sapiens
  misc_feature: GYAE6OF01BLA09.44.73.G07.1.454.CMB.1.raw
  modified_base (339)..(339): a, c, t, g, unknown or other
  misc_feature (339)..(339): n is a, c, g, or t
  modified_base (554)..(554): a, c, t, g, unknown or other
  misc_feature (554)..(554): n is a, c, g, or t
tcagacagtatatacacgaccggtgctcgatttagctctacgctcaggggccctgggagcacagctcatcaccatgcactggacctggaggttcctctttgtggtggcagcaactacaggtgtccagtcccaggtgcgtctggtgcaatctggggctgaaatgaagaagcctgggtcctcggtgaaggtctcctgcacggcttcgtggaggcatcttcagaaactatcttatcaccgtgggtgacgacacggcccctggacgaagggcttgagtggagtggggtggctccgtccctaagtttggacaagcaaactacgacacagaattcgaggcagacncacgacttaccgcggacgaactccgacgagtgcacgcctatatgggagcgtcgcgacaactgagtatcgtaggacggaccaccggacccttattacgtttctgcgacgaacgaactaaactttactaccgttacgttttacgggacggtagtgtatggtcttagtgtagttaggttcggacgtaaggactagtcggtaccgtcgttcctattacnccgtccctaacccgg

SEQ ID NO: 165210 - DNA, 529 bp, Homo sapiens
  misc_feature: GYAE6OF01ETWFS.44.73.G07.1.454.CMB.1.raw
  modified_base (354)..(354): a, c, t, g, unknown or other
  misc_feature (354)..(354): n is a, c, g, or t
  modified_base (521)..(521): a, c, t, g, unknown or other
  misc_feature (521)..(521): n is a, c, g, or t
  modified_base (525)..(525): a, c, t, g, unknown or other
  misc_feature (525)..(525): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccgggggaacagccaccctctcttgcagggccgcagactgtgacgacgacttagcctggtaccaacagaagcctggccaggcctcccgaggcctcctcatctatggaacatcccaccgagggccacgtggtactccccaccaggttcagtggcaggtcgggtccggganagtacgttcactctcacatcagcgcctgcagtctgagtatttgctagtttattactgtcagtctagtataataacgtcgtcctctctacgttcgggacggggacagggtggagtatacgaacgtactgtgctgaccacagtctgtcttcactcctccctctactctntatntacg

SEQ ID NO: 165211 - DNA, 725 bp, Homo sapiens
  misc_feature: GYAE6OF01C2Q89.44.73.G07.1.454.CMB.1.raw
  modified_base (209)..(209): a, c, t, g, unknown or other
  misc_feature (209)..(209): n is a, c, g, or t
  modified_base (232)..(232): a, c, t, g, unknown or other
  misc_feature (232)..(232): n is a, c, g, or t
  modified_base (247)..(247): a, c, t, g, unknown or other
  misc_feature (247)..(247): n is a, c, g, or t
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatcgtggggctgaaatgaagaagccgtgggtcctcggtgaaggtgtcctgcacggtcttcgnggagcattcgttcaagtaaactntcttatcacgtgggnccgccgacggcccctggaacgaagggcttgagtggagtgggtagaatcacttcccttgttttcgctccactccaacctcgcacgtacgtccgttccgggacaagtaacttacgaacgttaccggacggaacctaaacggtccaacgaacgaaccacgtacgtcctaccagtacgaaacaattcggtaattttacgttaacgaaaacgttccccggaaacgacccgtaccgggtcctttaacctaacgtacgtcggtacggaccggtaacgggtacccgttaccccgaacccccctaggtccctagacccgtaaggttcgggtaccgttccgtttaacgggaggtccggttacggggtacccggggggacctacccgggggtaacccgttggtaccgtatttccggaccctaacccgttcgacccgttccccgttaacccgaacccgggtaaccggccccgtttaacggtccccccggg

SEQ ID NO: 165212 - DNA, 557 bp, Homo sapiens
  misc_feature: GYAE6OF01DP4YS.44.73.G07.1.454.CMB.1.raw
  modified_base (392)..(392): a, c, t, g, unknown or other
  misc_feature (392)..(392): n is a, c, g, or t
  modified_base (535)..(535): a, c, t, g, unknown or other
  misc_feature (535)..(535): n is a, c, g, or t
tcagacagtatatacacgaccggtgctcgatttagctctacgctcagggggatcaggactcctcagttcaccttctcacaatgaggctccctgctcagctcctggggctgctaatgctctgggtctcagggtccagtggagatattataatgactcagtctcccctctccctggcccgtcacccctggagacgccggcctccatcctcctgtaggtctagtgagtagtcgttggaggtcagaacatctatgtggactggtacttgacagaacgaccgggcagtcctccacaactcctgactcttagtttcgggtccacgtccgggtcccgtccggggtctctgactggttcagtcgccgagtgcatcacacacagtacttcacactgacacntacagcagagtggagctgacgtgttggttgggtcttagttctgctaactccgtaacgttacctaacccgtaaccccgttcgtacccgttcgggacgaacgggacaccgtagtacggtaagtaagttaacggacgtaacgtggnggtctagaccacagttcgttcg

SEQ ID NO: 165213 - DNA, 771 bp, Homo sapiens
  misc_feature: GYAE6OF01BZHD6.44.73.G07.1.454.CMB.1.raw
  modified_base (359)..(359): a, c, t, g, unknown or other
  misc_feature (359)..(359): n is a, c, g, or t
tcagacagtatatacacgaccggtgctcgatttagctctacgctcagggggaggaactgctcagttaggacccagagggaaccatggaagccccagctcagcttctccttcctcctgctactctggctcccagacttccaccggcaaattgtgttgacacaatctccagccacctgtcttgtccgtaccggggaacgacgccacctctcttgcgacgggccgacagactgtagacgacgtacttacgcctaggtaccaagagaacgccgtggccgaaggccctacccgacgaccttcctcactctatcgtaattacttacgtaggtacggccttcgtcggccactcccgagtccccgtntcgaggtcggaccgtaggtcgggttcagggtacacgtacttcgactccgtaccaactctaccaaccgtacggtaccctaaggtaccgaccgttaaggtaacgtttacgtttcgaacgtttacgtttttaaacgtttccgtaacgttacccgttaaacgtaaaccggtaaaggtaaccggttcggtaacccttaaccgttaaacgttacgtttacccgttaacccgttttcccgggaacccgtttaacggggaaaaccttaaacgggttacggtaacttaacgttaaaccgaaaaccggttacgtacggttacggtacccgtaacgcccgtaaacttccgttacgtttaccgtcccttttaacccgaacccgttttcccccgtttacccaaccgttacccgtttcggttaaac

SEQ ID NO: 165214 - DNA, 641 bp, Homo sapiens
  misc_feature: GYAE6OF01EUUY9.44.73.G07.1.454.CMB.1.raw
  modified_base (196)..(196): a, c, t, g, unknown or other
  misc_feature (196)..(196): n is a, c, g, or t
  modified_base (335)..(335): a, c, t, g, unknown or other
  misc_feature (335)..(335): n is a, c, g, or t
  modified_base (391)..(391): a, c, t, g, unknown or other
  misc_feature (391)..(391): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccgggggaacngccaccctctcttgcagggccgccagactgttgacgacgacttagcctggtaccaacagaacgcctggccaggcctcccagacctcctcatctatgatactttctaggtacgggcctcgtggcactccccgagccccgntttcgagtcggctaggtcgggtctgggacagtaccttcgactctcaccatccaccngcctaaggactcctagaagtatttgacttagtttacttactacgtacttaaccgtaaccgtaaggtaacgttcggtacccttacctaatttaccttacctaccgtttcccggacccgttacgggaaccctaaaggttcggaacttaacgtaacgaaacggtacgttacggtacggtccttacgcctaccgtacttccgttacgttcccttaccgtactttccccgttaccccgtaccgtacgttcctacg

SEQ ID NO: 165215 - DNA, 560 bp, Homo sapiens
  misc_feature: GYAE6OF01EZU5S.44.73.G07.1.454.CMB.1.raw
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagaagcctggggtcctcggtgaaggtctcctgcacggcttctgggaggcattcttcaagaaactatcttatcacctgggtgcgacacggcccctggacaagggcttgagtggatggggtgggctcgtcccctaattttggacaagcaaactacgcacagaaattccagggcagactcacgattaccgcggacgaatccacgagtgcagcctatatggagctgcgccaacctgagatcgtagacggacaccggccctatactttctgcgcgacgaactaaaatttactacctacgtttttcgggacggtagttgtactgtcttatgtagttagtttggggacgtaagggactaagttggtactaccggttcttacttacacgtcctccgtaacccgg

SEQ ID NO: 165216 - DNA, 556 bp, Homo sapiens
  misc_feature: GYAE6OF01C65KY.44.73.G07.1.454.CMB.1.raw
  modified_base (331)..(331): a, c, t, g, unknown or other
  misc_feature (331)..(331): n is a, c, g, or t
  modified_base (551)..(551): a, c, t, g, unknown or other
  misc_feature (551)..(551): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccgggggaacagccaccctctctgcagggccgccagactgttgacgacgacttagcctggtaccaacagaagccgtggccaggctcccagacctcctcatctatgatacttcgtaggtacggcctctggccactcccagccccgtntttacaggtcggactaggtgggtctggggacaggtacttccgacttctcaccatccacacgtcctagacgcctagaagtatttgactagttattactgtactactacgtaagagtcggcctacctaattacttctacgtttccggcccgtacgggaacctaaagtgaatacactaaacgactgtcgctcgacactatctgtctactacttcctccgcctntctag

SEQ ID NO: 165217 - DNA, 701 bp, Homo sapiens
  misc_feature: GYAE6OF01C9A7J.44.73.G07.1.454.CMB.1.raw
tcagacagtatatacacgaccggtgctcgatttagctctacgctcagggggaggaactgctcagttaggacccagagggaaccatggaagccccagctcagcttctcttcctcctgctactctggctcccagacttccaccggcgtaaattgtgttgacacaatctccagccaccctgtctttcgtccgtaccgggggaacacgcccaccctctcttcgcgacgggccgccagacttgtcgacgacgtacgttacgccgtacggtaaccaaacgacggaaacgccgtcggcccgagggcccttacccgaacgtaccttccctactacttcctatcgaacttacttacgtaggtacggtcccttcgtcggaccacgtcccgaacggtcccgtcttccgaagggtcgacgtagggttcgggtccgtagggaccagtaccttcctaactccgtaccaaccttacaccgaacccacggtacctaacggacggttaccctaaggtaacgtttagttttacgactttaacgttttactacgttacgttaacctaacgtaaccggtaagacgtccggcctaactaacttactcctaccggttcgtacccgtaggtaaccgtaagtcgaacttacaacgtaaacgtgtgtacgtactcggactaccattcgtcgtttacaccgtcttccccacctacgtccttcgttag

SEQ ID NO: 165218 - DNA, 640 bp, Homo sapiens
  misc_feature: GYAE6OF01DJ2YT.44.73.G07.1.454.CMB.1.raw
  modified_base (251)..(251): a, c, t, g, unknown or other
  misc_feature (251)..(251): n is a, c, g, or t
  modified_base (623)..(623): a, c, t, g, unknown or other
  misc_feature (623)..(623): n is a, c, g, or t
  modified_base (628)..(628): a, c, t, g, unknown or other
  misc_feature (628)..(628): n is a, c, g, or t
tcagacagtatatacacgaccggtgctcgatttagctctacgctcagggggatcaggactcctcagttcaccttctcacaatgaggctccctgctcagctcctggggctgctaatgctctgggtctcgagggtccagtggagatattataatgactcagtcctcccctctcccgtggcccgtccaccccgtggacgcggccggcctccatcctcctgtaggtctagtgagacgtcgttgggaggtcagacntctagtgtgactggtacttgacagaacgaccggctacgtcctccaacaactcctagacttacttaggttttcggggttccctaccggttccggggtcccgttcccgggggtctccgtagacgtggttccaggtcgaccgtagtcgactactaccgaccacacgtagtaactttacaccgtactcgacacacgtacgacgacgaaggtacggtagggaacggccgttagggaccggttaggtttcgggttacgggttacttacgttacgtcgtactacgttacccgtaaacgtttcccgtaaaccccgtaaccccgttccttaccggtacgggacgtaacggacctacgtacgtagagtaataggcgacgtgngtcancactgtcgttcg

SEQ ID NO: 165219 - DNA, 790 bp, Homo sapiens
  misc_feature: GYAE6OF01AGKV4.44.73.G07.1.454.CMB.1.raw
  modified_base (255)..(255): a, c, t, g, unknown or other
  misc_feature (255)..(255): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccgggggaacgagccaccctctcttgcagggccggccagactgttgacgacgacttagcctggtaccaanagaagcctggccaggcctcccagactcctcatctatgatacttcgtaggtacgggcctcgtggctacgtcccgagccccgtcttcgaggtggctaggtcgggtcgtgggacagtaccttcacctctccactactccaacccgacgtcccgtaaggacgtacccgttaggaaagttacgttttttaccggaccttttaacggtttttaacgtttacccgtttcggttaacccgttaaacccgaacccgggtttaaacggtaaacggttccggttaccccttaaccgtaaactttacccgtttaccgtttacccggttttaccccgggtacccccggttaacgggggaaaccccttaaaggggtacggttaaacttaaaccgttaacccgaaaaacccgggttaacttacggggtaccggttaccgttaccggaaccccttaacccgttacggttcccgtttacggtttacccgtttacccgtaaccggttttcccccctttaccccccgggcctttaaccgttcccgggttaaacg

SEQ ID NO: 165220 - DNA, 743 bp, Homo sapiens
  misc_feature: GYAE6OF01EIS1D.44.73.G07.1.454.CMB.1.raw
  modified_base (350)..(350): a, c, t, g, unknown or other
  misc_feature (350)..(350): n is a, c, g, or t
tcagacagtatatacacgaccggtgctcgatttagctctacgctcagggggatcaggactcctcagttcaccttctcacaatgaggctccctgctcagctcctggggctgctaatgctctgggtctcagggtccagtggagatattataatgactcagtccctccctctccgtcggcccgtccacccgtggacgcggcccgcctcactcctcgtgtagtctaggtgagtagtcgttagggacggtacaagaactattctagttggtagtacgttggttacttgacgaaggaacggaccgggctacgtcctaccactaaccttccgtgtacttcgttaggtttcggtaccncggtccggtccgtcgggtctgacgacgtcggttcaggtcgaccgtagtcgactacgtccaactaacacgtaagtttaccttacaacgtaccgttcaaccaacttacgacgaacgggtacgtaaagggtacgggtacgggtacggtaccgtttaaggggaacggtttaggtttccgggggtttaacggttactttaacggtttaccgtgtaacccgtacgtttaacccgttaaacggtttaccccttaaacccccgttaaacccccggtttcgtaacccgggttaccggggaaaccgtaaacggggtaaccctaccggttaaagttacggaaacgtttaaggttaacggcggttaacgtgggtaccgtctacgacccgtacttagtcgttaccg

SEQ ID NO: 165221 - DNA, 611 bp, Homo sapiens
  misc_feature: GYAE6OF01ANL2T.44.73.G07.1.454.CMB.1.raw
  modified_base (193)..(193): a, c, t, g, unknown or other
  misc_feature (193)..(193): n is a, c, g, or t
  modified_base (292)..(292): a, c, t, g, unknown or other
  misc_feature (292)..(292): n is a, c, g, or t
tcagacagtatatacacgaccggtgctcgatttagctctacgctcaggggggaactgctcagttaggacccagagggaaccatggaagccccagctcagcttctcttcctcctgctactctggctcccagattccaccggcgaaattgtgttgacgcagtctccaggcaccctgtctttgtctccaggggaanagccaccctctcctgcagggccagtcagagtgttgacaccaccaccagcttcttagcctggtaccagcagaagcctggccaggcctcccaggcctcctnatatacgatgctatccacgacaacggcccgctgggccacgtccccaagtaccaggttcaggtcggcgaggtcgggtcgtggggacaggtacttcacttctcagcatcgaggcggactgggactcgtggtaggtactttcgtcgtcgtagttttacttacgtcgtacgtagtcgtaaggttagttcgggttcggttacctacccgtttacgtcggttaccgggttccggaccggtaaacggggtaacccgtaaggggttacggtaaacttaccggaaaacggttactggtacgtacgtacgacctaccgtgtcgttaccg

SEQ ID NO: 165222 - DNA, 777 bp, Homo sapiens
  misc_feature: GYAE6OF01CIY4J.44.73.G07.1.454.CMB.1.raw
  modified_base (227)..(227): a, c, t, g, unknown or other
  misc_feature (227)..(227): n is a, c, g, or t
  modified_base (238)..(238): a, c, t, g, unknown or other
  misc_feature (238)..(238): n is a, c, g, or t
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatcgtggggactagaaatgaagaacgccgtgggtcctggtagaaggttctcgtgcacggtcttcgtggaggcattcttanaagtaaacttnttcttatcctaccgtgggcgacgacgacggcccgtaggacgaagggtcgttaggaggtgggtagtggggtagggtccgtccgttaccccgttaagttttacggaacgaacgtacctaaaccgtacgaccgaaacgaagtaaacgttaccgaacgggaccaacggtaacctaccgaaccggtaaccgtttaacccggacggaaaccgtaacgtaccgaaggacgtcgacacgtacctagtagtcggagcgtcgaccgtaccgtaacgtgacgtattcgtacggaacggaaccgaccggtacccttaagtttacgttacgtacggacgtaacgtaaacgtaaaaccgtttaaaacgtttaccgttacccggtttaacggtttttaccggggacgttaagtcgttaagtcgtaaccgtttagtacggtaacgtttacgggttaacggggtaaccggtaaaggtacgttaacggttaccggtacccttaccggttacctttaccgttaaccgtacccgttaccccgtacccgtaaaccccggg

SEQ ID NO: 165223 - DNA, 588 bp, Homo sapiens
  misc_feature: GYAE6OF01AP5CB.44.73.G07.1.454.CMB.1.raw
  modified_base (465)..(465): a, c, t, g, unknown or other
  misc_feature (465)..(465): n is a, c, g, or t
  modified_base (473)..(473): a, c, t, g, unknown or other
  misc_feature (473)..(473): n is a, c, g, or t
tcagacagtatatacacgaccggtgctcgatttagctctacgctcaggggccctgggagcacagctcatcaccatggactggacctggaggttcctctttgtggtggcagcaactacaggtgtccagtccctggtgcaactggtgcagtctgggactagaatgccgcaaccttggtcctcggtcgaccctttcctgcacggcctctggaagtactaccagttccactacttataccatcaacgtgggtgcgccaggcccctggaccaagggcttgagtggatgggtggaatcactccccttcttttggcctcactccacctacgcacgacgaccgttccggggcagaacttacgacttaccgacggaacaagtcccaacgagacacagtctccatgacatgtagttcttagaactccgacgacgtacggcctactactactgtcgcgacgtacgtcccgtacccngcctcgcngtcggactccgtttagagtacgtcggcggggcacgggtacccgtggtaccgtgtttcgtacgcccttcgacgtacccttacccgaccgaccggcccctagttcccggttaccccg

SEQ ID NO: 165224 - DNA, 768 bp, Homo sapiens
  misc_feature: GYAE6OF01BCD98.44.73.G07.1.454.CMB.1.raw
  modified_base (242)..(242): a, c, t, g, unknown or other
  misc_feature (242)..(242): n is a, c, g, or t
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagaagcctgggtcctcggtgaaggtctcctgcacggtcttcgtggaggcatcttcagaaactatcttatcactgggtncgacacgccctggacaagggcttggagtggatggggtggctcgtccctaagttttcggacaacgcaaaactacgacaacgagaaaatccaagggcagactcaacgacgttaccgccggaacgaaatccgacgaaggtcgacaacggtccctaagtaagtaggaacgccttaggccgacgtaaaccttaggaacgtaacgtactacggaacggaaccgaccgggtacccttaacttaacgtttccgttagaccgtacggtaaacgtaaacgttaaaaaaaccttttacccgtaaccgtttaaccggtttttacggggtaaccggtaagggtttacgtaagttacggttaaccgtttaagttacggtaaagtttaacgggtttttacgggggaaaccccggttaaaacgggggaaacgtaaaaaccgggttaccggggttaaaccgttaaaccccgggtttacccgtttaacccgttttaacccgtacccggttaacccccgttacccccggtaaaaaccccccgggg

SEQ ID NO: 165225 - DNA, 1001 bp, Homo sapiens
  misc_feature: GYAE6OF01CIJIV.44.73.G07.1.454.CMB.1.raw
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaagtcgtggggctagaaatgaagaacgtccgtgggtcctcgggtagaacggtcctccgtggcgtacggtcttcgtgggacggctatcttacgaaagtaaaccttattcttaactaccgtaccggtggggtacgaccggaacgaccggtcccccgtagggaaaccggtaacgggtccgttagggaaggtgggtacggttcggggggttcgggtcccgttacccgggttacccccgtttaaaggtttttacgggaaactaaacggtacccaaaaaccgttaccggaacaaaccggtaaacgtaaaaccgtttacccggaaacgggaccaaacggtaccctaaccggtaaaccggttaacccggttaaacccgggaccggggtaaaaccgtaaacgttaccccggaacggtaacgggttacgaacccgtaacggttaacccgtttaaacggttaagggtacgggtaaaccgggtaccttacggtacccggaacccttaaacccggtgggtaaacgtaccgttacgggtaaccgggaacgggtaaccccgtaccgggtaccctttaaacgtttacggtttcccgacggtacccgggtaaacgtaaaacgttaaaaccccgtttaaaacgttttccccgtaaccgggttttaaccgggtttttacggggggaaccgtttaagggttacgttaacggtttaccgttaacggtttagttaacggttaagggttttaccgggttaaccggggaaccggttaaaagggtaaccgttaacgggttccccggttaacggttaccccgttaccgtttacccgttaccccgtaacccggttaaccccgtaccccgtaaacccccgggg

SEQ ID NO: 165226 - DNA, 740 bp, Homo sapiens
  misc_feature: GYAE6OF01D58JB.44.73.G07.1.454.CMB.1.raw
  modified_base (207)..(207): a, c, t, g, unknown or other
  misc_feature (207)..(207): n is a, c, g, or t
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatcgtggggctagaaatgaagaagcctgggtcctggtgaaggtctcctgcacggcttcgnggaggctatcttacaagtaaactatacttatcctaccgtgggtacgaccgacgacggtcccctggaacgaagggtcttaggaggtgggagtggggtggcctccgtaccccgtaagttttcggaactaacggactaaacgtacgacacaacgtaacttccgagggacagacctacgacgtacgtaccgacggaacgtaaacgtccgaacgtagtacgaccgaacgtacccgtaagtacgtagggacgtacgttacgaccgacctaaacccgttgaacgtagtacgtaggaacggaaccgaccggtacctattacgtttccgtcgtaccgacgtaagaaaccttaaaacgtttcccgtaaccgtttaacggttttacgggacggttaggttagtacgtacgttacgttaagttacgtaagttacgggtttacgggaaccggtaaagggtaaccgttaaacggtacgggttaaccctaacccggttcgttaacccgtttaccggaacccgtacccgtaaccccgtaaaccccgggg

SEQ ID NO: 165227 - DNA, 625 bp, Homo sapiens
  misc_feature: GYAE6OF01DOSSB.44.73.G07.1.454.CMB.1.raw
  modified_base (197)..(197): a, c, t, g, unknown or other
  misc_feature (197)..(197): n is a, c, g, or t
  modified_base (287)..(287): a, c, t, g, unknown or other
  misc_feature (287)..(287): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccactggagaaatagtgatgacgcagtctccagcccaccctgtctgtgtctcgaggggaaangcccaccctctcctgcagggccagtcagagtcgtaccagcaacttagcctggtaccaccagaaaccgtgggcaggcctcccaggctcctnactccgacggtgccactcccaaacgcgggccctacgtcgggccctcccgtgacgtaggttcaggtgcgtaggtgggtctggggactaggtaccttcgaccgttctccgacctagtccacgcgtaacggccgtagggaccgtaccgtaggtaaacgttacgttttggtagtagttagttacttacgttgttcctactttccgtagttccgttaccctttacgtaccgttaacgtttcggaccgtagggtaacctaacggtaacgaactacgaaacgtacttggtcgtacgtcgacctacgtctcgttacttaccttctacttccgttccgcctgttacg

SEQ ID NO: 165228 - DNA, 843 bp, Homo sapiens
  misc_feature: GYAE6OF01EV8DI.44.73.G07.1.454.CMB.1.raw
tcagacagtatatacacgaccggtgctcgatttagctctacgctcagggggatcaggactcctcagttcaccttctcacaatgaggcctccctgctcagctccgtggggctgctaatgctcgtgggtctcgagggtccaggtggagtattattataatgactctacgtcctcccctctcccgtcggcccgtccacccgtgggacgaccggcccggtcctccacttcctccgtggtaggtctaggtgagtagttcgtagggaggtacaagtaacttagtttagtggtaggtacgttaggttacgttcggacgaaggtaacggacccggggctacggttccctaccaactaacccttccgtagtactttaccgtttacggttttccgggttacccgtaccgggttcccggggtcccgtttaccgggggttccttacgtacggtaaccggttaggttaccggaggttccgacgttaacggtcgacctactaccaactacgaacgttaacgtactttaccaacgtccttacgaccaactacgtacgacgtacggtaagggtaggtacgggacggtacgtacggacggttaggttacgggtttggggttaacttacgtttaccgtacgaccttaaccgttaaccgttaaaccgttaccccgttaaaccccgttaaacccccggtttacggttaaccccgggttaacgggaaccgggtaaccgggtaacccgtacggtttaaaccgttaacggtaacggtttaaaccgtaacgggtacccgtaagggttccggtacggttaccctacgggtacccttaaccggttccgtttaccgtccgtttaaccccg

SEQ ID NO: 165229 - DNA, 775 bp, Homo sapiens
  misc_feature: GYAE6OF01CAW9B.44.73.G07.1.454.CMB.1.raw
  modified_base (231)..(231): a, c, t, g, unknown or other
  misc_feature (231)..(231): n is a, c, g, or t
  modified_base (238)..(238): a, c, t, g, unknown or other
  misc_feature (238)..(238): n is a, c, g, or t
  modified_base (688)..(688): a, c, t, g, unknown or other
  misc_feature (688)..(688): n is a, c, g, or t
  modified_base (748)..(748): a, c, t, g, unknown or other
  misc_feature (748)..(748): n is a, c, g, or t
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatcgtggggctgaaatgaagaagcgtgggtcctcggtagaggtctcctgcacggtcttcgtggaggctatcttacaagaaactnttcttanccgtaccgtgggtcgcgtacgacggtccctaggacgtaagggcttggaggtggagttcggggtaggtccgttacccgtcccctaagttttcggaacgaacgacaaaacctaccgacaacgtaagtaacttaccgaggtcaacgaccgtacgaccgtaacgttaacccggacggtaaccgaaacgttacccgaacggtaacgggtacgacgtaaccggtacccttaagaacggttacgggtaagtacccggttacgggtaccccgaaccgttaacccgtaacggtaacggtaacggttaccgtagggaaaccggtaacccggtaacccggggttacccctttaacgtttaacgttttacccggtacggtaccgtaacggtaaacggtaaaaccttaaaacgttttaccgtacccgttttaacggttttacggggacggtagttacgtagtnttacgttagtacgtattacgggttacggaacgtaagggactaaggtcgtacgtaccgttnttccttagacctcccgccgtaacccgg

SEQ ID NO: 165230 - DNA, 700 bp, Homo sapiens
  misc_feature: GYAE6OF01EA69N.44.73.G07.1.454.CMB.1.raw
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatcgtggggctgaaatgaagagcctgggtcctggtgaaggtctcctgcacggtcttcgtgggaggctattcttacaagtaaacttatcttactccaccgtgggtcgcgacgacggcccctggacgaagggtctggagtggagtgggtggctcgtccctagtttggacaacgacaactacgacacgaagtaacttccgaggcagactacacgtactaccggacggaacgaatacccgaacgtagtcgacgacgtaccgttaagtagtagggcgtcgttcggaccgacgtaacccgtagaagtaacgttcgtacggaacggaaccgtacccggtaccttaagtttacgtttcgtacgaccggtaacgaaacgtaaacttaaaacttttccgtaacccgtttaacggttttacggggaccggttaggttagtacgttggttactttagtaggttaacgtttagggtttacggggaaccggtaaagggtacgtaacggttaccggtccgttaccggttccttaccgttaccgacgtccccgtcccgtaaaccccggg

SEQ ID NO: 165231 - DNA, 743 bp, Homo sapiens
  misc_feature: GYAE6OF01DAK8H.44.73.G07.1.454.CMB.1.raw
tcagacagtatatacacgaccggtgctcgatttagctctacgctcagggggggaactgctcagttaggacccagagggaaccatggaagccccagctcagcttctcttcctcctgctactctggctcccagattccaccggcgaaattgtgttgacacaatctccagccaccctgtctttgtccgtccgggggaacagccaccctctcttgcgacgggccggcagactgttcgacgacgacttagcctaggtaaccaacaggaacgccgtcggaccaggcctcccgagacctcctcatctatagtattaccttgtaacggtacggggtccctcgtggccacgtccccgacgcccgtcttcgaggtcggacgtaggtcgggtcgtagggactacggtaccttccgacttctacacctactacccaccgtacgccgtaacgacgtacccgtaggtaaagttcgtttacgtactttacgtttaactttacgttagttaaccttaaccgtaaccggttaaacgtaacggttaccgggtacccttaaccgttaaacgtttaacgttaccgtttaccgtttacccgggtaacccggttacgggtaaacccgtaaagggttacggtaagttaaccgtaacgtaaaccggtaaacgttcggtacggtacgttacgacccgtaaccgtaacgttccgttcgttacccgtttacctacgttccccgttacccgacccttactccgttagtaac

SEQ ID NO: 165232 - DNA, 628 bp, Homo sapiens
  misc_feature: GYAE6OF01BFWU4.44.73.G07.1.454.CMB.1.raw
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatcgtggggctagaaatgaagagccgtgggtcctcggtgaaggtctccgtgcacggcttcgtggaggcattcttacaagtaaacttatcttatccgaccgtgggtcgacgacgacggccccgtaggacgaagggtcttggaggtggagtgggtggctccgtccctagttcgacagcaactcgcacagtaactcgaggcagacctcgacgtacgtacgcgaacgactcgacgagtcgacgacgtcctagtacgtggatcgtagccgactaacgtgacgacgtcgtaggacggaaccgtaccgtacccttagttacttcgtcgacgtacgtaagaaacttaaacttccgtaccgttacgtttaggggtacggtagtagtacgtagtcgtagttagtagttacgttacgggaccggtaagtacggttaacgtcggttacctacccgttcaccgtttacgaccgtcccgtaaccgtaaccccggg

SEQ ID NO: 165233 - DNA, 659 bp, Homo sapiens
  misc_feature: GYAE6OF01AYNTS.44.73.G07.1.454.CMB.1.raw
  modified_base (202)..(202): a, c, t, g, unknown or other
  misc_feature (202)..(202): n is a, c, g, or t
  modified_base (423)..(423): a, c, t, g, unknown or other
  misc_feature (423)..(423): n is a, c, g, or t
tcagacagtatatacacgaccggtgctcgatttagctctacgctcagggggaggaactgctcagttaggacccagagggaaccgattggaagcccctagcttcagcttctcttcctcctgctactctggctcccagagtatcaccggagatatttgtgttgacactaagtctccaggcaccctgtcttgtctccgagggganagagccgacctctcctgtacggccaggtcggagtgttgctaagtacctagcctggtaccaacagaaacctggcctaggctccagcctctcatctatgatcgacacgtaccgaacgagggttccaacggtcggaccctaaccccgagaaccgtacggttcaaggtcggtactaggtagggtacctaggggaacaggtaccttcacttccgaccgaccgttanaacggactaagttcgtacacgtaccgtagaacgtagtttagacgttaagtttattacctgtactagtactagtaccgttcctaccgacggtccgtacgttacgtaccggtttccggggaccgggggtaccgtaaggggtacgtacggtacgtacgacggtaccgaacgttcggtacggccttacggacccgacgtcgttcgtcgttcctacgttaccgttcccgttcccgtacccg

SEQ ID NO: 165234 - DNA, 634 bp, Homo sapiens
  misc_feature: GYAE6OF01AU6AF.44.73.G07.1.454.CMB.1.raw
  modified_base (329)..(329): a, c, t, g, unknown or other
  misc_feature (329)..(329): n is a, c, g, or t
  modified_base (367)..(367): a, c, t, g, unknown or other
  misc_feature (367)..(367): n is a, c, g, or t
tcagacagtatatacacgaccggtgctcgatttagctctacgctcagggggaggaactgctcagttaggacccagagggaaccatggaagcccccagctcagcttctcttcctcctgctactctggctcccagattccaccggcgaaattgtgttgacacaatctccagcccaccctgtctttgtcctccgggggaacagccaccctctcttgcagggccgccagactgttgacgacgacttagcctggtaccaacagaagcctggccaggctccagactcttcatctatgatacttctagtacgggcctctggcatcccagtccccgnttcgagtggcaggtgggtctgggacagtacttcactcncaccatccaccagcctagacgcctgaagtattttgactaggtttattaacttgtacctaacgaccgttaaagaacgtcgtaccctacgtaattacttccgtaacgttttcccggacccgttacgggaacccgtaaaggttcgggaacttaacgtaccgaaaaaccggtactacgggttacggactcggaaccctacccgtaattcccttacggttacctttacccgtacgtttccccttacccccggccttaacgttcccgttaacg

SEQ ID NO: 165235 - DNA, 767 bp, Homo sapiens
  misc_feature: GYAE6OF01AKSNP.44.73.G07.1.454.CMB.1.raw
  modified_base (197)..(197): a, c, t, g, unknown or other
  misc_feature (197)..(197): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagcccaccctgttctttgtctccaggggganagagccaccctctcctgtaggccaggtcggagtgttgctaagtcctagcctggtaccaacacgaaacctggccaggcctcccaggctcctcatctatgatgcactccaacgagggtccacgtggaccctaccccgagaccgtacggttcgaggtcggccgtagggtggggtcctagggggaaccctagggtaccctttaccaacccgtttccgtacccgaaacccgggtttccaaaggtacctaaacgtttcgtaaccgaaccggtcccgttaagggaaacgtttaacgtttttcgtaaccgtttaagtttttaaccgtttacgtacgttaccgaagtccgtaccgggttccgtttaccccgtaccgaccgggttcccgtaccgtaccgttacccgggtttacccggggggaccgggggtaacctaaggggttccggaacgttaccgtaccggaaacgggtacccggtaacgttcgggtcggaccgtttacccggaccttaccgtaacgttcggtcccggtttaccttacccgtaccgtttcccccttacccgtcccgttaaccgttccg

SEQ ID NO: 165236 - DNA, 727 bp, Homo sapiens
  misc_feature: GYAE6OF01AOQB1.44.73.G07.1.454.CMB.1.raw
  modified_base (250)..(250): a, c, t, g, unknown or other
  misc_feature (250)..(250): n is a, c, g, or t
  modified_base (327)..(327): a, c, t, g, unknown or other
  misc_feature (327)..(327): n is a, c, g, or t
tcagacagtatatacacgaccggtgctcgatttagctctacgctcagggggaactgctcagttaggacccagagggaaccatggaagccccagctcagcttctcttcctcctgctactctggctcccagattccaccggcgaaattgtgttgacacaatctccagccaccctgtctttgtctccgggggaacagccaccctctcttgcagggccgccagactgttgacgacgacttagcctggtaccaanagacgcctggccaggcctcccagacctcctcatctatgatcttcgtaggtcggcctcgtggccacgtcccagcccgnttcgagtcggctaggtgggtctagggacaggtacctttcgaccttccgtaccacccgtattcccaaccgtacgaccctaacggacgacccgttaagtaaacgttacgttttcggacctttaaggttttacgttaactttacggttaaccttaaccggtaaaccggttaaacggtaacggttccgggtaccccttaacgtaactttaacgtttaccctaccggttttaccccgggtacccgttaacggggtaaacccgttaaacgggtacggttaaacgtttaaccgtaaaccggtaaaaccggtaaccgttacgggtacggtaccgtacggtaccctaaccgttacttccgttcgttaccttacgtaccgttcccttacccgacctactcttacggtaac

SEQ ID NO: 165237 - DNA, 713 bp, Homo sapiens
  misc_feature: GYAE6OF01ALW2D.44.73.G07.1.454.CMB.1.raw
  modified_base (301)..(301): a, c, t, g, unknown or other
  misc_feature (301)..(301): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtcgtccgggggaacagccaccctctcttgcagggccgccagactgtgacgacgacttagcctcggtaccaacagaacgccgtggccaggcctcccagacctcctcatctatgatacttntaggtacgggcctcgcggctacctccccacggtcccctcgttcgacggtcggcgtagggtcgggtccgtagggaacctacggtaccttccgtacctcctaccaaccctatcccaacccgagacccgttaggacgtacccgtaaggtaacgttagttttacgacgtttaggttttaactttacgttcgttaacctaaccgtaacccggttaaagtaccggttacggtacccttaacctaaacgtttacttaccgttaccggttttcccggacccgttacgggaacctaaagggttcgtaacttaacgtaaccgaaacgtacgttggtacggtaccgtacgtcccaaccgttacgtcccgttacgttacctttacctaccctttacccttaccccggtacctacgttcgttacg

SEQ ID NO: 165238 - DNA, 761 bp, Homo sapiens
  misc_feature: GYAE6OF01EU85M.44.73.G07.1.454.CMB.1.raw
tcagacagtatatacacgaccggtgctcgatttagctctacgctcagggggaggaactgctcagttaggacccagagggaaccatggaagccccagctcagcttctccttcctcctgctactctgcctccagattccaccggacgtaaattgtgttgacactaactctccagcccacctgttctttgtcgtccggggaacgacgccacctctctgcgacgggccgcagacgtgtagacgacgtacttacgccgtacggtaaccaacgagaacgtccgtacggaccacggcctacccgaagtacccttcctacgacttactaagttacgtaactttaccgtttacgttaacggttaccggggtcccttcggtacggtaccctaccgtacccccgaccgtccccgtctttacggagtcgggcgtagggttcgggttcgacggtactacgtaccgttctaccttcctaaccaccgtactacccgacccgtacgtaccctaagggaccgtaccgttaaggtaacgttttcgtttacgtacgttttaacgtttattaacgtggttaaccgagtacgtaagttaaatacgttacgtacccgttcgtaccccgttacgtacccgggaaccgtaacgggtaccaccgggttacgacggttaaagtaacgttaaacgacgttcggaccgtctacggaaccctacgtattccgttaccgttccttaaacccgttccgttacccctcccggtattacttccgagttaaaccg

SEQ ID NO: 165239 - DNA, 984 bp, Homo sapiens
  misc_feature: GYAE6OF01C63AD.44.73.G07.1.454.CMB.1.raw
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagaagccgtgggtcctggtgaacggttctccgtgcgacggtcttacgtgggacggctacttcctttacgaaagtaaaccttacttacctttaactcctaacccggttggggcggccggaaccgaccgggtcccccgtagggaaccggaacggggtcgttaggagggttggggagtgggggtcgggtccttccggttacccccgtttaaggttttacggaaccgaaaacgtaacctaaaaccgtaccggaaccaacgtaaacggtaaacgttacccggaacggggtacaacgtacctaaccgacggtaaccgttaccggaaccggtaaacgtaaaccgtccggtaacggaacggttcggaaccgtaaccgccgttttaaacgaaggttacgggacgtaccggttacggtaacccggtaaccgtaaacccggttagggaacggttacgttacccggttaacgggaacggggtaaccctaaccccggggttacctttaaacggttttccgttttaccggtacgggtaacccggtaaacggtaaaccggttaaaaaccgttttaaaaaccgtttttcccggttaaaccccggtttttaacgggggtttttttaccggggggaccgggtttaacgggttacgggttaacttccgggtttaacgtttaacggtttaacgggtaacgtttttagggggttaacccggggttaaacgggtaaaacggggttaacggttaaccggttaccgggttacccctttaacccgggtttcctttaaccctttaccggaaccccttccccgggtaaaccccgtaaacccccgggg

SEQ ID NO: 165240 - DNA, 791 bp, Homo sapiens
  misc_feature: GYAE6OF01BK6UA.44.73.G07.1.454.CMB.1.raw
tcagacagtatatacacgaccggtgctcgatttagctctacgctcagggggatcaggactcctcagttcaccttctcacaatgaggctccctgctcagctcctggggctgctaatgctctggggtctcaggggtccagtggagatattataatgactcagtctcccctctccctggcccgtcacccctgggagagccggcctccatctcctggtaggtctagtggagagtcttgggaggtcagaacatctatgtggactggtactgcagaagacgggcagtctccacaactcctgatctagttggtccacgtcgggcctccggggtctcgtgacgtaggttcaggttgcccgagttcggactacgtacaaccgtaacacgtaaggttacttttaccaaacctacgttacggaacctaaccctaacgttacccgaagggtacccgaaaggggtaaccgggtttaggggaaccgggggtaccttaacggggtaaaccgggttaagggttacgggggtttttacgggggggttaaccttttaaacgtttaaccgttaccgggacttaaaccgtttaacccgttaaaaccggttttacccttaaaacccccgttaaaacccccccgggttttaccgtaaccccgggttttacccgggggaacccggtaaaaacgggggtaccccaaacggttaacccgtttagggtaaaacggttaaacgttaaacggtacccggtaaacggtttcgggaccgggttacctaggaaccccgtaacccttagttcccggtttaccg

SEQ ID NO: 165241 - DNA, 763 bp, Homo sapiens
  misc_feature: GYAE6OF01B4DAH.44.73.G07.1.454.CMB.1.raw
  modified_base (303)..(303): a, c, t, g, unknown or other
  misc_feature (303)..(303): n is a, c, g, or t
  modified_base (311)..(311): a, c, t, g, unknown or other
  misc_feature (311)..(311): n is a, c, g, or t
tcagacagtatatacacgaccggtgctcgatttagctctacgctcagggggaggaacctgctcagttaggacccagagggaaccatgggaagccccagcgtcagcttctcttcctcctgctactctggctcccagattccaccggcgaaattcgtagttgactacaaatctaccagccaccctgtctttgtctccgggggaacagccaccctctcttgcaggccgccagactgttgacgacgacttagcctggtaccaacagaaacctggccaggctcccaggcctcctcatctatcggaacntaccaccngggccacgtggtactccccgaccgaggttccaggtcggtcgaggttcgggtccggacgtaggacgtttacacctctaccgacctatccgacggtccggcccttgcccgtaaggttccctagggtaacgggttactttttacggaccgtttacggttttaacgtttaacgttcggtttaccgaacggttacgtaaacggtttaactaaacgtttaaccgttaccggtacccttacccgttacccgttaacccggttttaccgggggacccggggggtaaccgtaacggggtacgggtaaccggtacgttaacccggtaaacgtaaccggttacggtacgggaccgttacggtacccgtaccgtacgttaccgttaccgttaccttacccgttacgttccccgttaccccggtcccttacgttaccgttagtacgttaacgttagttaacccgg

SEQ ID NO: 165242 - DNA, 841 bp, Homo sapiens
  misc_feature: GYAE6OF01EHW1G.44.73.G07.1.454.CMB.1.raw
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccgggggaacgagccaccctctcctgcagggccagtcagagtgttaccagcaacttagcctggtaccaccagaaacctgggcaggctcccagacctcctcattctagtagtacttacttcgtaggtacggtcctcgtcggctacctcccgacgtccccgtcttccgacggttcggacgtacgggttcggggttcgtacgggaacgtagtaccctttaccgaccttaccttacccgaccctaacttaccaacccgtacgtaaccccgttaaggaccgtcccggtaagtaaaggttttacgttttacggacgttttaaagttttactttaaccgtacgttaaccgttaaacccgttaaccgggttaaacgtaacgggtcccgtttaccccgttaactaaacgttttaaccttcccgtttaaccggttttaccccgggtacccccgggttaacggggtaaaccccgttaaaaggggttagggtttaaacccgttaaaccgtaaacccggtaaaacccggtaacgggttttaccgtacgggggacccttttaacccggaacccctttaaaccctacggttttaccccttaccgggtttacctttaacccgttacctttaccccccgtttaaccccgtaccgtttaacctttcggtaaacg

SEQ ID NO: 165243 - DNA, 781 bp, Homo sapiens
  misc_feature: GYAE6OF01DQ0FD.44.73.G07.1.454.CMB.1.raw
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccacctgtctttgtcgtccgggggaacacgccaccctctctgcgacgggccgccagactgttgacgacgacttacgccttaggtaaccaacgagaacgccgtggaccaggcctcccgagacctccctcactctatgattaccttcgtaaggtcggtcctcgtcggacctactcccgacgccccgtcttacgaggtcggacgtagggttcgggtcgtgggaacctagtacttcgaccttcaccacctactccaccacgtacctaggaccgtaccgtaggtaagttacgttttacgacgtttaacgtttttacgtttacgttacgttaaccgttaacccgtaaccgggttaaaggtaaccggttaccgggttacccttaaccgtttaaactttaccgtttacccgtttaacccggttttacccggggtaccccgttaaacggggttaaaccccgttaagggttacggttaacttaaacgttaaccgtaaaaccgtaaccgttacgggtcgtaccgtccggtaaccctaacccgtttacgttaccgttaccgtttcctttaacccgttacccttttacccccgttacccccgtacccttaccgttccgttaaacgg

SEQ ID NO: 165244 - DNA, 715 bp, Homo sapiens
  misc_feature: GYAE6OF01DIJ4Q.44.73.G07.1.454.CMB.1.raw
  modified_base (205)..(205): a, c, t, g, unknown or other
  misc_feature (205)..(205): n is a, c, g, or t
tcagacagtatatacacgaccggtgctcgatttagctctacgctcgacggggaggaacctggctccagttaggaccctagagggaacctatggaagccccagctcagcttctcttcctcctgctactctggctcccagattccaccggtcgtaaactttgtgttgactaacaatctcagccacctgtctgtgtctcgagggaagngcctacctctccgtgcgacggcagtcagtagtgttaccagctaacttacgcctacgtaccaccgaagtaaacctcggaccacggcctacccgacggtcctccgtcgtactctagtcgagtgctacgtcgtaagtcgggccgtcggtacactcccgaagtccgtagtcaggtacgacgtaggttcgggtctacggacgacgtaacggtaccttaccgtaccctccgtaccaacgtactaccgacggaccgtacctaacggacgtaccggtaattacgttttcgacttaagtttaactaccgtaacgtacctaaaccgtccggtacgaccggtaacggtccggtaaccgttaacggttacttacgggttttaccggaaccgggtaacggggtaacccaaggtacggtacgggacttaaccgtaaccgaaaacgttacgtggttacggtcttacggtacctaaccggtcgttaccgttcggttaacttacgacctttcccgtaccccggtacc

SEQ ID NO: 165245 - DNA, 686 bp, Homo sapiens
  misc_feature: GYAE6OF01EGQ5R.44.73.G07.1.454.CMB.1.raw
  modified_base (274)..(274): a, c, t, g, unknown or other
  misc_feature (274)..(274): n is a, c, g, or t
  modified_base (329)..(329): a, c, t, g, unknown or other
  misc_feature (329)..(329): n is a, c, g, or t
  modified_base (346)..(346): a, c, t, g, unknown or other
  misc_feature (346)..(346): n is a, c, g, or t
  modified_base (398)..(398): a, c, t, g, unknown or other
  misc_feature (398)..(398): n is a, c, g, or t
tcagacagtatatacacgaccggtgctcgatttagctctacgctcaggggggaactgctcagttaggacccagagggaaccatggaagccccagctcagcttctcttcctcctgctactctggctcccagattccaccggcgaaatttgtgttgacacaatctccagccaccctgtctttgtctccgggggacagccaccctctcttgcagggccgccagctgtgacgcacttgcctcggtaaccaacaggaacgccgtggccgaggcctcccncgtacctcctcatctatgtaactacttctaagggtcggccttgtcttcgactccnccgaccgtcgtctacgnggtcgcttgggggtctgggggaactacgactttcctacctcctaccgacccnctactaccaacccgaaccgtaccgtacgtacgtaccgtacgtaagttacgtttacgttacgttacgtttaacgtttaacttacgttacgaaaccgtaccgtaacgtaacgtacggtacccgtacctacttaacgttaccgttaccgttacccgttaccggtaccggtaaccgtaacgtaacggttacgtaactaacgtaaaccgtaacgtacggtacgtacgtacgtcctacctacgtcgttcgttcttaccttaccttaccttacccttcccgtaccgtacgttacg

SEQ ID NO: 165246 - DNA, 526 bp, Homo sapiens
  misc_feature: GYAE6OF01EMOYM.44.73.G07.1.454.CMB.1.raw
  modified_base (330)..(330): a, c, t, g, unknown or other
  misc_feature (330)..(330): n is a, c, g, or t
  modified_base (477)..(477): a, c, t, g, unknown or other
  misc_feature (477)..(477): n is a, c, g, or t
  modified_base (501)..(501): a, c, t, g, unknown or other
  misc_feature (501)..(501): n is a, c, g, or t
  modified_base (507)..(507): a, c, t, g, unknown or other
  misc_feature (507)..(507): n is a, c, g, or t
tcagacagtatatacacgaccggtgctcgatttagctctacgctcaggggggaactgctcagttaggacccagagggaaccatggaagccccagctcagcttctcttcctcctgctactctggctcccagattccaccggcgaaattgtgttgacacaatctccagccaccctgtctttgtcgtccgggggaacagccaccctctcttgcagggccgccagactgttgacgacgacttagcctaggtaccaacagaacgcctggcccaggcctcccagacctcctcatctatgatacttctagtacgggcctctggcactcccagcccgnttcagtggcaggtggtctgggacagtacttcacctctccacctatccaccagcctagacgcctagaagtattttgacttagtttattactgtactacaccgtaagagtcgcctacaatattcactttcgcctaggaccaagtgatanacaacgtactgtgctgcacatctntcttcnctcctcccgctatctgtac

SEQ ID NO: 165247 - DNA, 654 bp, Homo sapiens
  misc_feature: GYAE6OF01CENYM.44.73.G07.1.454.CMB.1.raw
  modified_base (324)..(324): a, c, t, g, unknown or other
  misc_feature (324)..(324): n is a, c, g, or t
  modified_base (377)..(377): a, c, t, g, unknown or other
  misc_feature (377)..(377): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccggggggaacagccaccctctctgcagggccggccagactgtgacgacgacttagcctggtaccaacagaagcctggccaggctcccagactcctcatctatgatacttctagtaggcctgtggcactccagccccgnttcaggtgcagtgggtctgggacagacttcactctcacatcgaccagcctagngcctgaatatttgctagtttattactgtactacgtaaccgtaaagtaagtcggacctaccaagttacttaccgtaccttttaccgggccccgttacgggaaacccctaaagggttaccggaagttaaccgtaacgtaaaaaccggtaaacgttacgggtacgggttaccgtacggtaccctaacccgtaacgttcccgtttacggtttcccttttaaccgttaaacctttcccctttaacccccccggtccccttaaagtttcccccgtttaaacgg

SEQ ID NO: 165248 - DNA, 626 bp, Homo sapiens
  misc_feature: GYAE6OF01AXG95.44.73.G07.1.454.CMB.1.raw
  modified_base (201)..(201): a, c, t, g, unknown or other
  misc_feature (201)..(201): n is a, c, g, or t
  modified_base (236)..(236): a, c, t, g, unknown or other
  misc_feature (236)..(236): n is a, c, g, or t
  modified_base (416)..(416): a, c, t, g, unknown or other
  misc_feature (416)..(416): n is a, c, g, or t
  modified_base (536)..(536): a, c, t, g, unknown or other
  misc_feature (536)..(536): n is a, c, g, or t
tcagacagtatatacacgaccggtgctcgatttagctctacgctcagggccctgggagcacagctcatcaccatggactggacctggaggttcctcttgtggtggcagcaactacaggtgtccagtcccaggtgcgtctggtgcaatcgtggggctagaatgaagaagcctgggtctcggtgacggtctctgcacgcttcnggagctatcttcagaactatcttatcacgtgggtncgacgacggtccctaggacgaagggtccttggtaggtacggtagtggggtggggtcctacggtaccccgtaagttttcggacgaagtcaaactacgcacaacgtaaattccgagggtacaggtactcgaacgtacgttacgccggtaacgaactccgagacgtcgactagacctagtacnggacgtctcgacgctaaccgtagtacgtactcgtaggtacggacgtaccggtaccgtacttacgttctcgtacgacgtacgaacgttaaaacttcttacgttacgtttacgggtaccggngttacgagttacgtcttagtagtagttagttgggaccgtaaggactagtacggtactaccgtctcgttacgacgtcctaccgtaacccgg

SEQ ID NO: 165249 - DNA, 716 bp, Homo sapiens
  misc_feature: GYAE6OF01BE5RQ.44.73.G07.1.454.CMB.1.raw
  modified_base (207)..(207): a, c, t, g, unknown or other
  misc_feature (207)..(207): n is a, c, g, or t
  modified_base (287)..(287): a, c, t, g, unknown or other
  misc_feature (287)..(287): n is a, c, g, or t
  modified_base (335)..(335): a, c, t, g, unknown or other
  misc_feature (335)..(335): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccaccggcgtaaattgtgttgacacaatctccagccaccctgtctttgtcgtccgggggaacagccaccctntcttgcagggccgcagactgttgacgacgacttagcctggtaccaacagacgcctggccaggcctcccgagacctcctanattctatgtattaccttctaggtacgggccttcgtggcctactccccnggccccgtctttcgacggtggaccgtagggttcgggtcctgggaacctagtaccctttcaccttcctaccaaccataccacccgagtccctaaggacgaccttaggaacgtttattttggactttaagttttaactttaccgttacggttacctaaaccgtaaccgggttaaagtaacgggttccggtaccccttacgtaaactttaccgttaccttaaccgtttccggggaccccgttaggggtaaaccctaaagggttcggtaaacttaacgtaacgaaaacgtaacgttggttaccggacttcggaaccctaacctacgttcgttacgttaccctttactaaccgtttccccgttaccccgtacctacgttcgtaacg

SEQ ID NO: 165250 - DNA, 696 bp, Homo sapiens
  misc_feature: GYAE6OF01DPFDV.44.73.G07.1.454.CMB.1.raw
  modified_base (198)..(198): a, c, t, g, unknown or other
  misc_feature (198)..(198): n is a, c, g, or t
  modified_base (251)..(251): a, c, t, g, unknown or other
  misc_feature (251)..(251): n is a, c, g, or t
  modified_base (283)..(283): a, c, t, g, unknown or other
  misc_feature (283)..(283): n is a, c, g, or t
tcagacagtatatacacgaccggtgctcgatttagctctacgctcagggggaggaactgctcagttaggacccagagggaaccatggaagccccagctcagcttctcttcctcctgcctactctggctcccagacttccaccggcgaaattgtgttgacacaatctcagccaccctgtctttgtcgtccgggggaacngccaccctctctgcagggccgcagctgtgacgacgacttagcctggtaccaanagaacgcctggccaggcctcccagacctcctnatctatgacttacttacgtaggtacgggcctcgtcggcactcccaggccccgtctttcgaggtcggctaggtcggtcgtgggacagtaccttcacctctccgacctactcacctagacccgttaggacgtccttaaggaagtttagttttcgacgtttaaaggtttttacttaacgtgttaacctaccgtaaccgttaaaggtaacggttcggtacccttactaaacgtttacttacccgttaacgttttcccgggacccgttacgggaaacccgtaaaggtacggttaacttaacgtaccgtaaaacggtaacttggtccggtacctacggtaacctacccttagtttacccttacgtttaccttacccgtacgtttaccccgttacccccgtctaacgtttcccgttaaag

SEQ ID NO: 165251 - DNA, 563 bp, Homo sapiens
  misc_feature: GYAE6OF01A3K73.44.73.G07.1.454.CMB.1.raw
  modified_base (338)..(338): a, c, t, g, unknown or other
  misc_feature (338)..(338): n is a, c, g, or t
  modified_base (554)..(554): a, c, t, g, unknown or other
  misc_feature (554)..(554): n is a, c, g, or t
  modified_base (557)..(557): a, c, t, g, unknown or other
  misc_feature (557)..(557): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtcgtccgggggaacgagccaccctctcttgcagggccggccagactgtgacgacgacttagcctggtaccaacagaacgcctggccaggctcccagtacctcctcatctatgattacttcgtaggtacgggtcctcgtggcactcccgagtccccncttcagtcggcaggtgggtcgtagggacacgtacttcactctcaaccactccacacgctagacgctagagtatttgacttagtttactactgtacctacgacgtaagagtcggtacctaccaattctactacgttccgaccgtacggaacctaagtagtatacgtacaaacgtacgtgtacgctacgctactactctcgtacttctactccttccnctntctacg

SEQ ID NO: 165252 - DNA, 696 bp, Homo sapiens
  misc_feature: GYAE6OF01BQ1UZ.44.73.G07.1.454.CMB.1.raw
  modified_base (265)..(265): a, c, t, g, unknown or other
  misc_feature (265)..(265): n is a, c, g, or t
  modified_base (477)..(477): a, c, t, g, unknown or other
  misc_feature (477)..(477): n is a, c, g, or t
  modified_base (495)..(495): a, c, t, g, unknown or other
  misc_feature (495)..(495): n is a, c, g, or t
  modified_base (507)..(508): a, c, t, g, unknown or other
  misc_feature (507)..(508): n is a, c, g, or t
  modified_base (515)..(515): a, c, t, g, unknown or other
  misc_feature (515)..(515): n is a, c, g, or t
  modified_base (568)..(568): a, c, t, g, unknown or other
  misc_feature (568)..(568): n is a, c, g, or t
tcagacagtatatacacgaccggtgctcgatttagctctacgctcagggggatcaggactcctcagttcaccttctcacaatgacggctccctgctcagctccgtggggctgctaatgctctgggtctcgagggtcagtggagtattaattataatcgactcacgtcctcccctctcccgtcgggccctccacccgtgggacgccgtcccgcctcactcctccgtgtaggtctaggtgagtagttcgttggacggtcaagaactntctagttcggtaggtacgttacgggtttactcggaacggaagggaaccggggtacccggggtactaaccggttccctaaccgaaaccttaacccttccgtagtaacttttacgtttaaccggtttttccgggtaaccctaccggttcccggggtcccggttccgggttcttcgtacggacgttacggtttcaaccggttcgacctagggtcnctaactcgaacacgtacngttactcactcnncagtacncacgcaggcggtaggagcgacgtaggtaggtttcgggtaggtaccttagttanacgtactactaaccgtacttaaccctacccgttaacccgttcgtaccgtacggaccgaaggtaccgacgttagtacgaagtacgtaacgcgtaagtccggtacacggtacaacctcgtattccgtacg

SEQ ID NO: 165253 - DNA, 656 bp, Homo sapiens
  misc_feature: GYAE6OF01E0YHH.44.73.G07.1.454.CMB.1.raw
  modified_base (275)..(275): a, c, t, g, unknown or other
  misc_feature (275)..(275): n is a, c, g, or t
  modified_base (281)..(281): a, c, t, g, unknown or other
  misc_feature (281)..(281): n is a, c, g, or t
  modified_base (292)..(292): a, c, t, g, unknown or other
  misc_feature (292)..(292): n is a, c, g, or t
  modified_base (647)..(647): a, c, t, g, unknown or other
  misc_feature (647)..(647): n is a, c, g, or t
tcagacagtatatacacgaccggtgctcgatttagctctacgctcagggggatcaggactcctcagttcaccttctcacaatgaggctccctgctcagctcctggggctgctaatgctctgggtctcagggtccaggtggagatattataatgactcagtctcccctctccctgaccgtcaccctggagacgccggcctccatcctccgtgtaggtctaggtgagtagtcgttggagtcagaacatctatgtggactggtactgacagagccggnacgtcnccacactccgngtatctagtttcggtccacgtccgggccgtccgggtctcgtgacgtagttcgacgtcgacctaggtcgtacacgtaccaacgtaacctaacgtacggtaattttacccaaccgtacgtcgtaccaactacgtacccaggaccgtaaaggttagggtacggggtaacgggtaccgtagggtacgtacgggtttcgggtttacgggttacttacgttacgtcgtacctaccgttaccgtaaacggttacccttaaacccttaaccccggttccgtacccggttacgggaacgtaacgggtctaccggtattcggaactaaggttacgacgtacgttggtcgtcgtacgcctaacctnttccgttcg

SEQ ID NO: 165254 - DNA, 862 bp, Homo sapiens
  misc_feature: GYAE6OF01CSIYD.44.73.G07.1.454.CMB.1.raw
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagaagccgtgggtctcggtgaaggtctccgtgcacggtcttcgtgggaggcatcttacaagtaaactatcttatccgtaccgtggggtcgccgacgacggtccccgtggaacgaagggtcttaggaggttagggtaggtgggggtcgggtccgtacccggttacccccgttaaagttttacgggaaccaaacggacctaaaacgtaccgacctaacgaagtaaacgttacccggacgggtacctaacggaccttaccgtaaaccggtaacgtttacccggaccggaaccggtaaacgtacccgaacggaaggtcggaccgaaccgtaccgttaaagttacggtacggtaacggtccgttacggaccggtaaccctaaacccggtacggtaacgtaacgttaccggtacgggtaaccgggaacccgtaacccgggtaaccctttaagtttaaccgtttccgtacggtaccggtaaccggtaaacgtaaaaccgttaaaaacttttaccgttaacccgttttaacggttttacggggacgttaggttacggttagttcggttaacgttaagttggttaaacggtttacgggttacggggtaaaccggtaacggggttaaacgtaacgggttaccgggttaaccgttacccggttaccgtttcccgtaaccgtacccgtcccgtaacccgtaaaccccggg

SEQ ID NO: 165255 - DNA, 862 bp, Homo sapiens
  misc_feature: GYAE6OF01B4B6Z.44.73.G07.1.454.CMB.1.raw
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatcgtggggctagaaatgaagagccgtgggtcctcggtgaaggtctccgtgcacggtcttcgtggaggctattcttacaagtaaaacttattaccttactcctaccggtggggtcgccgaacgacggtccccgttagggaacgaacggggtcctttaggaaggttgggtaaggttgggggttcgggtccgttacccggttacccccgttaaaggtttttacgggaaccaaacggtacctaaaaccgttaccgacgtaaaccgtaaggtaaaacctttcccggaacggggtaccgtaacggaacccgttaccgaaaccgggtaaccgtttaacccgggaaccgggtaaaccgtaaacgttaccccgaacgggtacggttacggaccgtaacggtacccttaaagtaacggtgggacgtcgtacggaccgtacaaaccggtgaacgtacgttacgtaggaacggtaaccgaccccggtacctttaacgttactttaccgacggtaccgtaacggtaaacgtaaaaccgtttaaaacgttttcccgttaaccgttttaacgggtttttcgggggtaaccggttacggttagttacggttcgttaaccgtttaggtagttaagtttacgggttaccggggaacggtaaagggtaacctagggttacgtacccgttaccgttcgttacttaccgtaccgtacccctccggtaaaccccgg

SEQ ID NO: 165256 - DNA, 771 bp, Homo sapiens
  misc_feature: GYAE6OF01C5C6R.44.73.G07.1.454.CMB.1.raw
  modified_base (306)..(306): a, c, t, g, unknown or other
  misc_feature (306)..(306): n is a, c, g, or t
  modified_base (494)..(494): a, c, t, g, unknown or other
  misc_feature (494)..(494): n is a, c, g, or t
tcagacagtatatacacgaccggtgctcgatttagctctacgctcagggggggaactgctcagttaggacccagagggaaccatggaagccccagctcagcttctcttcctcctgctactctggcctccagattccacggcgaaattgtgttgacacaatctccagccacctgttctttcgtcgtccgggggacgacgccaccctctctcgcgacgggccggccagtacgtgtagaccggtacgtacttagccgtaggtaccaacgagacgcctcgggcctacggcctacccacgtacctcctacnctactagtacggaaccactacccaccgacgggcccacggttcggtacctaccccaaccggtacgggtttaccgaggtcgggacggtaggggtccggggtaccgggacgtacgtacctttaccgacctaccgtacccgaaccgtcgaacgtacctaagtcgttaccggactacggttacgtaaagtttntttacggtagtttaacgttttaacgttacgttaggtactaggtacttaaggttaattaagtacgtaccgtcggtaccccgtttccgtaaccgggtaccggaaacgggtacctacgggtaacgtacgggtaaacggtaaccgttaaaacggcgttacgggtaccggacggtaaccggtaccctacggtacttacgttaccgtttcctacgtttacccttccccgttaccccggtaccttacgttacgtttacttaagttacttacgttccgttaccgg

SEQ ID NO: 165257 - DNA, 710 bp, Homo sapiens
  misc_feature: GYAE6OF01A4LBA.44.73.G07.1.454.CMB.1.raw
  modified_base (243)..(243): a, c, t, g, unknown or other
  misc_feature (243)..(243): n is a, c, g, or t
tcagacagtatatacacgaccggtgctcgatttagctctacgctcagggggatcaggactcctcagttcaccttctcacaatgaggctccctgctcagctcctggggctgctaatgctctgggtctcagggtccagtggagatattataatgactcagtcctcccctctccctggcccgtcacccctggagagccggcctccatcctcctgtaggtctagtgagagtcttggaggtcagaacntctatgtggactggtacttgcagaagaccggcagtctccacaactcctgatcttattcgggttaccacgtcgggcccgttcggggtactcgtcgaacgacggtttcaagtcgcctagtgacatcaacacacagtacttttccgaacacgttcgacaacacgttacaggcaagggtacggtagggaacggtacgtaggaacgtacggtttgggttcggggtttacttaaagtttaccgttagggtcctaaagttaaccccgttaaacggtttaacccgtttaaaccccggttaaaacccccgtttacccgtaaccccggtttaccggggtaaaccgtaaaacggggggtaccctaaaccggttaccggttaaggtaaaccggttaaagttaaacccggtacgtaaaaccgggtttcgggacgggttaacctacgggtacccaaacccgttcggttaccgtttacccgg

SEQ ID NO: 165258 - DNA, 841 bp, Homo sapiens
  misc_feature: GYAE6OF01D7FRB.44.73.G07.1.454.CMB.1.raw
  modified_base (209)..(209): a, c, t, g, unknown or other
  misc_feature (209)..(209): n is a, c, g, or t
tcagacagtatatacacgaccggtgctcgatttagctctacgctcaggggccctgggagcacagctcatcaccatggactggacctggaggttcctctttgtggtggcagcaactacaggtgtccagtccccaggtgcgtctggtgcaatctggggctgaaatgaagaagcctgggtcctcggtgaaggtcctcctagcacggtcttcngggaggcattccgttacaagtaaaccttatcctttaactccgaccgttgggtcgacgaccgacggtccccgtggaacgaacgggtcttaggtagtggagtcggggtacgggtccgtccggtacccccgtaagttttacggaacctaaagacccgtaaaaccgtaccggtaccaaccgtaagtaaaacgtttccccggaagggacctaacggaaccctttacgaaccggtaaccgtttacccggtaccggggaaaccgtaaccgttaccccgaacggtacggtacggacctaacggtaccccttaagttacggtacgggtacgtacgttcgaccgtaacctacccgtaggacgtacgttcgacggaacggaccgtacccggtaccccttaagtttacgtttaccgtacgtccggaaccggtaaacggtaaacctaaaaacgttttacccgtaacccgtttaaggttttaccgggggtacggttacggttaacgggtaacgttccggttaattacggttagtaaccggttaagggttttcggggaacccgtaaaggggtaaccttaacggttcccgggtaccttacccgtcctttacccgtaccgtaccgtcccctaccggtaaaccccccggg

SEQ ID NO: 165259 - DNA, 774 bp, Homo sapiens
  misc_feature: GYAE6OF01AJX1Q.44.73.G07.1.454.CMB.1.raw
  modified_base (208)..(208): a, c, t, g, unknown or other
  misc_feature (208)..(208): n is a, c, g, or t
tcagacagtatatacacgaccggtgctcgatttagctctacgctcaggggccctgggagcacagctcatcaccatggactggacctggaggttcctcttgtggtggcagcaactacaggtgtccagtcccaggtgcgtctggtgcatcgtgggctagaatgaagagtccgtgggtcctcggtgacggtctccgtgcgacggtcttcgngggtacgctatccttacgaagtaacttatccttatccgtaccgtggggtcaccgaccgtaccggcccctagggaacgtaacgggtccgttggaggttagggtaggtcggggtcgggaccgttaccggtacccccgttaaggttttcggaaaccgtaacgtaccgtaaaccgttacgacctaacgaacgtaaacgttaccggagggtaccgacgtaccgtaccgaacgtacgttaacccggacggaacgaacgtaccgacgtaagtcgacgtacgtaccgtagtacggtagggacgtaccgtcggacgaaccgtaacgtacggacgtaacgtcgtacggaacggtacccgaccggtacccttagttacgttccgtacggcgtaaccgtaacggtaaaccttaaaacgtttcccgttacggttacggtttacggggtacggttaggtacgtacgtacggttacttacgttaggtacgttaggttaccggggaacgtaagggtacgtaacgtacgggttacctacgttcccttacgtaccgaccgttaccccgtaccgtaaaccccggg

SEQ ID NO: 165260 - DNA, 726 bp, Homo sapiens
  misc_feature: GYAE6OF01C0Z9Y.44.73.G07.1.454.CMB.1.raw
tcagacagtatatacacgaccggtgctcgatttagctctacgctcagggggaggaactgctcagttaggacccagagggaaccatggaagccccagctcagcttctctcctcctgctactctggctccagattccaccggcgaaattgtgttgacacaatctccacgccacctgtctttgcgtccgggggaacgacgccacctctcttcgcacgggccgccagctgtgacgacgtactgcctggtaaccaacagacgcctaggaccacggcctcccgagacctcctacattcatgtactacttctacggtacggtacctcgtggaccactcccgagcccgtctttacgaggtcggctagggtcgggtctagggacacgtacttccgtactccgttacaacctatcccaacctacggtaccctaagggaactccgttaagtaagttacgttttacggaccgttaaggtttttaacccttacttagttaaccctaaccgaacggtttaaacgaacggtacggtaccccttaaccgtaagtttaccttaccgttaacgttttccccgggacccgttaacgggtaaaccgtaaagggtacggttaacgtttaaacgtaaccaaaaccgggttacggttaaccggtacgtacgttacgccctaacggtaactttccgttcggttcctttaccgttacctttccccgttaccgaaccctgtttacctaacgg

SEQ ID NO: 165261 - DNA, 579 bp, Homo sapiens
  misc_feature: GYAE6OF01BX45B.44.73.G07.1.454.CMB.1.raw
  modified_base (243)..(243): a, c, t, g, unknown or other
  misc_feature (243)..(243): n is a, c, g, or t
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagaagcctgggtcctcggtgaaggtctcctgcacggcttcgtggaggcatcttcagaaactatcttatcaccgtgggtncgacacggccctggacaagggcttgagtggatgggtgggctcgtccccaagttttggacaagcaaactacgcacagaacttccgagggcagactcacgattaaccgcgacgaactccgacgagtgacagcctatacgtggagcgtcgcgacaacctgagactcgtgacggacacggccctagttactttcgcgtcgacgaataactaaaactttcctaccgttacgttttgggacgtagtcgatgtacttagtagtattaggtttacggggaccgtaagggactaacgttcggtaccgtaccgttcctcgttacgcgtcccgtccgtaaccccggg

SEQ ID NO: 165262 - DNA, 809 bp, Homo sapiens
  misc_feature: GYAE6OF01DGUMH.44.73.G07.1.454.CMB.1.raw
  modified_base (309)..(309): a, c, t, g, unknown or other
  misc_feature (309)..(309): n is a, c, g, or t
tcagacagtatatacacgaccggtgctcgatttagctctacgctcagggggaggaactgctcagttaggaccagagggaaccatggaagccccagctcagcttctctcctcctgctactctggctcccagacttccaccggacgtaaattgtgttgacacaatctccacgccacctgtctttgtcggtccggggaacacgccaccctctctgcgacgggccgcgagtacgtggttcgacgtacgtacttacgccgtacggtaccaaacgagaacgccgtcggcctacggcctcccgacggtacctcctnacgttactacgtctaacttacgttaccgttggtacggtccttacggtccggactaccgtcccgacgcccgtcttacgcgggtcggtacgtacgggttcgggacggtacgggtaacgtcgtaaccttccgtaccctacgttacccaaccgtaccttacccgaacggaaccgtccgtaacggtacccgttacgttaaccgggtaattttaccgggttttagtaccgtttaaacgtttttacgttaacctttcggttaacctaaacccgtttaacgggtaacgttaaccgggttaccgtacccttaaactttacgttttaacccggtacttccgggtttaacccggggacccgttaacgggtaaacccgtagggttaccgtaaacttacgtttaaacgaaaccggtaccgtttggaccggtagtaccgcccttaaaccttggttaccctttacgtcgttaacccgttccctttacccggtacccgtacttacgttcgttaaac

SEQ ID NO: 165263 - DNA, 616 bp, Homo sapiens
  misc_feature: GYAE6OF01EJSQ7.44.73.G07.1.454.CMB.1.raw
  modified_base (360)..(360): a, c, t, g, unknown or other
  misc_feature (360)..(360): n is a, c, g, or t
  modified_base (377)..(377): a, c, t, g, unknown or other
  misc_feature (377)..(377): n is a, c, g, or t
  modified_base (389)..(389): a, c, t, g, unknown or other
  misc_feature (389)..(389): n is a, c, g, or t
  modified_base (408)..(408): a, c, t, g, unknown or other
  misc_feature (408)..(408): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtcgtccgggggaacgagcccaccctctcttgcgagggccggccagactgttgacgacgacttagcctggtaccaacagaagcctggccaggcctcccgagacctcctcatctatgtatacttctaggtagggtccctgtggccactcccacgcccctcttcaggtggcaggtgggtcngggacagtactcactcncaccatcaaccngcctagacgtcctgaattntttgacttaagttttatactgttacgatactaagttataatggtacctcgggtccctttcccgtcggaaccgtaacgggacgaacgtacgtaggaagtaacttaaaacggacttggtacggctacgtaccaacccgttagttccgttacgttcccgttaccttacccgtttccccttccccgaaccctacttttaccgtagttaaacc

SEQ ID NO: 165264 - DNA, 709 bp, Homo sapiens
  misc_feature: GYAE6OF01DCI78.44.73.G07.1.454.CMB.1.raw
  modified_base (207)..(207): a, c, t, g, unknown or other
  misc_feature (207)..(207): n is a, c, g, or t
  modified_base (229)..(229): a, c, t, g, unknown or other
  misc_feature (229)..(229): n is a, c, g, or t
  modified_base (244)..(244): a, c, t, g, unknown or other
  misc_feature (244)..(244): n is a, c, g, or t
  modified_base (249)..(249): a, c, t, g, unknown or other
  misc_feature (249)..(249): n is a, c, g, or t
tcagacagtatatacacgaccggtgctcgatttagctctacgctcaggggccctgggagcacagctcatcaccatggactggacctggaggttcctctttgtggtggcagcaactacaggtcgtccagtcccaggtgcgtctgggtgcaatcgtggggctgaaatgaagagcctgggtcctggtgaagtctctgccacggtcttcgnggagcattcttacaagtaactntcttatcacgtggancgacncggtcccgtggacgagggtcttagaggtaggagtgggtacggcgttacccgtaccccttaagtttacggacgaacgaaccgtaaacgtacgacaagtaacgtaaacgttaccgaagggacctaacgaccgtacgtacgaaccgttacggaacggaaacgtaactaccgaaggtacgtacaccgtaacgtaccgttaataacgtagggacgtccgtacggtaccgaacctaccgttaggaacgtactacggtacggaacggaccgacccggtacttacgttacttcgacgacgtacgaaagtaaaccttaaacgtttacctaccgtttaggtttacgggaggttacgtagttagttacgttatttacgtagttacggtaggttcgggaacgtaagggtaacttacggtaccggttactacgttacccgttacgtacgtacccgtcccgtaccgtaacccgg

SEQ ID NO: 165265 - DNA, 638 bp, Homo sapiens
  misc_feature: GYAE6OF01AL7OH.44.73.G07.1.454.CMB.1.raw
  modified_base (227)..(227): a, c, t, g, unknown or other
  misc_feature (227)..(227): n is a, c, g, or t
  modified_base (242)..(242): a, c, t, g, unknown or other
  misc_feature (242)..(242): n is a, c, g, or t
tcagacagtatatacacgaccggtgctcgatttagctctacgctcaggggccctgggagcacagctcatcaccatggactggacctggaggttcctctttgtggtgggcagcaactacaggtgtccagtcccaggtgcgtctggtgcaatctggggctgaaatgaagagcctgggtcctggtgaaggtctcctgcacggtcttcgtggacggcatcttcagtaactntctatcacgtgggtncgacacggcccgtaggacgaagggcttgagtggagtgggtggctcgtcccctaatttcggacagcaactcgcacagaacttcgaggcacgactacgacgtacgttaccggcggaacgtaactccgacggagtggacacgtctagtacgtggacgcgtagcgacaacctgaagtctcgtggaacggaccgtaccggtacccttagtttacgtttcgtacggaccgtacgtaagtaaaccttaaaacgtttccgttaccgttacggttttacgggacgggttagttcgtagtcgtactttagtcgttaagttacgggtttacgggacccggtaaggggtactaggttcgtaaccgtaccgttccttcgtaccgccggttacccgtccgtaaccccggg

SEQ ID NO: 165266 - DNA, 656 bp, Homo sapiens
  misc_feature: GYAE6OF01A0H1Q.44.73.G07.1.454.CMB.1.raw
  modified_base (226)..(226): a, c, t, g, unknown or other
  misc_feature (226)..(226): n is a, c, g, or t
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagaagcctgggtcctcggtgaaggtctcctgcacggcttcgtggagcatcttcagtaaactntcttatctaccgtgggtgcgacacggccctggacgaagggcttgagtggagtgggtggctccgtaccctagtttggactaagcaaacgtacgcaacagaacttcgaggcacgactcgacgacgttacccggacgtacgaactaccacggagtcgaccagccctaatacgtggaacgtcgtcgtaccgactaacccgtgtacgtactactacggaacggaccgtaccgggacccttaagttactttcgacggtaccggtacggaacgtaaaacctaaaaacttttccgttaacccgtttacggtttttacggggacggttacggttacgtaagttcgtacgtttagtcggttaattacggtttacggggaccgtaagggtacgtaagttacggtcctaccgttctcgtacgacgtccctaccgtaacccgg

SEQ ID NO: 165267 - DNA, 731 bp, Homo sapiens
  misc_feature: GYAE6OF01EFUIQ.44.73.G07.1.454.CMB.1.raw
  modified_base (197)..(197): a, c, t, g, unknown or other
  misc_feature (197)..(197): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtcgtccggggaacgngccaccctctcttgcagggccggcagactgttgacgacgacttacgcctaggtaccaacagaacgcctggccaggcctacccagactcctacactctatgatactttcgtaggtagggccctacgtcggcactcccgagccccgtcttcgagtcggcaggtgggtctgggacagtaccttcacgtcctaccacctaactccgaaccacggacccttaacgacggtcccttaaggtaaacgttacgtttttacgacgtttaacggtttttaaactttaaccgttacgttacgtaacggtaccgttaagtttaaactaagtacggtaaccgttacgggtcccctttacccgggttacccgggacccgtaaacggggtacccgtaacccggtacggttaaacgggtaacgtaaacggttaaaaccggacgtttagggtaccgtaccgtacgtacccgtaaccgtctaaccggttcgttaccgtttacctaccgtttaccccgttaccccgtaccctaacgttaccgtacggttaaac

SEQ ID NO: 165268 - DNA, 902 bp, Homo sapiens
  misc_feature: GYAE6OF01C0I0P.44.73.G07.1.454.CMB.1.raw
  modified_base (97)..(97): a, c, t, g, unknown or other
  misc_feature (97)..(97): n is a, c, g, or t
tcagacagtatatacacgaccggtgctcgatttagctctacgctcaggggccctgggagcacagctcatcaccatggactggacctggaggttcctntttgtggtggcagcaactacaggtgtccagtcccaggtgcgtctggtgcaatcgtggggctagaaatgaaagaagccgtgggtcctcgggtagaacggttcctccgtgccgacggtcttcgagggacggctatccttacaaagtaaaaccttattcgttactaccgtaccggtggggtacgaccgaaaccgtccgggtcccccgtagggaaccggtaacggggtcgttaggtaaggtgggtagggttgggggtcgggtcccgttacccggtacccccgtttaaagttttacggggaaccaacgtaacccgtaaaactaccggaacaaactaacggtaaaacttacccggaagggaccaacgtacgtacgaaccggtacgttaacccggaccggtaaacgaaacgtacccgaacggtacggtacgacgaccgtaccgtaaagttaaggtacggtaacggtcgttaaccggccgtaaccgtaaacccggtacgggtaacgtacgtttaccggaacggaacgggtaacccggaacccggttacccttaacgtttacgttaccgtccggtaacgaaccggtaaacgttaaaaccttaaaaaccgttttacccgttaaccggttttaccggtttacggggtaaccggttaaggttcggttaacgttaccggtaagtttacgttaggttaaacgtttaacgggttaaccggggtaacgggtaaacggggtaacgttaaacgggttccgttacccggtaacccggttccttacgttacccgtaccggtccccgttacccggtaaaccccggg

SEQ ID NO: 165269 - DNA, 833 bp, Homo sapiens
  misc_feature: GYAE6OF01AIU09.44.73.G07.1.454.CMB.1.raw
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatcgtggggctagaaatgaagagccgtgggtcctcggtgaacggtctccgtgcacggtcttcgtggacggcacgttcttacaacgtaaacttattaccttaactccgtaaccggtgggttacggaccgaaccgtacccgggcccccgtacggggaacccggtaaggggtacgtttggacgggttgggtaggttcgggggtcggggtccgttccccggttacccccgtaaggtttttacgggaacgtaaaccgaccgaaaaccgttaccgaccaaccgaaacggtaaaaccgttaccggtaacgggaccgaaacggtaccgtaaccgaaccggtaaccgtttaacccggaccggggtaaacccggtaaaccctacccggtaacgggtaacgttaccggaccgtaacggtaccccgttaagttaacggtcggggaacgtcgtacggaccggtaccgaaccgttaggaacgtactccggtagtaaccggaccggttacccggacccttaagtttaccgttcgtacgtcgaaccgtaacgtaaaacctttaaaacctttaccgtaaccgtttacggtttacgggtacgtagtacgtcgttagtacgttagtagtcggttaggtacgggtaccgtaacggtactacggtcgtaccgttccgtcctactaccgacctcccgacggtacccgg

SEQ ID NO: 165270 - DNA, 713 bp, Homo sapiens
  misc_feature: GYAE6OF01DKRN3.44.73.G07.1.454.CMB.1.raw
  modified_base (663)..(663): a, c, t, g, unknown or other
  misc_feature (663)..(663): n is a, c, g, or t
tcagacagtatatacacgaccggtgctcgatttagctctacgctcagggggaggaactgctcagttaggacccagagggaaccatggaagccccagctcagcttctcttcctcctgctactctggctccagattccaccggcgaaattgtgttgacaacaatcctccacgccaccctgtctttgtcgtccgggggaacacgccaccctctcttgcacgggccgcagactgttgacgacgtacttagccgtaggtaccaacaggaacgcctaggcctaggcctcccgagtacctcctacatctatgtaacttcttcgtaagggtacggtacccttcgtcgggacctacctaccccgtaccggtccccgttaccgttttacgacgggttcggacgtacggggttgggttccgtagggaactaccggtaccttaccgacgttccctacgaccctaactaccctaaccgacgtacccgaagtaaccggtacccgtaaggtaacgtttgttttacgtacgtttaaacgttttattacgttacgttactaaccgtaacgtaagtaacggtcgtacctacctaagtttactacgtttaccttccgggtaccctaggtaacctaggttagtaactacgtaacgaaacgtacttcggaggtcctacgaaccncgtaacttctacgttacttacctacttcccttccccgactcttcggtaac

SEQ ID NO: 165271 - DNA, 675 bp, Homo sapiens
  misc_feature: GYAE6OF01B4CY2.44.73.G07.1.454.CMB.1.raw
  modified_base (370)..(370): a, c, t, g, unknown or other
  misc_feature (370)..(370): n is a, c, g, or t
  modified_base (443)..(443): a, c, t, g, unknown or other
  misc_feature (443)..(443): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccgggggaacagccaccctctcttgcagggccggcagactgttgacgacgacttagccgtaggtaccaacgaacgaaacctcgggccaacggcctacccgaggcctccttacactctagtacggaacctactccccaccgacgggccacgtggtacctccccacccgtaggttcaggtcggacgnggtcggggtccggaacgaggtagttcaccgtctaccacatccgaggccgtccgtgcctaggtcgtgtaggttnttttcggacttacgttttactacgttgtacgagtactaagttaagttaaactaaccgtcggtacctcttccgtaccggtttcggggaccgggggtaacgagggtacggacgtacgtaccgaaacgtacgtggtacgtactcggaccgtaacctgtccggttcgttaccttccgtacccgttcccgttccccgtaccttacgttacgtagtttaacttaacttcgttaaccgg

SEQ ID NO: 165272 - DNA, 703 bp, Homo sapiens
  misc_feature: GYAE6OF01BP9CD.44.73.G07.1.454.CMB.1.raw
  modified_base (163)..(163): a, c, t, g, unknown or other
  misc_feature (163)..(163): n is a, c, g, or t
  modified_base (292)..(292): a, c, t, g, unknown or other
  misc_feature (292)..(292): n is a, c, g, or t
  modified_base (315)..(315): a, c, t, g, unknown or other
  misc_feature (315)..(315): n is a, c, g, or t
  modified_base (337)..(337): a, c, t, g, unknown or other
  misc_feature (337)..(337): n is a, c, g, or t
  modified_base (357)..(357): a, c, t, g, unknown or other
  misc_feature (357)..(357): n is a, c, g, or t
  modified_base (375)..(375): a, c, t, g, unknown or other
  misc_feature (375)..(375): n is a, c, g, or t
  modified_base (485)..(485): a, c, t, g, unknown or other
  misc_feature (485)..(485): n is a, c, g, or t
  modified_base (493)..(493): a, c, t, g, unknown or other
  misc_feature (493)..(493): n is a, c, g, or t
tcagacagtatatacacgaccggtgctcgatttagctctacgctcaggggaggaactgctcagttaggacccagagggaaccatggaagcccagctcagcttctcttcctcctgctactctgctcccagacttccgaccggacgaattgtgttgacacaatcnccacgccacctgtctttgccgtacggggaacacgccacctcgtcttggccgacgggccggccagactgttacgacgacgtacttacgccgtacggtaccaacgaagaacgccgtgccgacggcctaccncggcctcctacatcctatgactnactaccacgaacgtcggtaccncgtccggaccacccagtacnggttaccgaggtccgagngggttccgggtcgtgggactactcgtacacgtccttccgaaccgttcaaggacctagtagtacgagtaccgtaagtaacgtttagtttacgtattagttttaacgttacnccggttanacggtcgtaacgtttcccgtcgtacccggacggtttcccgaccgttacccggttacgggttcccggggaaggggaaccgttagggtacgggaacgtacgtaccggaacggttacgtaaccggtcgtagggtcccttaccgacttagtacccgtttcggttaactttcccgtaccttacccggttacccttaccccgtcgtttatacccgg

SEQ ID NO: 165273 - DNA, 635 bp, Homo sapiens
  misc_feature: GYAE6OF01DNHS6.44.73.G07.1.454.CMB.1.raw
  modified_base (242)..(242): a, c, t, g, unknown or other
  misc_feature (242)..(242): n is a, c, g, or t
tcagacagtatatacacgaccggtgctcgatttagctctacgctcagggggatcaggactcctcagttcaccttctcacaatgaggctccctgctcagctcctggggctgctaatgctctgggtctcagggtccagtggagatattataatgactcagtctcccctctccctggcccgtcacccctggagagccggcctccatcctcctgtaggtctagtgagagtcttggaggtcagaacntcatgtggactggtacttgcagaagccgggcagtcctccgacaacttcctgactcttagtttcgggttccacgtccgggtcccgttccgggtctcgtggacgtaggttcacggtcgaccctagtcgacgtactccgaacctacacgtacgtacttttaccaacgactgaccaactactacgacgacgaggtaggtacgggaaggtccgttaggaaccggttagttcgggttagggtacttacgttacgtgactacgttacgttaacgttaccttaacccgtaaccccggtttacctaccggttcgggaaccgaaacggggtacctaacggtacgttaagaacgtaagttaaccggactacggtgttacggtctcgacctactagtccgttacg

SEQ ID NO: 165274 - DNA, 882 bp, Homo sapiens
  misc_feature: GYAE6OF01B5SLN.44.73.G07.1.454.CMB.1.raw
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatcgtggggctagaaatgaagagccgtgggtcctcggtgaacggtctccgtgcgacggtcttcgtggacggctattccttacgaagtaaacttattcttaactccgaccgtgggtcgcgaccgaccggtcccctagggaaccgaagggtcgttaggaggtaggtaggtggggtcgggtccgttcccgttaccccgttaagtttacggaacctaacggaacctaaacgtaccggtacaacgtaacgtaaaacgttccgaagggtaccgaacgtacctaccgaacggttaaccgttacccggaccggtaaaccgaaacgtacccggaaggtacggtacgtaccgaacggtacccgttaagtacggtacgggaacgtcgtaccggaccgtaaccgaaccgtaggtacgtacgttacgtacgggaacggtaacccgtaacccggttaccgtttaacgtttacgtttaccggtacggtaccgggtaaacccggtaaacggttaaaacccgtttaaaaacgttttccccgtttaacccgttttaaccggggttttacgggggtaccgggttaaggtttaccggttagttacggttacgtttaaggttaccggtttaaaggtttaccggggttttacgggggaaccggttaaacgggtaaccggttaaggttacccggtaacccggttacccgttacgttacccgttaccgtacccgtccccgtaacccggtaaaccccggg

SEQ ID NO: 165275 - DNA, 742 bp, Homo sapiens
  misc_feature: GYAE6OF01E582R.44.73.G07.1.454.CMB.1.raw
  modified_base (243)..(243): a, c, t, g, unknown or other
  misc_feature (243)..(243): n is a, c, g, or t
tcagacagtatatacacgaccggtgctcgatttagctctacgctcagggccctgggagcacagctcatcaccatggactggacctggagttccttctttgtggtggcagcaactacgaggtcgtccagtcccgaggtgcgtcgtggtgcaatcgtgggactagaaatgaagacgtccgtcgggtacccgtagacgtcctcgtgcgtacgtcttcggtggacgtctatccttacaagtaacttnttctacgtccgtacggtggccgaccgaccgaccggtacccgtaggaacgtacggtcttggaggtgggtaggtcggggtccgtccgttacccgtaccgttaagttacgaacgaacgaaccaaccgtacgaactaaccgaacgttaaccgtcggaggacactaccgtaccgtaacgtaaccgtaccggacggtaacctaacgtaccgaggtaccgtcgaaccgtacgttacgtaagtcggtacggacctcgtaccggacctaaccgtacgtagaccgttacgtcggtacgaaccggtccgtacttaccgttattcgtaccggacgaacgtaaacctaaacgtttaaactttacgttccgttacgggtttaacggttcggacgttattacggttattaccgttagttacgttaggtaacggtttcggaaccgggtaagtacggtacgtacgtcccgtacttcccgtacttacgtaccaccctcccgtaaccgaccggtcccg

SEQ ID NO: 165276 - DNA, 680 bp, Homo sapiens
  misc_feature: GYAE6OF01CKRR5.44.73.G07.1.454.CMB.1.raw
  modified_base (234)..(234): a, c, t, g, unknown or other
  misc_feature (234)..(234): n is a, c, g, or t
tcagacagtatatacacgaccggtgctcgatttagctctacgctcagggggatcaggactcctcagttcaccttctcacaatgaggctccctgctcagctcctggggctgctaatgctctgggtctcagggtcagtggagatattataatgactcagtctccctctcctggccgtcaccctggagacgccggctccatctcctgtagtctagtgagagtcgtggagtcagaacntctatgtggacttggtacttgacgaagaaggaccgggcagtctccactaactcctgacttctagttttcggtaccacggtcgggtaccgtcccggggttcttcgtggactaggttcaggtcgccgtaggtcgacatacacaactacaagtactttaccgactactcgacaaccgtactacgaagaccgtaggtaggtagggaacgggtagttaccggaacggtaggtttagggtttcgggttactttaagttaacgttacgacttaacgtacccgttaaacggtttacccgttaaaccccgttaaacccccgtttaccgtaacccggttaccggggtaacgaaaccggggtacaaaccggtaacgtttacggaaacggttaagttaaacggccggttaaacgttcgggttacggtcgttacgaccctaacctcgttccggttaccg

SEQ ID NO: 165277 - DNA, 630 bp, Homo sapiens
  misc_feature: GYAE6OF01C39W5.44.73.G07.1.454.CMB.1.raw
  modified_base (227)..(227): a, c, t, g, unknown or other
  misc_feature (227)..(227): n is a, c, g, or t
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagaagcctgggtcctcggtgaaggtctcctgcacggcttcgtggaggcatcttcagaaacttntcttatcacgtgggtgcgacgcggccctggacaagggcttcgagtggagtggggtggctcgtcccctaagttttggacaagcaaactacgcacagaacttcgagggcagactcgacgacttaccgcgaacgaactccgacgagtcgcacgcctatagtggagctgcgacaaccgtgagatcgtagacggaacgaccggcccttaagtactttcgcgtaccgacggtaacgtaaaccttaaaacgttttacccgtacctttaacggtttttacggggacggtagttacgtacgttcgtacgtttagtacgtagttacgggttcggggaaccgtaagggtacgtaacggttcggtaccgtaccgttcgttaccgttagacccgtccccgtaccgtaaaccccggg

SEQ ID NO: 165278 - DNA, 919 bp, Homo sapiens
  misc_feature: GYAE6OF01EBPQ8.44.73.G07.1.454.CMB.1.raw
tcagacagtatatacacgaccggtgctcgatttagctctacgctcagggccctgggagcacagctcatcaccatggactggacctggaggttcctctttgtggtggcagcaactacgaggtgtccagtcccaggtgcgtcgtggtgcaatcgtgggctagaaatgaagaagcctgggtcctcggtgaaggtctccgtgcgacggtcttcgtgggagctattccgttacaagtaaaacttactacctttaatccaaccgttgggtcgaccgtaaccgaccggccccgttaggaaaccgaacggggttccgtttaggtaacggttgggtaggttcggggtacgggtcccgttccccggttacccccgtttaaagtttttcgggaaactaaacgaccgtaaaaccgtacgaccgaaaccgtaagtaaacgttccgaagggtaccgaacgtaccgtacgtaaccgaacgttacccgacggaaacgaacgtacccgaagtacggtacgaccgaacgtacctaaagtacggacggtacgtccgttacggacccgtaccgtaaaccgtagtaacgtacgttacgtaacggtaacggaaccgtacccggttaaccctttaacggtttactttaccggttacggaacccgtaacgggtaaaccgtaaaaccgttttaaaaaccgttttcccgttaacccggttttaacccggtttttaacggggaacgggtttaacggtaggttacgttacgtttaaccggttaagttaacgggtttaacgtttaggggttttaaccggggaaaacccggttaaaagggggttacccgttaaaacggttccccggggtttaaacccgacccgggttttaacccttaccccgttttaacccggaacccgtttacccccgtaaccccggtaaaccccggg

SEQ ID NO: 165279 - DNA, 920 bp, Homo sapiens
  misc_feature: GYAE6OF01E08WE.44.73.G07.1.454.CMB.1.raw
  modified_base (555)..(555): a, c, t, g, unknown or other
  misc_feature (555)..(555): n is a, c, g, or t
tcagacagtatatacacgaccggtgctcgatttagctctacgctcaggggggatcaggactcctcagttcaccttctcacaatgaggctccctgctcagctccgtggggctgctaagtgctcgtgggtctcgaggggtccaggtggatattattaactaagtgactcagtccttccccctctcccgtcggcccgtccaccccgtagggacgaccggtccccggtacccttccctattcccgttccgttaggtttacgggttaccgttaggtaggtacggtacggttccggtttaaggggacggtaaccgtaaagaaacccttgtttaccgtttaaggttcgggttagggttaaccggtttagggtttaacccttagggaaaccgaaacgggggtaaccgggtaccccggggtactaacggttccccctaaaccccgtaacccttaaaaccgtttccgggtacttaaacgttttcccggttttaaagggtttttccccggggtaacccccgttaccgggggttccccgggttcccccggggtttccccgggggttnttacccggtaacgggtaccccgggtttagggttccaaggttccccggtaccggtacgggttaccacgtaaccttacaaaccctaacgtaacgttaaacgttcgttaacccaacttacgcgtacctactactaccggacgtaaggtaacgggtaggtacgggacgttacggtaggtaacgggttacgggtttcggggtttacgtaacgtttaacgttcgtaacgtctaaccgtaacgttaccgttaaacccctacccgttaaccgttccggtaccggttacggacggtaaacgtcggtacgtaacgtaggtaagtagtacggtacgacgggtttcgcgtacgtacccgaatcgtcgttaagttccg

SEQ ID NO: 165280 - DNA, 839 bp, Homo sapiens
  misc_feature: GYAE6OF01EZBTZ.44.73.G07.1.454.CMB.1.raw
  modified_base (786)..(786): a, c, t, g, unknown or other
  misc_feature (786)..(786): n is a, c, g, or t
tcagacagtatatacacgaccggtgctcgatttagctctacgctcaggggggaactgctcagttaggacccagagggaaccatggaagccccagctcagcttctcttcctcctgctactctggctcccagattccaccggcgaaattgtgttgacacaatctccagcctacctgttcgttgtcgtaccgggggaacgacgccaccctctcgttgcgacgggcccggccagtcgtggttgaccgacgtacttacgcccttcggtaaccaacgagaacgcctgggaccaggccctacccgagcctccctctattacctagtgtaacttcctttacgttacgggtacgggtccttccggtacggacctaccgttcccccgacggtccccggtaccgttttccgaggttcgggtaccgtagggtttcgggggtaccgtacgggggaacctacgttaccgtttcccgtaaccttccctaccgtaaaccccgtacttaccccgaaacccgaccggttaccccgttaagggtaaccggtacccgttaagggttaaacggtttcgtttttacgggtaaccgttttaacgtttttaaaccgtttaccggtttaccggttaccttaaccggtaaaccccggttaaaggggtaaaccgttccgggtacccctttaaccgtaactttaaccgtttaccctttacccggtttacccgggtacccgttacggggtaacccttaaggggtacggtacttaacggtactaaacggtacgtggtacggtacacgtcctaactntccgttcgttaccgttacctccgttcccttaccctaccttacgtcgtgttaac

SEQ ID NO: 165281 - DNA, 700 bp, Homo sapiens
  misc_feature: GYAE6OF01BF2F6.44.73.G07.1.454.CMB.1.raw
  modified_base (195)..(195): a, c, t, g, unknown or other
  misc_feature (195)..(195): n is a, c, g, or t
  modified_base (197)..(197): a, c, t, g, unknown or other
  misc_feature (197)..(197): n is a, c, g, or t
  modified_base (204)..(204): a, c, t, g, unknown or other
  misc_feature (204)..(204): n is a, c, g, or t
  modified_base (363)..(363): a, c, t, g, unknown or other
  misc_feature (363)..(363): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagacttcccgaccggcgaaattgtgttgacacaatctccagccacctgtcttgcgtaccggggancnccacctntctgcgagggccgacagactgtcgacgacgtacttgcctaggtaccaagagaacgccgtggcccaggcctaccgagtacctccttacattctactacgaacttacgttcgtaagggtacggtcccttcgtacggacctacgtccccgacgtccccggtntttccgacggtcggacgtagggtcggttccggagggacaggttacccttccgaaccttcctaccgaaccacgtacccaccgtacggtacccttaagggaccgtaccgttaagtaacgttacttttacggacgtttaagtttacttacgtccgttactaaccgtaccggtaaggtaccgtacgtacccttacaactttacttccgtacgtttcccggaccgtacgggtaacgttaaggtacgtaacttacgaaccgtaaacggtacgttgggtaccgtcgtcgacctactacgtttccgtcgttacccttctaccttcccgttaccctctgtcgtaac

SEQ ID NO: 165282 - DNA, 718 bp, Homo sapiens
  misc_feature: GYAE6OF01EF919.44.73.G07.1.454.CMB.1.raw
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatcgtggggctgaaatgaagaagccgtgggtccccggtgaaggtctcctgcgacggtcttcgtggagctattcttacaagaaacttatacttatccgtaccgttggggtcgccgaccgaccggcccccgtaggaaccgaagggtcgttaggacggttgggaggttggggtcgggtcctcccggtaccccgtaagttttacggaacgtaacggaccgtaaacgtaccggacaacgaacgtaaacttccgaacgggacacgaccgtacgaacgtaccgtaccggacggaaccgaacgtaccgaggagtcgactacgacttaagtagtcggacgtcgtacgcgaccgaaccgtggaacgtacgtacgtaggaacggaccgtaccggtaccttattactttcgcgtcgaacgtaacgtaaacttaaactttacgtaccgtttacggttttacgggacggttagtagtagttacgttacgttagttagtagttaggttacgggaacgtaacgggtaacgtaggttcggtaccgtaccgttcttcctacgaccgtcccgtaccgacccggtaaccgg

SEQ ID NO: 165283 - DNA, 777 bp, Homo sapiens
  misc_feature: GYAE6OF01ELT1X.44.73.G07.1.454.CMB.1.raw
  modified_base (106)..(106): a, c, t, g, unknown or other
  misc_feature (106)..(106): n is a, c, g, or t
  modified_base (146)..(146): a, c, t, g, unknown or other
  misc_feature (146)..(146): n is a, c, g, or t
  modified_base (216)..(216): a, c, t, g, unknown or other
  misc_feature (216)..(216): n is a, c, g, or t
  modified_base (235)..(235): a, c, t, g, unknown or other
  misc_feature (235)..(235): n is a, c, g, or t
  modified_base (241)..(241): a, c, t, g, unknown or other
  misc_feature (241)..(241): n is a, c, g, or t
  modified_base (252)..(252): a, c, t, g, unknown or other
  misc_feature (252)..(252): n is a, c, g, or t
tcagacagtatatacacgaccggtgctcgatttagctctacgctctaggggtcccgtgggagcaccagctcatcaccatggactggacctggacggttcctcttgnggtggccaggcaactacagtgtccagtcccaggtgcgtcnggtgcatctggggcttgaaatgaacgaacgtcctgggtcctcggtgaacggtctcctgacacggtcttcngggagcatcttcagaactntcttanccacgtgggtncgactacgccctgacaacggcttgagttggagtcggtggcctacgtacccctaagtttcggaactaacgacgtaaacctacggtcaaccacgtaaacgtttccagggtacagtactcgtacgatttaccggcggtaacgaactcccgaagtcgtacgctacgacctaaggtacgtggtaagtacccgttagtacccggtactaaacccgtttggaaacgttaacggttacccgtaggaacgggtacccggaacccggttaacccgtaacgtttacgtttaccgacggtaccgtaacggtacggtaaacttaaaacggttttaccaccggtttaaacggtttttaccggggacggttaacgttacgtacgtttacccgtagttttaaaccgtggtttaaacggttaggttttaccgggggtaaacgtaaaacgggttacgttaaacgggttaccggtaccggttaaccccgggttacttaacccggtttaccgaaacccgttccccgtaacccgtaaaccccgggg

SEQ ID NO: 165284 - DNA, 875 bp, Homo sapiens
  misc_feature: GYAE6OF01BW2N0.44.73.G07.1.454.CMB.1.raw
  modified_base (233)..(233): a, c, t, g, unknown or other
  misc_feature (233)..(233): n is a, c, g, or t
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatcgtggggctagaaatgaagaacgccgtgggtcctcggtgaaggtctcgtgcacggtcttcgtggagcatcttacaagtaaactntacttactccgtacgtcgggtcgtcgacgaccggtcccgtgggtaacgaaggggtccttagggtaggtggggtaggtcgggggttcgggtccttacccgggttacccccgttaaggttttcgggaactaaacggaacctaaaacccgttaccggacctaaccgaaaggttaaaacccgttaccggaacgggacctaacgacccgtacgtaaccgtaaccgttacccgggaaccgggaaacgtaacctaacccggtaacgtacggtcgaaccgtacgttacctagttaacggtacgggtaaccgtcggttacggaccggtaaccctaaccggtaggaacggtacttccggtaagggaaacgggtaacccgtacccgtaaccgtttagtttaccgttcggtaccgtcggtaaaccgttaaacgttaaaaccctttaaaaccttttcccggtttaacccgtttaacgggggtttttacgggaccggtttaggtaacggttacgttacggtaacgtttacggttaagttacgggtttaaacgggtttcccgggggaaaacgtaagggtaacgttcgttaccggttaacccggttaccgttccgttacgttaaccccggtccgtaccccgtaccccggtaacccggg

SEQ ID NO: 165285 - DNA, 741 bp, Homo sapiens
  misc_feature: GYAE6OF01A28JG.44.73.G07.1.454.CMB.1.raw
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagagcctggtcctcggtgaaggtctcctgcacggtcttcgtggaggcattcttcaagtaaacctattcttaatccaccgtgggtcgcgacgacggcccctaggacaagggcttgaggtggagtggggtgggtctccgtacccctaagttttcggaacaagacaaactaccgcaacagtaaacttccgagggcacgactacgacgtacttaccggcggaacgtaactcccgaacgtagtcgacgacgtacctaatacgtggacgtcgttcgaccgaccgtaaccgtgggaactacgttacgtacgggaacggaccgtaacccggtaccccgttaacgttaacttttccgtacggtacccggaccgtaacggtaaaacccgttaaaacttttaacccgttacccggtttaacggttttaccggggttaccgggtaagttacggtacgttacggttactttaacgtaggttaacgtttagggttttaccggggaaaccgtaagggggtaactaagggtccgggttacctacccgggtacctttaccgttaccgaccgtccccgtacccgtaaaccccggg

SEQ ID NO: 165286 - DNA, 519 bp, Homo sapiens
  misc_feature: GYAE6OF01D2UT8.44.73.G07.1.454.CMB.1.raw
  modified_base (303)..(303): a, c, t, g, unknown or other
  misc_feature (303)..(303): n is a, c, g, or t
  modified_base (319)..(319): a, c, t, g, unknown or other
  misc_feature (319)..(319): n is a, c, g, or t
  modified_base (352)..(352): a, c, t, g, unknown or other
  misc_feature (352)..(352): n is a, c, g, or t
  modified_base (372)..(372): a, c, t, g, unknown or other
  misc_feature (372)..(372): n is a, c, g, or t
  modified_base (509)..(509): a, c, t, g, unknown or other
  misc_feature (509)..(509): n is a, c, g, or t
tcagacagtatatacacgaccggtgctcgatttagctctacgctcagggggaactgctcagttaggacccagagggaaccatggaagccccagctcagcttctcttcctcctgctactctggctcccagattccaccggcgaaattgtgttgacacaatctccagccaccctgtctttgctccgggggaacagccacctctcttgcagggccgccagactgttgacgacgacttagcctggtaccaacgagaagcctggccaggcctccagactcctcatctatgatacttctagtaggcctntggcatcccagcccgnttcagtggcagtgggtctgggcagacttcactntcacatcaccagcctagacncctgaagtattttgactagtttattactgtactactacccgtaagacgtggctccaatacttcactttcgcctagggaccaagtgatacacaacgactgtagctgacaccgtatactgtccttcacttccttacccnctactctgta

SEQ ID NO: 165287 - DNA, 703 bp, Homo sapiens
  misc_feature: GYAE6OF01B2BOJ.44.73.G07.1.454.CMB.1.raw
  modified_base (123)..(123): a, c, t, g, unknown or other
  misc_feature (123)..(123): n is a, c, g, or t
  modified_base (195)..(195): a, c, t, g, unknown or other
  misc_feature (195)..(195): n is a, c, g, or t
  modified_base (226)..(226): a, c, t, g, unknown or other
  misc_feature (226)..(226): n is a, c, g, or t
  modified_base (259)..(259): a, c, t, g, unknown or other
  misc_feature (259)..(259): n is a, c, g, or t
  modified_base (353)..(353): a, c, t, g, unknown or other
  misc_feature (353)..(353): n is a, c, g, or t
  modified_base (425)..(425): a, c, t, g, unknown or other
  misc_feature (425)..(425): n is a, c, g, or t
  modified_base (603)..(603): a, c, t, g, unknown or other
  misc_feature (603)..(603): n is a, c, g, or t
tcagacagtatatacacgaccggtgctcgatttagctctacgctcaggggccctgggagcacagctcatcaccatggactggacctggaggttcctctttgtggtggcagctaactacaggtntccgacgtcccaggttgcgtctggtgctaactcgtggctagaaatgaagacgctggtctcgtagtagtctcngcacggtcttcgtaggacgtcattaccgtanaacgtaactatctttagaccgtacgttgggacnccgacgacggtcccgaaggtaccgaaggtctagaggtacgtagtcgggtacggtcgtaccgtaccgttagttacggaatacgaacaacggtcanacgtaagaacttccgaagggtcaacgtaccacgtacgtaacgtccggaacggaactaactaccgaaggtcgngtaaccgtcggtacctaaggacggttacggaaagttcgtaacacgtaaccgtaccgtagacgtagaccgtaagacgtacctacggtacttacgttactttcgacggcgtaacgtaactaaacgttaaacttccgttaaccgttcggtttaacggggaccgttagacgttagtaccgtnttaaggtacgttaagttagggtacggtacggaaacgttacgtaagtccgttaccgtaccgttcgtctttaaccggcccttaacggtaccccgtacccggg

SEQ ID NO: 165288 - DNA, 686 bp, Homo sapiens
  misc_feature: GYAE6OF01EOMEE.44.73.G07.1.454.CMB.1.raw
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatcgtggggctgaaatgaagaagcctgggtcctcggtagaaggtctcctgcacggcttcgtggagcatcttacagtaaactatcttatccacgtggtcgcgacacggcccgtggacgtaagggtcttggaggtggagttggggtcggccgtccgtaccccttaagttttcggaacgtaagaccaaacgtccggacaacaagtaacttccgaggacacgtactaccgaacgacgttacccggacggaacgtaactccgacggtagtacgaccgaacgtacctagtaagtcggaacgtcgtacgaccgtacgaaccgtagacgtactacgtacggaacggaccgtacccggtaccttaagttacgtttcgacgtcggacgtaacggtaaacctaaaacgtttcctaaccgttacggttttcgggacggttagtagtagtcgtaacgttagtagtaagttaggttacggggaaccgtaagggtactaggttccggtaccgtaccgttacttaccgtaccgacgtccccgtaccgtaacccgg

SEQ ID NO: 165289 - DNA, 646 bp, Homo sapiens
  misc_feature: GYAE6OF01AHQAO.44.73.G07.1.454.CMB.1.raw
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagaagcctgggtcctcggtgaaggtctcctgcacggcttctggaggcattcttcagaaactatcttatcaccgtgggtcgcgacacggcccctggacaagggcttggagtggagtgggtggctcgtcccctaatttggacaagcaactcgcacagtaattccgagggcagactcgacgtacttaccgcggaacgaactccgacgtagtgacacgtacctatagtagggacgtcgtcgacgacaaccgttgaacgtactacgtaggacggaccgaccggtacccttattacgtttccgcgccgacgtaactaaaccttaaaactttccttaccgtttacggtttttaggggaccggtagttagtacgtcgttacttagtgtaagtttagggttaccggggaccgtaaggggtaactaacggttacggttacccgtaccggttccttacgttacccgtacgtccccgtacccgtaaaccccggg

SEQ ID NO: 165290 - DNA, 707 bp, Homo sapiens
  misc_feature: GYAE6OF01D7NQA.44.73.G07.1.454.CMB.1.raw
  modified_base (164)..(164): a, c, t, g, unknown or other
  misc_feature (164)..(164): n is a, c, g, or t
  modified_base (203)..(203): a, c, t, g, unknown or other
  misc_feature (203)..(203): n is a, c, g, or t
tcagacagtatatacacgaccggtgctcgatttagctctacgctcagggggaggaactgctcagttaggacccagaggaaccatcggaaacccagcgcagcttctcttcctcctgctactctggcctcccagataccacggagatattgtgttgacacgagtcncgaggcctacccttgttctttcgtccgtacggagggganacggaccgccctacccgttcgtccgttaggtacgggccaggttcgggtagttcggtgtaccgttaagtacctacggtccgtaacggtaaccaaacgaacgtaaccgtcggaccgacggtccctaccgacggtccctaccgtactagtccttagtagctacgacctacgtaccgaacggtacggtcctacggtccgaccctaacccgagtacgtacggtcgaggtcgtacgtcggttacgggacgtacggactacgtcctacgcctacgtactacgtacgataactacgtacgacgacgtacgtacgtagtttcgttacgtagtttaactttactacgtcgttacacggtactccggttaccgtcccgtaccgtacgtcgttaccgtacggttccgggtacggggaccgggtaggtaggtcggagtacgtacggacgagtacgtggacgtcgtacgccgtaatcgtacgttcgttacctcgttaccctacccgcttcgtgttacg

SEQ ID NO: 165291 - DNA, 874 bp, Homo sapiens
  misc_feature: GYAE6OF01AKLWF.44.73.G07.1.454.CMB.1.raw
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagaagccgtgggtcctcggtgaaggttctccgtgcgacggtcttcgtggagcatcttcaagtaaactatcttagtcctaccgtgggtcgaccgtacgaccgggccccgtagggaaccgtaaggggtccgttaggaaggttcggggtagttcggggggtcggggcccgtttcccggttacccccgtaaggtttttacgggaaccaaacggacctaaaacctaaccgaccgaaacgaacgtaaaacgttacccggaggggacctaacggaaccttaccgaacggtaaccgttaacccggacgggaaaccgtaacgtacccgaacgtacggtcggacgaccgaccttaacgtaaggtacgggtaccgtacgtaccggtaccgtaacccgtaaaccggtaggtaacgtaacgttcggttaacgggaaccggtaaacccggtaacccgggtaccccctttaaaggtttcgtttacccgtcgggtaacccggaccgttaaacgtaaaacccgtttaaaaaccgtttttcccgttaacccggtttaccgggtttttaacgggggtaccgggttaaggttacggttaacgttacggttacctttaaggtacggttaaacgtttacggggtttacggggtaaaccggtaacgggtaactaggttaccggtacgtacccgttcgttacgtaccgtacccgtccgtacccggtaaacccgg

SEQ ID NO: 165292 - DNA, 685 bp, Homo sapiens
  misc_feature: GYAE6OF01BZSSI.44.73.G07.1.454.CMB.1.raw
  modified_base (192)..(192): a, c, t, g, unknown or other
  misc_feature (192)..(192): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagtattccaccggcgaattggtgttgacacaatctcagccacctgtcttgtctcgggggacngccacctctctgcgagggccgcagactgtcgacgacgtacttacggccttaggtaccaacagaacgtcctcggccacggcctacccacgacctcctcactactatgacttacgtttctagggtaacggtccctcgtcgggactacgtaccccgcgtcccgtacttcgaaggtggacctagggtcgggtaccgtgggtaaccacggtacctttaccacttaccgtaccgaacaccgttccaaacgtcccgtacgttacgggacctaccgtaggtaacgttacgttttacgaaccgtttaacgttttacttaaccgtttcgtaaccgttaacgtaaccgtaaacgtacggtaccgtacctactaattccttaccgtaacgttccggaccgttacggaacgtaagtcgtactacgtaccgaacgtacgtggtacgactccggtacctacacgttctcctccttactacgttcccgtaccccgtcttacctggttac

SEQ ID NO: 165293 - DNA, 868 bp, Homo sapiens
  misc_feature: GYAE6OF01B1FBI.44.73.G07.1.454.CMB.1.raw
  modified_base (145)..(145): a, c, t, g, unknown or other
  misc_feature (145)..(145): n is a, c, g, or t
  modified_base (175)..(175): a, c, t, g, unknown or other
  misc_feature (175)..(175): n is a, c, g, or t
  modified_base (202)..(202): a, c, t, g, unknown or other
  misc_feature (202)..(202): n is a, c, g, or t
  modified_base (215)..(215): a, c, t, g, unknown or other
  misc_feature (215)..(215): n is a, c, g, or t
  modified_base (243)..(243): a, c, t, g, unknown or other
  misc_feature (243)..(243): n is a, c, g, or t
  modified_base (250)..(250): a, c, t, g, unknown or other
  misc_feature (250)..(250): n is a, c, g, or t
  modified_base (273)..(273): a, c, t, g, unknown or other
  misc_feature (273)..(273): n is a, c, g, or t
  modified_base (370)..(370): a, c, t, g, unknown or other
  misc_feature (370)..(370): n is a, c, g, or t
tcagacagtatatacacgaccggtgctcgatttagctctacgctcagggggatcaggacctcctcagttccaccttctcacaatgaggctccctgctcagctccgtgggctgctaatgctctggactccctggaccagtcgcagnttgttgtacgctcgacccagtcctcccctntctcgtcgtcccgtccacccgtggacncggccgtcctccntcgtcctgacgtagtacgtagcaagccnccttcgngtacagtagtagagtaaggaaanactattaacgttttcgaaccgttaggtacccttggacgaagggtaacgtcgacgggtacccctaaggttcccgcccgactacggtccctcccgttanaacgtttcttaaacgttcgtaacctttttcccgttaaacggacccggtacccttcgtttacccgttggtaccgggttaaagggttccccaaaccggtaagggttaccgtttttacgggtaccggaagggtttcgggaccgggacgggggtttaccgggggtaccgggttaaccgtaaggtttaccgtttaaccgaaacccggttaacgtaaacggtaaaaccgtttccgggaacgggtacccgggggttaggtacccggtaggtagggtaaccggttaaggttttagggttaagggtttaaacttttacggttaacccgttaggtaccgttaagtcggtaaaccgtacgggttaacccgtaccggttttaacccggtacccccggtttacccgggttaaaccgtttacccggggaccggttaacccgggtaacgggtaacgtaaaccgggttaacaacccgggaggttaaacccgtttacggcgtaacgggtaccccg

SEQ ID NO: 165294 - DNA, 854 bp, Homo sapiens
  misc_feature: GYAE6OF01EKYAG.44.73.G07.1.454.CMB.1.raw
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatcgtggggctagaaatgaagaagccgtgggtcctcggtgacggtctctgcacggtcttcgtggagtctattcttacaagtaaacttacttcttactccgacgttgggtcacgaccgaccggtccccgtaggaacggaagggtccgttaggtacggtaggtaggttcggggtcgggtacccgttacccggttacccccgtttaaaggtttttacgggaaaccgtaaacgaaccgtaaaaccgtaccggaccaaacgtaaacggttaaaacgttaccggaacgggtacctaacggtacccgtaaccgtaaaccggtaaaccgttaacccgggaccgggtaaaccgaaacccgttaccggaacggtaacggttacgaccgtaacgtacccgttaagtaacggtacgggtacgtaccggttacgcccggtaaccctaaccggtagtaacgtaacttcggtaacggaaccggaaccgtacccgtaccgttactttacgttcgtacggaccgtacgtaacgtaaacttaaaacctttccgttaaccgtttacgggttttacgggacggttagttagtacgttacgttacgttaacgttaggttaagtttacgggttacgggtaaccggttaaagggtacgttaaggttcccggtaacgttaccccgttcgttacccggttaacgtccgttccccgtaccgtaaaccccgggg

SEQ ID NO: 165295 - DNA, 746 bp, Homo sapiens
  misc_feature: GYAE6OF01B2RTP.44.73.G07.1.454.CMB.1.raw
  modified_base (195)..(195): a, c, t, g, unknown or other
  misc_feature (195)..(195): n is a, c, g, or t
tcagacagtatatacacgaccggtgctcgatttagctctacgctcagggggaggaacgtgctcagttaggacccagagggaaccatggaagccccagctcagcttctcttctcctgctactctggctccagattccaccggcgaaattgtgttgacacaatcgtccagccaccctgtctttgtcgtcggggaaancgccacctctctgcacgggccagtcagtagtcgttagcagactaacgttgaccgtacggtaccaacgaacgaaaccgtggacgacgtcctaccgacgtcctacctactacttacgtagtaccgaacctaccgtacccgaccggaccggacctacgttacggtaaccctacccgtaaccggtacggttacgtacgggtacgggtacggtacggggttaccggggtaccggtaacgtacggttacgttacctaccgttaccgtacctaaccgtacgtccgacggtccggtacctacgtccgtaacgttcgttacggttaacgtttcgtttacggtacgtttaacgtttacgttacgtcgtacgaagttacgtaagttaacgtaacgttaccgtcgttccgttacgttacgggttaccgggttacgggggaccggttaacgtacgggtacgtaacgtaacgttaacgaacggtcgtcggtcgacgtacctaccgtacgttcgtacggttcgtccgttaccgtccgttacccgtctacttagtactagtaactcg

SEQ ID NO: 165296 - DNA, 843 bp, Homo sapiens
  misc_feature: GYAE6OF01DWJT2.44.73.G07.1.454.CMB.1.raw
tcagacagtatatacacgaccggtgctcgatttagctctacgctcaggggccctgggagcacagctcatcaccatggactggacctggaggttccttctttgtggtggcagcaactacaggtgtccagtcccaggtgcgtctggtgcaagtcgtggggctgaaatagaagaacgcgtgggtcctcggtagaaggtctccgtgcgacggtcttcgtggacgcagttctacgaacaaaccttattcgttaactccgaaccggttgggtacgaccgacgaccggacccgtaggaacggtaagggtacgttggacggttaggaggtacgggggtacgggtaccgttaccccggtacccccgtttaaagtttttacggaaaccgtaaacggtaacccgtaaaacggttaccggaacctaaccgtaaacggtaaacctttaccggaaacgggtacgaacgtaaccgttacgaaccggtaaccgttaccggaccgggaaccgtaaacgttcccgaacggtacgtcgaccgtaaccggtaccgtaagtacgtacgggacgtacgttcggaacccgtaaccgtaccgttaacggacgtaacgtttcgtacgggaaacggtaacccgtacccggtaaccctttaagtttaccgtttacgtacgtaccgaacgtaactaaaaccgttaaactttaccgtaccgtttaacggttttacggggtacggtagttacggttacgttacgttacgtttagtacggttaacgtttagggttacgggaacggtaagggtaataacggttacggtacgtaccgttaccgttacttaccgaccgtccgtacccgtaacccggg

SEQ ID NO: 165297 - DNA, 787 bp, Homo sapiens
  misc_feature: GYAE6OF01CANLB.44.73.G07.1.454.CMB.1.raw
  modified_base (251)..(251): a, c, t, g, unknown or other
  misc_feature (251)..(251): n is a, c, g, or t
  modified_base (289)..(289): a, c, t, g, unknown or other
  misc_feature (289)..(289): n is a, c, g, or t
tcagacagtatatacacgaccggtgctcgatttagctctacgctcagggggatcaggactcctcagttcaccttctcacaatgaggctccctgctcagctccgtggggctgctaatgctctgggtctcgagggtccaggtggagatattataatgactcagtcctcccctctcccgtggcccgtcacccgtggacgcgccggcctccatcctcctgtagtctagtgagtagttcgttggaggtcaagaacntctatggtggtactggtactgacgaaggacggaccggnacgtctaccaactaactctagtattcgttagtttcgggtccacggtccgggtccgtccgggtatcgtgacgtggtcagtcgcgtagtctcactacacaacacgtagtacttacacctactcgacacactcgacgagaaggtaggtgggtaacgtcgtacgggtaacggttaggtttcggggtttagggttaccttaaagttccgtacgttaccgtaaccgtttaacccggtttaacccgtttaaccccggttaaacccccgttaaacccccggtttaacccgggttaaccccggggttttacccggggaaaacccgggttaaaaaccgggggtaacccgttaaacccgggtttaaaacgggtttaaccgggtaaacggtttaaaacgggtttaaaaccgggtaacccgggttaaaacccggtttggggtaccccggttacggttaaccccggtaaccccgttaaacccggtttacgtttacccgggtttttaaccccg

SEQ ID NO: 165298 - DNA, 770 bp, Homo sapiens
  misc_feature: GYAE6OF01EZF55.44.73.G07.1.454.CMB.1.raw
  modified_base (364)..(365): a, c, t, g, unknown or other
  misc_feature (364)..(365): n is a, c, g, or t
  modified_base (409)..(409): a, c, t, g, unknown or other
  misc_feature (409)..(409): n is a, c, g, or t
  modified_base (589)..(589): a, c, t, g, unknown or other
  misc_feature (589)..(589): n is a, c, g, or t
tcagacagtatatacacgaccggtgctcgatttagctctacgctcagggggagaactgctcagttaggacccagagggaaccatggaagccccagctcagcttctcttctcctgctactctggctcccagacttccaccggtacgaaatttgtgttgaccaacaatcctacccacgcccaacccttgtccgtttaggtccgtcccgggggaacgtcgcccgaccccttcgtccttgcgacggggccgtccagtacttggttcgacgtacgtacttcggacccgttggtaaccaacagaacgtcccgttcggacccaagggcccttacccacggaccttaccctcgactctactggactttaccnntttacgtacgtactggtccgtctcgccacgtccccagtccgctnacgtacggtcgtacgtcgggactgggtacctacggtaccttccaccgttccgtaccgtaacccgtaaccgtaccgtaacccgtaacgccgtaccgtaacggtaaccgttaacggttaacgtaacgttttacggtttaccgttaacgtttaacgaacgttttaaccgttacccggtaccgnttaaccgtaacccggtaaccggttaaccggtaaccgttacggtaccgttacccgtaaccttaacgttacccgttaccgttaccgtaccgtacggtaacgtaacgtacgtaacgtaacgacgtacgtaaccgtacgtcgtaccgtacgtacctaccgtacgtacctcgttccgttccgtacc

SEQ ID NO: 165299 - DNA, 830 bp, Homo sapiens
  misc_feature: GYAE6OF01CKCKY.44.73.G07.1.454.CMB.1.raw
tcagacagtatatacacgaccggtgctcgatttagctctacgctcgaggggcccggtgggagcgacagctcatcaccatggactggacctggaggttcctctttggtggtggcagcaactacaggtcgtcccagtcccaggtgcgtcgtggtgcaatcgtgggctagaatgaagagcctgggtcctcggtgaagtctaccgtcgcgacggtcttcgtgggacggtctatccttacgaagtaaactacttcttacgtacctacgtgggtacgacgaccgtacggcccgtaggaacgtaagggtcgttaggaggttacgggtaggtcgggggtacggtccgttccgttaccccgtaaggttttcgggaaccgtaacggacctaaaccgtacgtaccgtaacgtaacggtaacgttccggacgggtaccgaacggtacctacggtaacgtaccgtacccggaccggtaaccgtaaccgtacccgtacggtacgtacggaccgtacgtaacctaagtacggtacggtaacgccgtacgaccgtaaccgtaaccgtacggaacgtacgtaccggtacggaacggaaccggtaccggtaccttaagtttacgttccgtacggtacggtaccgtaaacggtaaaccttaaacgtttcccgttaccgttacggttttaacggggacggttacgttaggttaacgtcgttaacgttggtacggttaacggttacggggttaccggggaacggtaaagggtaacgttacggttaccggtaacccgttccgttaccggttaccgttaccgacccggttccccgtaaccgggtaaccccggg

SEQ ID NO: 165300 - DNA, 810 bp, Homo sapiens
  misc_feature: GYAE6OF01E00H7.44.73.G07.1.454.CMB.1.raw
  modified_base (200)..(200): a, c, t, g, unknown or other
  misc_feature (200)..(200): n is a, c, g, or t
  modified_base (264)..(264): a, c, t, g, unknown or other
  misc_feature (264)..(264): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccaccggcgtaaattgtagttgacacaatctccagccaccctgtctttgtccgtccgggggaacngcccacccttctcgttgcgagggcccgcagtctggttgacgacgtacttagcctggtaccaacngtaacgccgtggaccacggccttcccagacctcctcgacttcgttactgacttacttcgttaaggtccggggtccttcggttcggacctaccgttacccccgacgggtcccccgttctttaccggaggttcgggaccgttaggggttcgggttccgtagggtaacgaggtaccctttacaccgttctacccaacgtacttacccgaacccgtacgtaccttacggaacgttaccgtaaggtaacggttttattttacgggtaccttttaaaggtttttacctttaccgttacgtttacccttaaacccggttaaccgtaaaacgggtacggtaccgttaacccttaccctaaacgtttactttacccgtacctttcccgggaacccgggtttacccggggaaaccgttaaacgggttcgtaaacttaaccttaaccgaaaaacgttaaccggttcggtaccgggactttacccggacctaacccctaagtttccccttagttacccttacccttactttccccggccttaccacggtttcctaaag

SEQ ID NO: 165301 - DNA, 650 bp, Homo sapiens
  misc_feature: GYAE6OF01BU9CS.44.73.G07.1.454.CMB.1.raw
  modified_base (264)..(264): a, c, t, g, unknown or other
  misc_feature (264)..(264): n is a, c, g, or t
  modified_base (273)..(273): a, c, t, g, unknown or other
  misc_feature (273)..(273): n is a, c, g, or t
  modified_base (384)..(384): a, c, t, g, unknown or other
  misc_feature (384)..(384): n is a, c, g, or t
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagaagccgtgggtccccggtgaaggttctccgtgcacggcttcgtgggagctatccttacagaaacttagttccttaagtccaccgttgggtcgacgacncggtccccnggacaaggtcttgagtggatgggtaggctcgtcccctatttggacagcaacgtacgcacagaatccagggtcagacgtccagtactaccgcgaacgactacccgagtagtnacgagtcctatagtggacgcgtgccgactaactggacgtatgtacggacgtacgtaccgtaccctatacgttttcgacgtccgaccgaagtaactaaaacgttttacgttaccgtaacgtttttgggaccgggtacggttataacgttacgtcgtttaacgttagtaagtttaccggttacggggaacgtaacggggataaggttcccggtaccgtaccgttaccttccgttacgtacctccccgtaccgtaccggtaaccccggg

SEQ ID NO: 165302 - DNA, 952 bp, Homo sapiens
  misc_feature: GYAE6OF01A0NW3.44.73.G07.1.454.CMB.1.raw
tcagacagtatatacacgaccggtgctcgatttagctctacgctcaggggccctgggagcacagctcatcaccatggactggacctggaggttcctcttgtggtggcagcaactacaggtgtccagtcccaggtgcgtctggtgcaatcgtggggctgaaatgaagagcctgggtcctggtgaaggtctccgtgccgacggtcttcgtggagctattccttcaagtaacttatcttactacaccgtgggtcgaccgacgaccggccccgtagggaacgtaacgggtcgttggaaggtgggagttcggggtacggtccgttcccgtaccccgttaagttttaccgggaacaacggtaccgtaaaaccgtcgaccgaacgtaacgtaaaccgttaccggaacgggtacgaacgaccgttacggaaccgttacggttacccggacgggtaaccacgttacccggagtaacggtcgacgaacgtcccgttaaagtaggtacgggtacgtaccgtacggtacccgaccgtaacccggttacggtaacggttaccgttacccggtacggtaacccggggaccccggtaaccccgggttaccctttaaccgttttaacggtttcccggttaaccgggtaccggttaaacccggtaaacggttaaaaacccccgttttaaaaaacgttttcccccgttttaaacccggggttttaaccggggtttttcccgggggtaaccgggggttaaacggttttacggaacgtttaacccgggttaccgtttttaaagtaccggggtttaaaacggttttaccgggggttaaacccgggggttaacccgggttaaacgggttaaccgttaaccggggtttacccgggttacccgttaaacccgggttcccttaccgggttacccccgtacggtttaccccccggaaaccccgggttaaaccccgggg

SEQ ID NO: 165303 - DNA, 783 bp, Homo sapiens
  misc_feature: GYAE6OF01C75U7.44.73.G07.1.454.CMB.1.raw
  modified_base (420)..(420): a, c, t, g, unknown or other
  misc_feature (420)..(420): n is a, c, g, or t
  modified_base (504)..(504): a, c, t, g, unknown or other
  misc_feature (504)..(504): n is a, c, g, or t
  modified_base (506)..(506): a, c, t, g, unknown or other
  misc_feature (506)..(506): n is a, c, g, or t
  modified_base (739)..(739): a, c, t, g, unknown or other
  misc_feature (739)..(739): n is a, c, g, or t
  modified_base (773)..(773): a, c, t, g, unknown or other
  misc_feature (773)..(773): n is a, c, g, or t
tcagacagtatatacacgaccggtgctcgatttagctctacgctcgagggggaggaactgctcagttaggaccagagggaaccatggaagccccagctcagcttctcttcctacctgctactctggctcccagtcttccgaccggcgaaattgtgtgacacaagtctccgacgcctacccttgttcgttgtccggtacgggggaacacgcctaccctctctcgcgacgggccgaccagtactggttacgaccgggactacttacggcctacggtaacccaaacgaggtaacgccccggtggacccgaagggtcccctacccggataccctccactaacgtctaatcggtaacttacggtttccgaaaggggtttcggcccttacgttcggtacccaacgtacccgcccgtcccccggttntaccggtacggttgggaccgtgggtttacccgggtggtaccgggaaacctactaaccggttacccacggtacccttaccaaacncncccggttaaaccgacggtttaccgaacggccggtaaccgttaaacggtaaggtttaagttttcgaccgttttaaggtttactttaaaccgtcgttaccgaaagtcgggtaccttagttaccgttccttaaccgccttaactaccggtgtaccgggttaccggaacccggaagggtaaccgaaggttacgggtaaactacgaaacgtaaccggtgtaccggactcgaaaccgtncttacgtccttacgacttaccctcgtaccccgtncgttcgtaaa

SEQ ID NO: 165304 - DNA, 871 bp, Homo sapiens
  misc_feature: GYAE6OF01C66N2.44.73.G07.1.454.CMB.1.raw
  modified_base (539)..(539): a, c, t, g, unknown or other
  misc_feature (539)..(539): n is a, c, g, or t
tcagacagtatatacacgaccggtgctcgatttagctctacgctcaggggccctgggagcacagctcatcaccatggactggacctgggacggttccttcgtttggtgggtggcagaccaactacaggtcgtaccagtacccagggtcgcgtcttagggtgacaattcgtggggtactaggaaataggaaggtaacgtccgtcgggtccgtacgggtaggtaacggttcctacctcggaccgtacggtcctttacggtgggacggtctacgttaccttacgaaacgtaacttacttaccttactccggtaccggttagggacgaccgaccggtaccggcccggtagggaacggtacgggtcgttaggagggttagggtcgggttggggtccggtccgttacccgttacccgtttaaggtttacggaacaacgacctaaacgtacgaacaacgtaacgtacgtacggacggacgactaccgtacgacgtaccgtacggacgtaactaacgaccgagtagacacgtacgtactaagtcggnggcgtactacggaccgtaaccacggtactacgtactacggacggaaccgtaccgtaccggtaactttaacggtccgttacggacgtaaccggaaataaacgttaaaaccttttaacggttcccctttaggggtttaaccgggtcgggtacggttagtacggttacttacggttaacgttaacggttacgtaaaccgggggtttcggttaaacccggggaacgtaacggttaacccggttaagggtttcccccctaaacgggttttaccccgttacccgtttaaccggaccccggttaacccggttcccccgaaaacccggtaacccccgggg

SEQ ID NO: 165305 - DNA, 639 bp, Homo sapiens
  misc_feature: GYAE6OF01EXD74.44.73.G07.1.454.CMB.1.raw
  modified_base (143)..(143): a, c, t, g, unknown or other
  misc_feature (143)..(143): n is a, c, g, or t
  modified_base (158)..(158): a, c, t, g, unknown or other
  misc_feature (158)..(158): n is a, c, g, or t
  modified_base (251)..(251): a, c, t, g, unknown or other
  misc_feature (251)..(251): n is a, c, g, or t
  modified_base (291)..(291): a, c, t, g, unknown or other
  misc_feature (291)..(291): n is a, c, g, or t
  modified_base (417)..(417): a, c, t, g, unknown or other
  misc_feature (417)..(417): n is a, c, g, or t
  modified_base (453)..(453): a, c, t, g, unknown or other
  misc_feature (453)..(453): n is a, c, g, or t
tcagacagtatatacacgaccggtgctcgattttagctctacgctcaggggggaggaactgctcagttaggacccagagggaaccatggaagccccagctcagcttctcttcctcctgctactctgctccagattccaccggngaattgtgttgacanaatctcagccacctgtctttgtcgtcgggggaacgagccaccctctcttgcgagggccgccagactgtgacgacacttacgcctggtaccaanagaacgcctggccaggcctccagacctcctacatctagtnattactttcgtaggtaagggccctcgtcggcctactccccacgcccgtcttcgaggtggcgagggttgggtctacgggaacagtacctttacacttctaccaacctatccaccacgacctaggacnccgtagaacgttactttagtactagtttattacgtntactaacgtaacgtaagtaacgtacgtcctacctaattacttacgtacgtttccggaccgttcgggaaccgtaaagtcggtaatacgtaaccgaaacgtaacgtggtacgccgtacggcctaaccgttactccgttacgttccttaccctaacgttccccttacccctaccgttaactcgttaacg

SEQ ID NO: 165306 - DNA, 786 bp, Homo sapiens
  misc_feature: GYAE6OF01CXJQ6.44.73.G07.1.454.CMB.1.raw
  modified_base (743)..(743): a, c, t, g, unknown or other
  misc_feature (743)..(743): n is a, c, g, or t
  modified_base (750)..(750): a, c, t, g, unknown or other
  misc_feature (750)..(750): n is a, c, g, or t
  modified_base (757)..(757): a, c, t, g, unknown or other
  misc_feature (757)..(757): n is a, c, g, or t
  modified_base (761)..(761): a, c, t, g, unknown or other
  misc_feature (761)..(761): n is a, c, g, or t
  modified_base (781)..(781): a, c, t, g, unknown or other
  misc_feature (781)..(781): n is a, c, g, or t
tcagacagtatatacacgaccggtgctcgatttagctctacgctcgagggggggaggaactgctcaggttaggacccaggagggaaccagtggaacgcccagctcgacgtcttccttccttccctcctcgcttactcgtcggcctacccagtaccttccgaccggtacgtaaagttggtagtacgaacacaactcctccgacgccctacccttcgttcctttcggtcccgggtacccggggggaaccgaccgtaccctaccctccgttaccgttcggaccggaccgggggcccgggacccaacggtacgttcgggttaccggaacggtaaccgtacggttaccggtaccgtaacggtaaccgaaaccgaacggaacggtcccgtacgggacccgacggcctacccgacgtaccctcctaccatactactacgtaacttacctttacgtaacgggttcggtcccttccggtacgccttaacctcccgtaccgtccccgtacttacggtacggtcggtacggtacgggtcggttacgggacggtaacgaacggttaccttaccgtaccgtacccttaccaaccgtacctaccaaccggtacgttaccgacgtaacggtccgtaaacgtatttcgtacgtacgtaagtttactacgtagttacctaaagtaccgtaagtgtacccgtactaactacttcgtaccttacgtccggacgtacggaactagtagactaacgacgtaacngcgacgncgactanttcnttactactctaccctcaccntctcg

SEQ ID NO: 165307 - DNA, 730 bp, Homo sapiens
  misc_feature: GYAE6OF01AP4WJ.44.73.G07.1.454.CMB.1.raw
  modified_base (321)..(321): a, c, t, g, unknown or other
  misc_feature (321)..(321): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagacttccaccggcgaaatttgtgttcgacacaatctccacgtccaccctgtctttgtccgtccgggggaacgacgcccaccctctcttgccgagggccggccagtacgtgttacgacgaccgtacttcgcctacggtaccaacgagaacgcctcggccaggcctcccgacgtacctcctacattcctagntagtcgcacgtaccaacgtaggtcctacggtcgacccgacccgagaacctcggttccgaggttcggcgtaacggttcggggtacgtacgggactacgttacccgtttacgaccttcgtaccgtacccgttccgaaaccggtactaacgtaccggtaacgacgtaacccggtttaggtaaactttaccgggttttacgacggttttaaactttttcgttaacgtcggtttaacacgttacgtaaccggtcccttacccggcccggttaaccggtcccgttccttaaccgggttccgggttaccggggaccgggggaactaggggtacggtactccggaataccggtaacggtactcggtcggaccgtcgtaccagtcttacggtcttacttctcgtcgtcccgctgtacg

SEQ ID NO: 165308 - DNA, 790 bp, Homo sapiens
  misc_feature: GYAE6OF01BGJ57.44.73.G07.1.454.CMB.1.raw
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatcgtggggctgaaatgaagagcctgggtcctcggtgaacggtctccgtgcgacggcgttcgtgggacgcatcgttacaagtaaactatcttatccgacgtgggtacgacgacgacggtccctaggaacgaagggtcttaggacggttaggacgtggggtacggtccgttaccggttaccccgttaaggttttacggaaccgtaacgtaaccgaaaaccgtaccgaccgtaacgaaggtaaacttaccgaaggggaccacgtaacctcgaacgtacgtaaccggaccggaaacgtaactaccgaacgacgtacgactacgaccgttaataggacggacgtacgtcggaccgtaccgtaaccgagtagacgttacgtacgggaacgggtaaccgaaccggttacctaagtttacgttacgtcgaaccggaacgttaaacgtaaacctttaaaaacgttttccgtaacccgttttaggtttacgggggtacggttaacggttacgtaacgtttacgtaaccgtttaaggtacggttaaaggtttaccgggtttacgggggaaaccggttaaaggggaaccttagggttaccggtacccttaccggttccttaccgtactaccgtccccgtacccgtaaacccggg

SEQ ID NO: 165309 - DNA, 813 bp, Homo sapiens
  misc_feature: GYAE6OF01A2Y7V.44.73.G07.1.454.CMB.1.raw
  modified_base (363)..(363): a, c, t, g, unknown or other
  misc_feature (363)..(363): n is a, c, g, or t
tcagacagtatatacacgaccggtgctcgatttagctctacgctcagggggatcaggactcctcagttcaccttctcacaatgaggctccctgctcagctccgtggggctgctaatgctctggactcccgtcggacccagtcgacagtattggttgtgcgtcgacccacgtaccctccctctctcgtcgtcccgtccgtacccgtggaccgacggcccggtccctccgtacgttcgttccgtacgtaccgtaacgttacctaggtaccgtaacggtaccgtccctccgtacggactaagtagggtacgtaaggtaacggaaaacgttactaagttttacgtttacgtaaccgttcggtaaccnggtaacgtacggacggtaccgtacggacccgttacggtcccgtacgccgtaacgttccctaccgtacttacgttacttagttacgtttaccttacttaaccggacggtcccgttaccgttagtcgggtagggtacctcggaacgttaaggttacggttacggttcgaagggtccgggacgggttacggggtccggggtacgtactacgttacgttacaacggtaacgtaacgtaacggccgggtacgggaccgggtaggtaccgtagtaagggtcggtttaagttacggtttaagttacgtttaacgtacggtagttaccgaagtaccgggtacgtacgttacgtacccgtttaccgggtaccccggtttacccggccggtaaaccgggaccggtaagggtcgtaaacgggtaacttacggacgtaaacgtagtaacggtcggagtaccg

SEQ ID NO: 165310 - DNA, 696 bp, Homo sapiens
  misc_feature: GYAE6OF01BUYTH.44.73.G07.1.454.CMB.1.raw
  modified_base (63)..(63): a, c, t, g, unknown or other
  misc_feature (63)..(63): n is a, c, g, or t
  modified_base (207)..(207): a, c, t, g, unknown or other
  misc_feature (207)..(207): n is a, c, g, or t
  modified_base (300)..(300): a, c, t, g, unknown or other
  misc_feature (300)..(300): n is a, c, g, or t
  modified_base (318)..(318): a, c, t, g, unknown or other
  misc_feature (318)..(318): n is a, c, g, or t
  modified_base (362)..(362): a, c, t, g, unknown or other
  misc_feature (362)..(362): n is a, c, g, or t
  modified_base (418)..(418): a, c, t, g, unknown or other
  misc_feature (418)..(418): n is a, c, g, or t
  modified_base (429)..(429): a, c, t, g, unknown or other
  misc_feature (429)..(429): n is a, c, g, or t
  modified_base (553)..(553): a, c, t, g, unknown or other
  misc_feature (553)..(553): n is a, c, g, or t
tcagacagtatatacacgaccggtgctcgatttagctctacgctcaggggggaggaactgctnagttaggacccagagggaaccatggaagccccagctcagcttctcttcctcctgcctactctcggctcccagtacttccaccggcgtaaattgtagttgacacaatctccacgccaccctgtccttggtcgtaccgggggaacncgaccaccgtctctgcacgggccgcagactgtgacgacgacttagcctcggtaaccacgagaacgtccgtcggcaggcctaccgaacgctccncgatctactcgctacctntacggtacggcctagtcggactacgtcccacgcccgtcttacgnggttcggctacggtggtccggtaaggaccaagtcccttcgacgtctacgaaccctntccgaaacccngtcctaacggtcgtacctaggattactttaccgagttaacgtttaacgtacgtccgttaaacgtaccgaaccgttaaaggttagtccgtaactactaacgttatccgtaacgttcgtaacccgnggttaaaccgaagggttcaacgttacgtaacaaccgggtttaaccgaggttaccggttacacggacccttaacggtaacgttccgttacccttcgtttaaccttccgtaacccgttacccccgaatttccgggtacttaaccg

SEQ ID NO: 165311 - DNA, 719 bp, Homo sapiens
  misc_feature: GYAE6OF01CVRN0.44.73.G07.1.454.CMB.1.raw
  modified_base (120)..(120): a, c, t, g, unknown or other
  misc_feature (120)..(120): n is a, c, g, or t
  modified_base (127)..(127): a, c, t, g, unknown or other
  misc_feature (127)..(127): n is a, c, g, or t
  modified_base (195)..(195): a, c, t, g, unknown or other
  misc_feature (195)..(195): n is a, c, g, or t
tcagacagtatatacacgaccggtgctcgatttagctctacgctcagggggatcaggactcctcagttcaccttctcacaatgaggcctcctgctcagctccgtggggctgactatgctntgggtcncgagggtcagtggagtattattaataatcgacctcgagtcctccccctctcccgtgcccgtcacccgngggacacgcccgcctcactcctctagtaggtcagtaggatacgtcggtggagtcaagatatcgtagtgtggacgttgtactgacgaagaacggaccggctacgtcctaccaactaccgtcgtgtacttcgttacgtttcggtaccgtaccggttccgggtcccgttaccggggtcttacgtaccgtaacgtaggttaccgtggccgtacgagttcgcttaagtaccgaactaaccggattaaacggttaccgtttaccgaactaccgtacgtaaccaacttacgtaccggaacgtaacgaccgggtaaggtacgggtaacgtacggtacgtagtaacggtttgggtaccggttattacgtactcgtaacgttaccttaaacggtacccgttaaccgttaaccttaaccccgttacgtaccggttaccggaccgtaaacggtaccgaaccgtagtacgggtaaactagtaaccgtataccgggtacgtccggtagaacccggtcctaaactcgttacccgttacg

SEQ ID NO: 165312 - DNA, 755 bp, Homo sapiens
  misc_feature: GYAE6OF01AI7LJ.44.73.G07.1.454.CMB.1.raw
  modified_base (186)..(186): a, c, t, g, unknown or other
  misc_feature (186)..(186): n is a, c, g, or t
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (222)..(222): a, c, t, g, unknown or other
  misc_feature (222)..(222): n is a, c, g, or t
tcagacagtatatacacgaccggtgctcgatttagctctacgctcagggggaggaactgctcagttaggacccagacggaaccatggaagccccagcgcagcttctcttcctcctgctactctggctcccagataccacgtggagaaattgtgatgacggcggtctccagccacctgtctgtgtcncgagggaancgccacctntctgcagggccagtcagngtgtagcagcaacgttacgcctcgtaaccgacgacaagaaaacttcgtcggaccgacggtccctacccggaggtccttccccgtactaacgttccttaatacggtactcgtacctaacgtaccgtaaaccgtacggggtaccctaccgtacgggaccctaacccccggtaaagtacccggtaaacgggtttcccgaacggggtttccggggaaaccgtacggggttacggggtttaccgtaacgggggtaacctaaacgggttaccctttaccggtaacccttaccgttacccggtaaacccgttaccgtaacggtaccgtaaacgttacgtaacgtacggtaccgtaacgtaacggtacgtttttacgacgtttaacgttttaagttaccgtacgtacgtacgtcgtaccgtaccgtttccgtaccgtacggtccgtaccgtcgtaccgggttacgggtaccggggtaacgtaggggtacgacgtacgtacgacgacgtagtcggtacggctcgacgtacatctgtcttacg

SEQ ID NO: 165313 - DNA, 705 bp, Homo sapiens
  misc_feature: GYAE6OF01EO5P4.44.73.G07.1.454.CMB.1.raw
  modified_base (215)..(215): a, c, t, g, unknown or other
  misc_feature (215)..(215): n is a, c, g, or t
  modified_base (243)..(243): a, c, t, g, unknown or other
  misc_feature (243)..(243): n is a, c, g, or t
  modified_base (252)..(252): a, c, t, g, unknown or other
  misc_feature (252)..(252): n is a, c, g, or t
  modified_base (688)..(688): a, c, t, g, unknown or other
  misc_feature (688)..(688): n is a, c, g, or t
tcagacagtatatacacgaccggtgctcgatttagctctacgctcaggggccctgggagcacagctcatcaccagtggactggacctggaggttcctctttgtggtggcagcaactacaggtgtccagtcccaggtgcgtctggtgcaatcgtggggctagaaatgaagacgccgtgggtcctcggtagaaggtctccgtgccgacggtcttcgngggtagctattcgttacaagtaaacttnttacttacncctaccgtggggtcacgacgccggtccctaggacgaagggtcttaggagtggagtgggtcggtcctacgtaccccttaggtttcgaacgtaacgacaacgtcgtacaacagtaacttccgaggcagacctactacgacgttaccggacgaacgtaactaccgaacgtgtacggactacgtacctaagtaacggtcgggaacgtaccgtaccggaccggaaccgtaacccgttagggaacgtacggtacggtaggaaccgggtaacgtacccgtacccttattacgttacgtcgacgaacgtaacgtaaatttaaaccgtttccgttaccgtttaggtttacggggacgttacgttacgtagtacgtcttaaggacgttagttacgggttacgggacgtaacggtattacggtcgtacctacggttacttccgtacncgtccgaccgtaaccgg

SEQ ID NO: 165314 - DNA, 310 bp, Homo sapiens
  misc_feature: GYAE6OF02HUC3R.44.73.G07.1.454.CMB.1.raw
  modified_base (303)..(310): a, c, t, g, unknown or other
  misc_feature (303)..(310): n is a, c, g, or t
tcagacagtatatacacgaccggtgctcgatttagctctacgctcagggggtctcaggaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtcagcccaaggccaaccccactgtcactctgttcccgccctcctctatatactgtctgagcgggctggcaaggcgcatagnnnnnnnn

SEQ ID NO: 165315 - DNA, 491 bp, Homo sapiens
  misc_feature: GYAE6OF02GC1MW.44.73.G07.1.454.CMB.1.raw
tcagacagtatatacacgaccggtgctcgatttagctctacgctcagggggatcaggactcctcagttcaccttctcacaatgaggctccctgctcagctcctggggctgctaatgctctgggtctcagggtccagtggagatattataatgactcagtctcccctctccctggccgtcacccctggagagccggcctccatctcctgtaggtctagtgagagtcttggaggtcagaacatctatgtggactggtacttgcagaagaccgggcagtctccacaactcctgatctatttgggttccactcgggcctccggggtctctgacaggttcagtgccagtgcatcacacacagatttcacactgcacatcagcagagtggaggctgacgatgttggggtctattactgcatccaagttctacaaccccgttcaccttcgggcaagggacacgacttgagattaagcgaactgtggctgcacatctcg

SEQ ID NO: 165316 - DNA, 565 bp, Homo sapiens
  misc_feature: GYAE6OF02GX8EZ.44.73.G07.1.454.CMB.1.raw
  modified_base (240)..(240): a, c, t, g, unknown or other
  misc_feature (240)..(240): n is a, c, g, or t
tcagacagtatatacacgaccggtgctcgatttagctctacgctcaggggccctgggagcacagctcatcaccatggactggacctggaggttcctcttgtggtggcagcaactacaggtgtccagtcccaggtgcgtctggtgcaatctggggctgaaatgaagaagcctgggtcctcggtgaaggtctcctgcacggcttctggaggcatcttcagaaactatcttatcacctgggtncgacaggccccctggaccaagggcttgagtggatgggtgggctcgtccccaattttggacaagcaaactacgcacagaaattccagggcagactcacgattaccgcggacgaatccacgagtgcagccctatatggagctgcgcaacctgagatctgaggacacggccctattatttctgtcgacgagaacaaaaatttacctaccctactttttgggaccggtagttagagtgcttatgtactagtttacggggcctaaagggtaccgtaagtcggtaccgtaccggttcgttacctttctaacggtccctaccctaaccccgg

SEQ ID NO: 165317 - DNA, 510 bp, Homo sapiens
  misc_feature: GYAE6OF02HHAO3.44.73.G07.1.454.CMB.1.raw
  modified_base (325)..(325): a, c, t, g, unknown or other
  misc_feature (325)..(325): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccgggggaacagccaccctctcttgcagggccggccagactgttgacgacgacttagcctggtaccaacagaagcctggccaggctcccagactcctcatctatgatacttctagtagggcctctggcatcccagcccgnttcagtggcagtgggtctgggacagacttcactctcaccatcaccagccctagacgcctagaagtattttgctagtttattactgtctacacgtaagaagtgcctccaatatcactttcggcctggaccaagtgatatacaaacgatgtgctgcaccatctgtcttcacttcttcccgctatctg

SEQ ID NO: 165318 - DNA, 651 bp, Homo sapiens
  misc_feature: GYAE6OF02HABE5.44.73.G07.1.454.CMB.1.raw
  modified_base (393)..(393): a, c, t, g, unknown or other
  misc_feature (393)..(393): n is a, c, g, or t
  modified_base (411)..(411): a, c, t, g, unknown or other
  misc_feature (411)..(411): n is a, c, g, or t
  modified_base (444)..(444): a, c, t, g, unknown or other
  misc_feature (444)..(444): n is a, c, g, or t
  modified_base (456)..(456): a, c, t, g, unknown or other
  misc_feature (456)..(456): n is a, c, g, or t
  modified_base (464)..(464): a, c, t, g, unknown or other
  misc_feature (464)..(464): n is a, c, g, or t
tcagacagtatatacacgaccggtgctcgatttagctctacgctcaggggaggaacgtgcctcacgttaggaccctacgaagggaaccattcggaagtcccgagctcagcttctcttacctcctgcgtactctcggctcccgagtaggatcaccggagtagtttactttggttgttgacctaacgaggttctcccaggtcctacccgttgtctttgtactccagggggtagaggtacgggccgacccttcgttcccgtcgggggttacgggccctaaggtccggtacgttcgttggcgtaacgtacctacgtcccgtaggtaccaaacgagtaaaccctcggaccaggtctccccaggcctccgtcactcgtatcgagtggctagtccaacgngggtcacgtggcaccccngtacagggttcaggtgcgagtgggtctgggacnggacttcagtcncgaccgtntagcaatcgtacagacctagaacgtactttacgactacgttattactgtcagcagtcgttcctaccaggccgctccgacgtttccgggacgggggacctaagggtaggtacgtacgtcgagacgaacgtacggtcggtactcgacaccgtagttcgttcggtcgttcgtacgttccgtcccgtcccg

SEQ ID NO: 165319 - DNA, 486 bp, Homo sapiens
  misc_feature: GYAE6OF02GV7JC.44.73.G07.1.454.CMB.1.raw
tcagacagtatatacacgaccggtgctcgatttagctctacgctcagggggatcaggactcctcagttcaccttctcacaatgaggctccctgctcagctcctggggctgctaatgctctgggtctcagggtccagtggagatattataatgactcagtctcccctctccctggccgtcacccctggagagccggcctccatctcctgtaggtctagtgagagtcttggaggtcagaacatctatgtggactggtacttgcagaagaccgggcagtctccacaactcctgatctattgggttccactcgggcctccggggtctctgacaggttcagtgccagtgcatcacacacagatttcacactgcacatcagcagagtggagctgacgatgttggggtctattactgcatccagttctacaacccgttcaccttcgggcaagggcacgactgagattagcgtaactgtggctgcaccatctcg

SEQ ID NO: 165320 - DNA, 523 bp, Homo sapiens
  misc_feature: GYAE6OF02I9TVW.44.73.G07.1.454.CMB.1.raw
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagaagcctgggtcctcggtgaaggtctcctgcacggcttctggaggcatcttcagaaactatcttatcacctgggtgcgacaggcccctggacaagggcttgagtggatgggtgggctcgtccccaattttggacaagcaaactacgcacagaaattccagggcagactcacgattaccgcggacgaatccacgagtgcagcctatatggagctgcgcaacctgagatctgaggacacggccctatatttctgcgcgagacaaaatttactacctacgttttgggcggtagtgatgcttatgtatagtttggggcctaagggacaagtggtcaccgtctcttcacgtcctcctaacccg

SEQ ID NO: 165321 - DNA, 639 bp, Homo sapiens
  misc_feature: GYAE6OF02F2PRA.44.73.G07.1.454.CMB.1.raw
  modified_base (475)..(475): a, c, t, g, unknown or other
  misc_feature (475)..(475): n is a, c, g, or t
  modified_base (635)..(635): a, c, t, g, unknown or other
  misc_feature (635)..(635): n is a, c, g, or t
tcagacagtatatacacgaccggtgctcgatttagctctacgctcaggggagaactaggctcagttaggacccagagggtaaccatggaagccccagactcagcgttctcttcctcctgcttactcctggctcccagattccacccggcgaaattgtagttgtacactaactcctccagcctaccctggtcctttcgtctccgggggaactagcctacccgtcgtacttgcagggccgccagactgttcgacgacgacttagcctggtaccacacgaagcctggccacggctccagactccgtcactctagtcgtacttacttctaggtacgggccttcgtcgggacctaactccccgacggaccccgtcgtttccgaacggttcggcccagggttcgggtcctacgggactacggtacttcgaccgttccgtacaccactaccgacccacgtcctacgacgtcctagaacgttnttttacggagttttactcttaggtcttaacgacgtaagtagtcgtacctactaattctactacttcgacctaggacctaaggtgattacgtactaaacgtaactgttcgactgtaccaacgtactcgtcgttcttacgacttccgttccgactctacgtntacg

SEQ ID NO: 165322 - DNA, 512 bp, Homo sapiens
  misc_feature: GYAE6OF02GJNTU.44.73.G07.1.454.CMB.1.raw
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagaagcctgggtcctcggtgaaggtctcctgcacggcttctggaggcatcttcagaaactatcttatcacctgggtgcgacaggccccctggacaagggcttgagtggatgggtgggctcgtccccaattttggacaagcaaactacgcacagaaattccagggcagactcacgattaccgcggacgaatccacgagtgcagcctatatggagctgcgcaacctgagatctgagacacggccctatatttctgcgcgagacaaaattactacctacttttggcgtagtgatgcttatgtattagttgggctaaggacaagtgtcacgtctcttcacgtcctcaacccg

SEQ ID NO: 165323 - DNA, 504 bp, Homo sapiens
  misc_feature: GYAE6OF02JAWJJ.44.73.G07.1.454.CMB.1.raw
  modified_base (330)..(330): a, c, t, g, unknown or other
  misc_feature (330)..(330): n is a, c, g, or t
tcagacagtatatacacgaccggtgctcgatttagctctacgctcagggggatcaggactcctcagttcaccttctcacaatgaggctccctgctcagctcctggggctgctaatgctctgggtctcagggtccagtggagatattataatgactcagtctcccctctccctggccgtcacccctggagagccggcctccatctcctgtaggtctagtgagagtcttggaggtcagaacatctatgtggactggtacttgcagaagaccgggcagtctccacaactcctgatctatttgggttccactcgggcctccggggtctctgacnggttcagtgccagtgcatcacacacagtatttcacactgcacatcagcagagtggaggctggacgagtggttggggtcttagttactgcatcctaagttctaacctaaccccgttcaccgttcgggcaagggacacgtacttgagattaagcgaactgtgctgcacctatctcg

SEQ ID NO: 165324 - DNA, 521 bp, Homo sapiens
  misc_feature: GYAE6OF02INZ01.44.73.G07.1.454.CMB.1.raw
  modified_base (309)..(309): a, c, t, g, unknown or other
  misc_feature (309)..(309): n is a, c, g, or t
  modified_base (385)..(385): a, c, t, g, unknown or other
  misc_feature (385)..(385): n is a, c, g, or t
  modified_base (442)..(442): a, c, t, g, unknown or other
  misc_feature (442)..(442): n is a, c, g, or t
  modified_base (481)..(481): a, c, t, g, unknown or other
  misc_feature (481)..(481): n is a, c, g, or t
tcagacagtatatacacgaccggtgctcgatttagctctacgctcagggggggaactgctcagttaggacccagagggaaccatggaagccccagctcagcttctcttcctcctgctactctggctcccagattccaccggcgaaattgtgttgacacaatctccagccaccctgtctttgtctccgggggaacagccaccctctcttgcagggccggccagactgttgacgacgacttagcctggtaccaacagaagcctggccaggctcccagactcctcatctatgatacttctagtagggccctntggcatcccagccccgcttcagtggcagtgggtctggggacagacttcactctcaccatccaccagccctaaggcncctagaagtattttgctagtttattactgtctacaccgtagaagtgcctcatattcncttcgcctacggacaagtgatatacaaacaactgtgctnacacatctgtcttctacttccttcccgcctactctagtac

SEQ ID NO: 165325 - DNA, 527 bp, Homo sapiens
  misc_feature: GYAE6OF02F4TWE.44.73.G07.1.454.CMB.1.raw
  modified_base (373)..(373): a, c, t, g, unknown or other
  misc_feature (373)..(373): n is a, c, g, or t
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagaagcctgggtcctcggtgaaggtctcctgcacggcttctggaggcatcttcagaaactatcttatcacctgggtgcgacaggcccctggacaagggcttgagtggatgggtggctcgtcccaattttggacaagcaaactacgcacagaattccagggcagactcacgattaccgcggacgaatccacgagtgcagcctatatgganctgcgcaacctgagatcgtgaggacacggccctatatttctgcgcgagactaaaatttactacctacttttgggcggtagtgatgtcttatgtattagttgggtccgaagggtactaagtcggtacaccgttctccttcacgtcctccaacccg

SEQ ID NO: 165326 - DNA, 507 bp, Homo sapiens
  misc_feature: GYAE6OF02G4DRN.44.73.G07.1.454.CMB.1.raw
  modified_base (397)..(397): a, c, t, g, unknown or other
  misc_feature (397)..(397): n is a, c, g, or t
  modified_base (414)..(414): a, c, t, g, unknown or other
  misc_feature (414)..(414): n is a, c, g, or t
tcagacagtatatacacgaccggtgctcgatttagctctacgctcagggggatcaggactcctcagttcaccttctcacaatgaggctccctgctcagctcctggggctgctaatgctctgggtctcagggtccagtggagatattataatgactcagtctcccctctccctggccgtcacccctggagagccggcctccatcctcctgtaggtctagtgagagtcttggaggtcagaacatctatgtggactggtacttgcagaagaccgggcagtctccacaactcctgatctagtttgggtccactcgggcctccggggtctcgtgacaggttcagtcgccagtgcatcacacacagtattcacactgcacatcagcagagtggaggctgacgngtggttgggtctattcngcatccaagttccaacgtaacccgttcaccgttcggacaagggacacgtactagaagtattaagcgtaactggtacggctgacacctatctcg

SEQ ID NO: 165327 - DNA, 514 bp, Homo sapiens
  misc_feature: GYAE6OF02IJ4GY.44.73.G07.1.454.CMB.1.raw
  modified_base (326)..(326): a, c, t, g, unknown or other
  misc_feature (326)..(326): n is a, c, g, or t
  modified_base (422)..(422): a, c, t, g, unknown or other
  misc_feature (422)..(422): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccgggggaacgagccaccctctcttgcagggccggcagactgttgacgacgacttagcctggtaccaacagaagcctggccaggctcccagactcctcatctatgatacttctagtagggcctctggcatccccagcccgnttcagtggcaggtgggtctgggacagacttcactctcaccatcaccagcctagcgcctgaagtattttgctagtttattactgtctacaccgtaanaagtgcctcaatatcacttcggcctggaccaaagtgatatacaaacgactgtggctggcaccatctgtcttcacttccttcccgcctatctg

SEQ ID NO: 165328 - DNA, 666 bp, Homo sapiens
  misc_feature: GYAE6OF02HUMFW.44.73.G07.1.454.CMB.1.raw
  modified_base (207)..(207): a, c, t, g, unknown or other
  misc_feature (207)..(207): n is a, c, g, or t
  modified_base (228)..(228): a, c, t, g, unknown or other
  misc_feature (228)..(228): n is a, c, g, or t
  modified_base (234)..(234): a, c, t, g, unknown or other
  misc_feature (234)..(234): n is a, c, g, or t
  modified_base (244)..(244): a, c, t, g, unknown or other
  misc_feature (244)..(244): n is a, c, g, or t
tcagacagtatatacacgaccggtgctcgatttagctctacgctcagggccctgggagcacagctcatcaccatggactggacctggaggttcctctttgtggtggcagcaactacaggtgtccagtcccaggtgcgtctggtgcaatctggggctgaatgaagaagcctgggtcctggtgaaggtctccgtgccgacggtcttcgngggagcatcttcagtaaactntcttancacctgggtncgacgaggcccctaggacaagggcttaggagtggagtgggtggctcgtaccctagtttcggacaagcaaactcgcaacagaaacttccgagggcacgtactcaacgtacttaccgacggaacgaactccgaacggagtacggaccacgaccttaatacgtcgggataccgtgacgaccaaccgtgaacgactacgtacggaacggaccgaccggtaccttaagttaacgtttcgtacgccggtaacgaacgaaaccttaaaacgtttaaccttaccgttaacgttttacggggaccggttaacggttacgtaacgttgtaacgtttagtagttagttacggtttacggggaccgttaaagggtacgtaacggttacggtaccgttacgttccttcgttacgtacgtcccgtaccctaaccgg

SEQ ID NO: 165329 - DNA, 284 bp, Homo sapiens
  misc_feature: GYAE6OF02FZO1H.44.73.G07.1.454.CMB.1.raw
  modified_base (283)..(284): a, c, t, g, unknown or other
  misc_feature (283)..(284): n is a, c, g, or t
tcagacagtatatacacgaccggtgctcgatttagctctacgctcaggggtcccggatcggttctctggctccaagtctggcaacacggcctccctgaccgtctctgggctccaggctgacgatgaggctgattattactgcagctccgatggaggcacctatgatttgcttttcggcggagggaccagactgaccgtcctaggtcagcccaaggctgcccctcggtcactctgttcccacctcctctatatactgtctgagcgggctggcaaggcgcatagnn

SEQ ID NO: 165330 - DNA, 535 bp, Homo sapiens
  misc_feature: GYAE6OF02HV8JZ.44.73.G07.1.454.CMB.1.raw
  modified_base (303)..(303): a, c, t, g, unknown or other
  misc_feature (303)..(303): n is a, c, g, or t
  modified_base (398)..(398): a, c, t, g, unknown or other
  misc_feature (398)..(398): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagataccaccggagagattgtgttgacgcagtctccagccaccctgtctttgtctccaggggaaagagccaccctctcctgcagggccagtcagagtgttagcagctacttagcctggtaccaacagaaacctggccaggctcccaggctcctcatctatggtgcatccaacnggggccactggcatcccagacaggttcagtggcaggtgggtctgggacagacttcactctcaccatcagcagcctggagcctagaagtattttgngtatgttattactgtctatttcattcgttcccttaccttcgtaacttttcggaccgtacgggtacctaaacgtaggaaactacgaaacgtactaggtcggcttacgcaccatctgtccttcacttccttccgcctac

SEQ ID NO: 165331 - DNA, 583 bp, Homo sapiens
  misc_feature: GYAE6OF02G5CB1.44.73.G07.1.454.CMB.1.raw
  modified_base (369)..(369): a, c, t, g, unknown or other
  misc_feature (369)..(369): n is a, c, g, or t
  modified_base (373)..(373): a, c, t, g, unknown or other
  misc_feature (373)..(373): n is a, c, g, or t
  modified_base (378)..(378): a, c, t, g, unknown or other
  misc_feature (378)..(378): n is a, c, g, or t
  modified_base (395)..(395): a, c, t, g, unknown or other
  misc_feature (395)..(395): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccgggggaacagccaccctctcttgcagggccggccagactgttgacgacgacttagcctggtaccaacagaagcctggccaggcctcccagactcctcatctatgatacttctagtagggcctcgtggccactccccagccccgcttcaggtggcaggtgggtctgggacagtacttcactcncacntcacngcctagcgctagaagtnttttgacttagtttattacgtgtactaacacgttaagaagtcgacctaccaattattccgactttccggccctagggaacctaaaggtcgataactacaaacgtaactgtacgacgttacgacctaacctacttaccgttcgttaccgtttaccacgtttcccgtttaccccgacttacgtcctaacg

SEQ ID NO: 165332 - DNA, 551 bp, Homo sapiens
  misc_feature: GYAE6OF02JNOFP.44.73.G07.1.454.CMB.1.raw
tcagacagtatatacacgaccggtgctcgatttagctctacgctcagggggaactgctcagttaggacccagagggaaccatggaagccccagctcagcttctcttcctcctgctactctggctcccagagatcaccggagatattgtgttgacacaatctccagccaccctgtctttgtctccgggggaacagccaccctctcttgcagggccgccagactgttgacgacgacttagcctggtaccaacagaagcctggccaggcctcccagactcctcatctatgatacttctagtacggcctctggcactccccagccccgtcttcgaggtcggcaggtcgggtctggggacagtaccttcgactcgtcacctatccaacctagcctaaggacgacctgtaagtattttgctagtttatactgtctacgtaccgtaagacgtcggtacctactaatacttctactttcggcccgtaggacctaagtcgtatactacgaaacgtactgtcgtctcgacactactctgtcttacacttcctaccgctatc

SEQ ID NO: 165333 - DNA, 582 bp, Homo sapiens
  misc_feature: GYAE6OF02INEHM.44.73.G07.1.454.CMB.1.raw
  modified_base (302)..(302): a, c, t, g, unknown or other
  misc_feature (302)..(302): n is a, c, g, or t
  modified_base (332)..(332): a, c, t, g, unknown or other
  misc_feature (332)..(332): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccgggggaacgagccaccctctcttgcagggccggccagactgttgacgacgacttagcctggtacccaacagaagcctggcccaggcctcccagacctcctcatctatgatacttntaggtagggcctctggcatcccagccccgnttccagtggcaggtgggtctgggcagacttcactctcaccatccacacgcctagacgtcctagaagtattttgctagtttattactgttactacaccgtacaaagagtcggccctaccgaattacttctacttttccgggcccttagggacctaagtcggtaatactacaaacgtaactagtcggacgtcgaccaccgtaacttcgttcgttacctttactacttcccgtttaccccctaccgtattacc

SEQ ID NO: 165334 - DNA, 531 bp, Homo sapiens
  misc_feature: GYAE6OF02GCMPD.44.73.G07.1.454.CMB.1.raw
  modified_base (293)..(293): a, c, t, g, unknown or other
  misc_feature (293)..(293): n is a, c, g, or t
  modified_base (322)..(322): a, c, t, g, unknown or other
  misc_feature (322)..(322): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccgggggaacagccaccctctcttgcagggccggccagactgttgacgacgacttagcctggtaccaacagaagcctggccaggctcccagactcctcatctatggtncatccagcagggcctctggcatcccgganggttcagtggcagtgggtctgggacagacttcactctcacatcagcagactggagcctagaagtattttgctagtgttatactgtcagcagtatgcttactctacctctcgtacgttccggaccgtaagggaccaaggtaggaaacgtacgaaacgacgtaggtcggacgtgacctactagtctcgtacttacacttccttcccgtacc

SEQ ID NO: 165335 - DNA, 555 bp, Homo sapiens
  misc_feature: GYAE6OF02FKSPU.44.73.G07.1.454.CMB.1.raw
  modified_base (295)..(295): a, c, t, g, unknown or other
  misc_feature (295)..(295): n is a, c, g, or t
tcagacagtatatacacgaccggtgctcgatttagctctacgctcagggggatcaggactcctcagttcaccttctcacaatgaggctccctgctcagctcctggggctgctaatgctctggatccctggacccagtgcagatgttgtgctgacccagactcccctctctctgtccgtcacccctggacagccggcctccatgtcctgcaagtctagtcagagcctcctgcatagtgatggaaagacatatttgtactggtacctgcagaggtcaggccagtctccgcagctccncatctatgattcttcagcgcctctctggatcgccagattaggttcagtggcaggcgggtacggggacaggatttcacacgtagaaaactcgaggccggggtaggacggcgtaggaggtagttggttaggtaatttagttactgtacagttgacgtaaggtctagttccgtacgtttcccccggaccgtttccggacccgtaacggggtaccgtaggggtacggaaacgttcgaaacggccggtaacgtggtacggtaccg

SEQ ID NO: 165336 - DNA, 529 bp, Homo sapiens
  misc_feature: GYAE6OF02IQRXZ.44.73.G07.1.454.CMB.1.raw
  modified_base (241)..(241): a, c, t, g, unknown or other
  misc_feature (241)..(241): n is a, c, g, or t
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagaagcctgggtcctcggtgaaggtctcctgcacggcttctggaggcatcttcagaaactatcttatcacctgggtncgacaggcccctggacaagggcttgagtggatgggtgggctcgtccccaattttggacaagcaaactacgcacagaaattccagggcagactcacgattaccgcggacgaatccacgagtgcagcctatatggagctgagcgaggctgagatcgtagaagacacggccatctatttctgtgcgagacgccctcgtctaactttcatacgtccctctctatacgtccactacatacggtaaattcggttaccgacccgtcggggaccacgggtaccctggtcctacccg

SEQ ID NO: 165337 - DNA, 706 bp, Homo sapiens
  misc_feature: GYAE6OF02FHYXR.44.73.G07.1.454.CMB.1.raw
tcagacagtatatacacgaccggtgctcgatttagctctacgctcaggggaggaactgctcagttaggacccagagggaaccatggaagccccagctcagcttctcttcctcctgctactctggctcccagataccaccggggaaattgtgttgacacaatctccagccaccctgtctttgtctccaggggaaagagccaccctctcctgcagggccagtcagagtgttaggactactagcctggtatcaacagacacctgccaggctcccaggctcctcatctatgatgcatcaatagggccgcggcacgtcccagccaggttcagtggcaggtgggtctggacgacagacttcactctaccaccatccaacggccggaccgtaaggacggaccgggtaaagtacgtttttacgacttaacggtttttaacttaccgttacgtacccgtaaaccgtacccggttaacggtacccggtacgttcgggtacccgttaacggggtttaaccgttacgggttttaccggggaaccccggtaaacggggggtaaccctaaacgggtcccggttaacgggtaacggtaccgttaacccgaaaaaccggtaacgttacgggttcggggaaccttcggaaccctaacccgtacgtttccgttacggttaccctttacccgaaccgtttccccgttccccggtacccttaaccg

SEQ ID NO: 165338 - DNA, 517 bp, Homo sapiens
  misc_feature: GYAE6OF02HQ7FS.44.73.G07.1.454.CMB.1.raw
  modified_base (284)..(284): a, c, t, g, unknown or other
  misc_feature (284)..(284): n is a, c, g, or t
  modified_base (379)..(379): a, c, t, g, unknown or other
  misc_feature (379)..(379): n is a, c, g, or t
  modified_base (388)..(388): a, c, t, g, unknown or other
  misc_feature (388)..(388): n is a, c, g, or t
  modified_base (396)..(396): a, c, t, g, unknown or other
  misc_feature (396)..(396): n is a, c, g, or t
  modified_base (473)..(473): a, c, t, g, unknown or other
  misc_feature (473)..(473): n is a, c, g, or t
  modified_base (492)..(492): a, c, t, g, unknown or other
  misc_feature (492)..(492): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccgggggaacgagccaccctctcttgcagggccggccagactgttgacgacgacttagcctggtaccaacagaagcctggccaggctcccaggctcctnatctatggtgcatccaccaggggcctcgtggcatccccagccccgcttcagtcggcaggtgggtctggggacagacttcactctcaccatccacngcctagacnctgaagtnttttgctagtttatactgtactacaccgtaagtaagtggcctacaatacttcactttcgcctggaaccaagtgatancaacgatgtggctgcactntctgtcttcacttccttccgctatc

SEQ ID NO: 165339 - DNA, 555 bp, Homo sapiens
  misc_feature: GYAE6OF02JMKMY.44.73.G07.1.454.CMB.1.raw
  modified_base (306)..(306): a, c, t, g, unknown or other
  misc_feature (306)..(306): n is a, c, g, or t
  modified_base (348)..(348): a, c, t, g, unknown or other
  misc_feature (348)..(348): n is a, c, g, or t
  modified_base (371)..(371): a, c, t, g, unknown or other
  misc_feature (371)..(371): n is a, c, g, or t
  modified_base (518)..(518): a, c, t, g, unknown or other
  misc_feature (518)..(518): n is a, c, g, or t
tcagacagtatatacacgaccggtgctcgatttagctctacgctcagggggaacgtgctcagttaggacccagagggaaccatggaagcccagctcagcttctcttcctcctgctactctggctcccagattccaccggcgaaattgtgttgacacaatctccagccaccctgtctttgtctccgggggaacagccaccctctcttgcagggccgccagctgtgacgacgacttagcctggtacccaacagaagcctggccaggcctcccagactcctcatctatgatactctaggtacggcctcnggcactcccaggccccgcttcaggttggccaggtgggttccnggggaccagacttcactctcacntccaccagccctagacgcctagaagtatttacgcttacgtttattactcgttactactaccgtaagtacgtcgtcctacaatacttctactttcgacccgtaggacctaaacgtggtactatcaaacgtactagtcgctagctaacntctgttactctactccttcccgactactccttagtac

SEQ ID NO: 165340 - DNA, 663 bp, Homo sapiens
  misc_feature: GYAE6OF02G5TOD.44.73.G07.1.454.CMB.1.raw
  modified_base (380)..(380): a, c, t, g, unknown or other
  misc_feature (380)..(380): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccgggggaacgagccaccctctcttgcagggccgccagactgttgacgacgacttagcctggtaccaacagaagcctggccaggctcccagactcctcatctatgattacttctagtacgggcctcgtggcactcccagcccgtcttcgagtggcaggtcgggtctggacagtacttcactctcacctatcaccngacctagacgtcctagaacgttagttttcgacttagttttaacttaccgttagttaccttaaccgaaccggttaaaggtacgttacggtaccccttaccaaactttacgttacctacgtttaccggaccccgttacgggtaaaccgtaaaggttcgggtaacttaacgtaaaccgaaaacgtaacgttagggtcggtacgttacgtaccgtaacctacgttaccgttacgtttacctttacgtacctttcccgttacccccgtaccgttacgttcccgttaag

SEQ ID NO: 165341 - DNA, 519 bp, Homo sapiens
  misc_feature: GYAE6OF02HZYNW.44.73.G07.1.454.CMB.1.raw
  modified_base (195)..(195): a, c, t, g, unknown or other
  misc_feature (195)..(195): n is a, c, g, or t
  modified_base (296)..(296): a, c, t, g, unknown or other
  misc_feature (296)..(296): n is a, c, g, or t
  modified_base (307)..(307): a, c, t, g, unknown or other
  misc_feature (307)..(307): n is a, c, g, or t
  modified_base (323)..(323): a, c, t, g, unknown or other
  misc_feature (323)..(323): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgctccgggggaacngccacctctcttgcagggccggccagactgttgacgacgacttagcctggtaccaacagaagcctggccaggctcccagacctcctcatctatgatacttntagtaggcctntggcatcccagcccgnttcagtggcaggtgggtctgggacagtacttcactctcaccatcaccagcctagacgcctagaagtattttgactagtttattactgtctacaccgtaagaagtgctacatatcacttcggcctggacctaagtgatactacaaacgtatgtagctagcacctatctgttcttcacttccttcccgctactctacg

SEQ ID NO: 165342 - DNA, 530 bp, Homo sapiens
  misc_feature: GYAE6OF02GUQNJ.44.73.G07.1.454.CMB.1.raw
  modified_base (475)..(475): a, c, t, g, unknown or other
  misc_feature (475)..(475): n is a, c, g, or t
  modified_base (502)..(502): a, c, t, g, unknown or other
  misc_feature (502)..(502): n is a, c, g, or t
tcagacagtatatacacgaccggtgctcgatttagctctacgctcagggggagtaactgctcagttaggacccagagggaaccatggaagccccagctcagcttctcttcctcctgctactctggctcccagattccaccggcgaaattgtgttgacacaatctccagccaccctgtctttgtctccgggggaacgagccaccctctcctgcagggccagtcagagtgttaggaactacttagcctggtatcaacagacacctggccaggctcccaggctcctcatctatgatgcatccaagtacgggccgcgggcatcccagcccaggttcaggtggcaggtggtctgagacagacttcactctcacatcagcggcctagacgccggaagtagttttgacttagtttacttactgtacaacgaccgtagcgactggcctaggtactagtttggaccgaggggaccagcgtggancgtacgaaacgtactgtggctgacacntctcgttcttcacttccttcccgctacg

SEQ ID NO: 165343 - DNA, 545 bp, Homo sapiens
  misc_feature: GYAE6OF02H6D9K.44.73.G07.1.454.CMB.1.raw
  modified_base (239)..(239): a, c, t, g, unknown or other
  misc_feature (239)..(239): n is a, c, g, or t
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagaagcctgggtcctcggtgaaggtctcctgcacggcttctggagcatcttcagaaactatcttatcactgggtncgacaggcccctggacaagggcttgagtggatggtgggctcggtccccaattttggactaagcaaactacgcacagaaattccagggcagactcacgattaccgcggacgaatccacgagtgacagcctatatggagctgcgcaacctgagatctgacggacacggcctatatttctgcgcgagaactaaaatttacctacctacgtttttgggacgtagtgtatgacttagtgtagttagtttggggccgtaagggtacaagttcggtacgtaccgttctccgttcacgtccctacctaacccgg

SEQ ID NO: 165344 - DNA, 614 bp, Homo sapiens
  misc_feature: GYAE6OF02JJLM7.44.73.G07.1.454.CMB.1.raw
  modified_base (233)..(233): a, c, t, g, unknown or other
  misc_feature (233)..(233): n is a, c, g, or t
  modified_base (265)..(265): a, c, t, g, unknown or other
  misc_feature (265)..(265): n is a, c, g, or t
  modified_base (389)..(389): a, c, t, g, unknown or other
  misc_feature (389)..(389): n is a, c, g, or t
  modified_base (393)..(394): a, c, t, g, unknown or other
  misc_feature (393)..(394): n is a, c, g, or t
  modified_base (437)..(437): a, c, t, g, unknown or other
  misc_feature (437)..(437): n is a, c, g, or t
tcagacagtatatacacgaccggtgctcgatttagctctacgctcagggggatcaggactcctcagttcaccttctcacaatgaggctccctgctcagctcctggggctgctaatgctctggctcccaggttcgagatgtgacatcgagatgacccagtctccttccttcctgtcttcttctgttggaggcagcgtcaccatcacttgccgggcgagtcaggtcgttttcggngctgttgcctggtttcaaacgaaaaggggganaggcccctaaggtcctcgtctctcgtagaaccagactggaaggtagagtcccgtccaggttcagtgccagtccaggtggtgggccggagtccactctcacattacgcgacctgcggcctgaagnttcnnctaacttatttctgtcagcagtactcattagtcgtccccgttntaccgttttgggaccgtaaggggtacccaaggtccgttaagggtaaaccttaccgaaaaaccggtaaacgttggtacgggtaccttacgacctacccgtaagttccttacggttaccctttccgaacctttcccgtttcccccggtacccttaacgttccttacggtaactttaacg

SEQ ID NO: 165345 - DNA, 547 bp, Homo sapiens
  misc_feature: GYAE6OF02FS3L8.44.73.G07.1.454.CMB.1.raw
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagaagcctgggtcctcggtgaaggtctcctgcacggcttctggaggcatcttcagaaactatcttatcacctgggtgcgacaggcccctggacaagggcttgagtggatgggtgggctcgtccccaattttggacaagcaaactacgcacagaaattccagggcagactcacgattaccgcggacgaatccacgagtgcagcctatatggagctgcgcaacctgagatctgaggacacggccctatactttctgcgcgagaactaaaaatttacctactacgtttttagggcggtagtagatgtcttagtgtattagtttggggacctaagggtacaagttcggtaccgtaccgttcgtccgttcacgtccctcctaacccgg

SEQ ID NO: 165346 - DNA, 529 bp, Homo sapiens
  misc_feature: GYAE6OF02G1HP1.44.73.G07.1.454.CMB.1.raw
  modified_base (429)..(429): a, c, t, g, unknown or other
  misc_feature (429)..(429): n is a, c, g, or t
tcagacagtatatacacgaccggtgctcgatttagctctacgctcaggggccctgggagcacagctcatcaccatggactggacctggcggttcctctttgtggtggcagcagctacaggtgtccagtcccaggtgcagctggtgcagtctggggctgaggtgaagaagcctgggtcctcggtgaaggtctcctgcaaggcttctggaggcaccttcttcagctatgtctttttatttggggtgcgacaggcccctggacaagggcttgagtggcgtgggagggatcgatccctattctttggtgcatcgaattacgcacagtaagtttcaggacagagtcacattaccgacggacaactccacgacgtacagcctacagtggagctagagcaggctagagatcgtagaagacacgctatctatttcgngtgcgagacgcctcgtactaactttcattacgtccctctctactcgtcccactactagtaggtaacttcggtaccgacccggtgggaccgacggtacccg

SEQ ID NO: 165347 - DNA, 539 bp, Homo sapiens
  misc_feature: GYAE6OF02HHB67.44.73.G07.1.454.CMB.1.raw
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagaagcctgggtcctcggtgaaggtctcctgcacggcttctggaggcatcttcagaaactatcttatcacctgggtgcgacaggcccctggacaagggcttgagtggatgggtgggctcgtccccaattttggacaagcaaactacgcacagaaattccagggcagactcacgattaccgcggacgaatccacgagtgcagcctatatggagctgcgcaacctgagatctgaggacacggccctatatttctgcgcgagacaaaatttacctacctacgttttgggcggtagttgatgtcttatagtattagtttggggcctaagggtactaagttggtactaccgttcttccttcgacgtccctcctaacccgg

SEQ ID NO: 165348 - DNA, 659 bp, Homo sapiens
  misc_feature: GYAE6OF02IL6K5.44.73.G07.1.454.CMB.1.raw
  modified_base (409)..(409): a, c, t, g, unknown or other
  misc_feature (409)..(409): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagcccaccctgtctttgtcctccgggggaacagccaccctctcttgcagggccgccagactgtgacgacgacttagcctggtaccaacagaacgcctaggccaggcctcccagacctcctcatctatgatacttcagtacggcctgtggcactcccgagccccgtcttcagtcggctaggtgggtctagggacaacgactttccgacttctaccaacctatccaacctaggccctaaggaccnccgtagaagttatttgactacgttttattactgttacctaacgtaccgtaaagtaacgtcggaccttacctaaattacgttcctaaccgtttccggtacccgtacgggtaaaccctaaacgggttacggtaactaacgttaaccaaaaccgtaacgttacgggtacggtaccttcggaacctaaccctagttaccgttacgttacctttacctaacgttcccctttaccccggacttacttaccgttacg

SEQ ID NO: 165349 - DNA, 491 bp, Homo sapiens
  misc_feature: GYAE6OF02JEZ9H.44.73.G07.1.454.CMB.1.raw
  modified_base (411)..(411): a, c, t, g, unknown or other
  misc_feature (411)..(411): n is a, c, g, or t
  modified_base (444)..(444): a, c, t, g, unknown or other
  misc_feature (444)..(444): n is a, c, g, or t
tcagacagtatatacacgaccggtgctcgatttagctctacgctcagggggatcaggactcctcagttcaccttctcacaatgaggctccctgctcagctcctggggctgctaatgctctgggtctcagggtccagtggagatattataatgactcagtctcccctctccctggccgtcacccctggagagcccggcctccatctcctgtaggtctagtgagagtcttggaggtcagaacatctatgtggactggtacttgcagaagaccgggcagtctccacaactcctgatctatttgggtccactcgggcctccggggtctctgacaggttcagtgccagtgcatcacacacagatttcacactgcacatcagcagagtggaggctgacgatggttgggtctattacngcatccagttctacaacccgttcaccttcgganaacgggacacgtatgagtattagcgtaactgtggctgcaccatctcg

SEQ ID NO: 165350 - DNA, 551 bp, Homo sapiens
  misc_feature: GYAE6OF02HBVPO.44.73.G07.1.454.CMB.1.raw
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagaagcctgggtcctcggtgaaggtctcctgcacggcttctggaggcatcttcagaaactatcttatcacctgggtgcgacaggcccctggacaagggcttgagtggatgggtgggctcgtccccaattttggacaagcaaactacgcacagaaattccagggcagactcacgattaccgcggacgaatccacgagtgcagccctatatggagctgcgcaacctgagatctgacggacaccggccctagttactttctgcgacgagaactaaaatttacctaccttacgtttttgggacggtagttgatgtacttatgtattagtttggggtacaagggtacgaagtggtactaccggttcttcgttcacgtccctcccgaacccgg

SEQ ID NO: 165351 - DNA, 495 bp, Homo sapiens
  misc_feature: GYAE6OF02H0P9V.44.73.G07.1.454.CMB.1.raw
  modified_base (412)..(412): a, c, t, g, unknown or other
  misc_feature (412)..(412): n is a, c, g, or t
  modified_base (438)..(438): a, c, t, g, unknown or other
  misc_feature (438)..(438): n is a, c, g, or t
tcagacagtatatacacgaccggtgctcgatttagctctacgctcagggggatcaggactcctcagttcaccttctcacaatgaggctccctgctcagctcctggggctgctaatgctctgggtctcagggtccagtggagatattataatgactcagtctcccctctccctggccgtcacccctggagagccggcctccatctcctgtaggtctagtgagagtcttggaggtcagaacatctatgtggactggtacttgcagaagaccgggcagtctccacaactcctgatctatttgggttccactcgggcctccggggtctctgacaggttcagtgccagtgcatcacacacagatttcacactgcacatcagcagagtggaggctgacgagtgttggggtctattacngcatccaagttctaacaaccccgttnaccttcgggcaaggacacgtactgagtaattaagcgaactggtggctgcacatctcg

SEQ ID NO: 165352 - DNA, 550 bp, Homo sapiens
  misc_feature: GYAE6OF02HUEJE.44.73.G07.1.454.CMB.1.raw
tcagacagtatatacacgaccggtgctcgatttagctctacgctcagggggatcaggactcctcagttcaccttctcacaatgaggctccctgctcagctcctggggctgctaatgctctgggtctcagggtccagtggagatattataatgactcagtctcccctctccctggccgtcacccctggagagccggcctccatctcctgtaggtctagtgagagtcttggaggtcagaacatctatgtggactggtacttgcagaagaccgggcagtctccacaactcctgatctatttgggttccacgtcgggcctccggggtctctgacaggttcagtgccagtgcatcacacacagtatttcacactgcacatcagcagagtggaggctggacgtagttggttggggttctagttacgtgactacttaccaagtttacctaacccgtaaaccccgttcctaacccgttcggaccgtaagggaccaccggtacttaggacgtaagttaacggcgtaacgtggtcggctacgaccaccgtattccttcgg

SEQ ID NO: 165353 - DNA, 625 bp, Homo sapiens
  misc_feature: GYAE6OF02GVU63.44.73.G07.1.454.CMB.1.raw
  modified_base (273)..(273): a, c, t, g, unknown or other
  misc_feature (273)..(273): n is a, c, g, or t
tcagacagtatatacacgaccggtgctcgatttagctctacgctcagggggatcaggactcctcagttcaccttctcacaatgaggctccctgctcagctcctggggctgctaatgctctgggtctcagggtccagtggagatattataatgactcagtctcccctctccctggccgtcacccctggagagccggcctccatctcctgtaggtctagtgagagtcttggaggtcagaacatctatgtggactggtacttgcagaagaccgggnagtctccacaactcctgatctatttgggtccacgtcgggcctccggggtctctgacaggttcagtgccagtcgcatcacacacagtactttcacactgacacatcagcaggagtgggaggtctaggaacgtagttgggttcggggttacttaagttacgtcgacctaacgttaccctaaacgtttacctaaacccgtaaacccccgtttccgtaaccccggtttacgggaaccgtaaacggggtaaccgtaaccggttacgttacggaacggttaaacgttaaacgggaccgttaaacgttcgggtacggtaccgttacggtacccgtaacccgttacgttaccgtttacgg

SEQ ID NO: 165354 - DNA, 628 bp, Homo sapiens
  misc_feature: GYAE6OF02G8BWZ.44.73.G07.1.454.CMB.1.raw
tcagacagtatatacacgaccggtgctcgatttagctctacgctcagggggagtaactgctcagttaggacccagagggaaccatggaagccccagctcagcttctcttcctcctgctactctggctcccagattccaccggcgaaattgtgttgacacaatctccagccaccctgtctttgtcgtccgggggaacagccaccctctcctgcagggccagtcagagtgttaggaactacttagcctggtatcaacagacacctggccaggctcccaggctcctcatctatgatgcataccaagtacgggccgcgggccacgtcccgagcctagggttccaggtcggcctaggtgggtctggaacgacgagtaaccttcaaccgttcctacgaaccctatccgacggaccggtcccgtaggacggaccggtaaagtacgttttgacgttaagtttattacgttcgtacctaacgtaccgtagaccgtcgtacggaccgttaaggttacgtacggttttacgggaccggtacggggtaacccgtaaggtcgtgggtacgacgtacgaaacgtacgttggtacggcgttacgacgacctagttcctagttcttacacttccttcccgactc

SEQ ID NO: 165355 - DNA, 549 bp, Homo sapiens
  misc_feature: GYAE6OF02G6S23.44.73.G07.1.454.CMB.1.raw
  modified_base (241)..(241): a, c, t, g, unknown or other
  misc_feature (241)..(241): n is a, c, g, or t
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagaagcctgggtcctcgggtgaaggtctcctgcacggcttctggagcatcttcagaaactatcttatcacctgggtncgacacggcccctggacaagggcttgagtggatgggtgggctcggtccccaattttggactaagcaaactacgcacagaaatccagggcagactcacgattaccgcggacgaatccacgagtgcagcctatacgtggagctgcgcaacctgacgatctgaggacaccgggaccctattactttctcgcgcgaagaacctaaaatttacctacctacgttttgggcggtacgttgattgcttagtgattagttcgggactaagggacaagttcggtacaccgttctacctcacgtccctactaacccgg

SEQ ID NO: 165356 - DNA, 692 bp, Homo sapiens
  misc_feature: GYAE6OF02G6ZQ2.44.73.G07.1.454.CMB.1.raw
tcagacagtatatacacgaccggtgctcgatttagctctacgctcagggggagtaactgctcagttaggacccagagggaaccatggaagccccagctcagcttctcttcctcctgctactctggctcccagattccaccggcgaaattgtgttgacacaatctccagccaccctgtctttgtctccgggggaacgagccaccctctcctgcagggccagtcagagtgttaggaactacttagcctggtatcaacagacacctggccaggcctcccaggcctcctcatctatgatgcatccaagtcgggccgcgggcactcccagcccgaggttccaggtcggactaggttgggtctaggacgacctagtacttcactcgtaccacctatccgacggccggaccgtaggacggaccgggtaagttattttcggacttaagttttacttacgttcgtaccgtaaaccgtaccggttacgtaccgtacgtcggtacccgttagggttaccgttagggtttttccgggacccggtaacgggggtaacccgaacgggtccgtacggggtaacggtacccgtaacgtaaacccggtacgttacgggtacgggtaccgttacggtacccgtaacccgttaacgttccgttacggttccctttaccgtaccgtttccccgtttaccccggaccttaccg

SEQ ID NO: 165357 - DNA, 515 bp, Homo sapiens
  misc_feature: GYAE6OF02HGNIA.44.73.G07.1.454.CMB.1.raw
  modified_base (284)..(284): a, c, t, g, unknown or other
  misc_feature (284)..(284): n is a, c, g, or t
tcagacagtatatacacgaccggtgctcgatttagctctacgctcagggggaggaactgctcagttagggacccagagggaaccatggaagccccagctcagcttctcttcctcctgctactctggctcccagattccaccggcgaaattgtgttgacacaatctccagccaccctgtctttgtctccgggggaacgagccaccctctcttgcagggccggccagactgttgacgacgacttagcctggtaccaacagaagcctggccaggctcccagactccncatctatgatacttctagtagggcctctggcatcccagcccgcttcagtggcaggtgggtctgggacagacttcactctcaccatccaccagccctagacgcctgaagtattttgctagtttattactgtctacacgtaagagtcgcctcaatatcacttcgcctggacctaagtgatatacaaacgactgtgctgcactatctgtcttcacttccttcccgctactctag

SEQ ID NO: 165358 - DNA, 546 bp, Homo sapiens
  misc_feature: GYAE6OF02HP69C.44.73.G07.1.454.CMB.1.raw
  modified_base (330)..(330): a, c, t, g, unknown or other
  misc_feature (330)..(330): n is a, c, g, or t
  modified_base (377)..(377): a, c, t, g, unknown or other
  misc_feature (377)..(377): n is a, c, g, or t
tcagacagtatatacacgaccggtgctcgatttagctctacgctcagggggatcaggactcctcagttcaccttctcacaatgaggctccctgctcagctcctggggctgctaatgctctgggtctcagggtccagtggagatattataatgactcagtctcccctctccctggccgtcacccctggagacgcccggcctccatctcctgtaggtctagtgagagtcttggaggtcagaacatctatgtgatggtacttgcagaagccggcagtctccacaactcctgatctagtttggtccacgtcgggccgtccgggtctcgtgacgnggttcagtcgccagtcgctatcacacacagtattcacactcgcaacntacagacagagtggacgcgtagacgtagttggttgggtcttaagttctgcattacctagtacctaacctaacccgtttcctaacccgttcgggaaccgaagggtaccacgtacttaggaacgtagttaacgacgtaacgtggttacgcgttcgaccaccgtagtcttcg

SEQ ID NO: 165359 - DNA, 535 bp, Homo sapiens
  misc_feature: GYAE6OF02IF50P.44.73.G07.1.454.CMB.1.raw
  modified_base (396)..(396): a, c, t, g, unknown or other
  misc_feature (396)..(396): n is a, c, g, or t
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagaagcctgggtcctcggtgaaggtctcctgcacggcttctggaggcatcttcagaactatcttatcacctgggtgcgacaggccctggacaagggcttgagtggatgggtggctcgtccccaattttggacaagcaaactcgacacagaaattccagggcagactcacgattaccgcgacgaatccacgagtgcagcctatatgagctgcgcaacctgagatctgaggacncggcctatacttcgtgcgcgagaactaaaattactactacgtttttgggcgtagtcgtatgcttagtgtagttgtttagggcgtaaagggactaagtcggtacgaccgtcttccgttacacgtccctaccgtaacccgg

SEQ ID NO: 165360 - DNA, 531 bp, Homo sapiens
  misc_feature: GYAE6OF02G4363.44.73.G07.1.454.CMB.1.raw
  modified_base (369)..(369): a, c, t, g, unknown or other
  misc_feature (369)..(369): n is a, c, g, or t
  modified_base (389)..(389): a, c, t, g, unknown or other
  misc_feature (389)..(389): n is a, c, g, or t
  modified_base (392)..(392): a, c, t, g, unknown or other
  misc_feature (392)..(392): n is a, c, g, or t
  modified_base (414)..(414): a, c, t, g, unknown or other
  misc_feature (414)..(414): n is a, c, g, or t
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagaagcctgggtcctcggtgaaggtctcctgcacggcttctggaggcatcttcagaaactatcttatcacctgggtgcgacaggcccctggacaagggcttgagtggatgggtgggctcgtccccaattttggacaagcaaactacgcacagaattccaggcagactcacgattaccgcggacgaatccacgagtcgcagcctanatggagctgcgcacctgagntcngagacacggccctattatttcncgcgcgagactaaaatttactacctattttcgggacggtagtgactgcttatcgtatagttgggactaagggactaagtcggtcgtaccgtcgttcttcgacgtcctcctaacccgg

SEQ ID NO: 165361 - DNA, 517 bp, Homo sapiens
  misc_feature: GYAE6OF02IJINA.44.73.G07.1.454.CMB.1.raw
  modified_base (241)..(241): a, c, t, g, unknown or other
  misc_feature (241)..(241): n is a, c, g, or t
tcagacagtatatacacgaccggtgctcgatttagctctacgctcagggggccctgggagcacagctcatcaccatggactggacctggaggttcctctttgtggtggcagcaactacaggtgtccagtcccaggtgcgtctggtgcaatctggggctgaaatgaagaagcctgggtcctcggtgaaggtctcctgcacggcttctggaggcatcttcagaaactatcttatcactgggtncgacaggcccctggacaagggcttgagtggatgggtggctcgtccccaattttggacaaggcaaactacgcacagaaattccagggcagactcacgattaccgcggacaatccacgagtgcagcctatatggagctgcgcaacctgagatctgaggacacggcctatatttctgcgcgagaacaaaatttactacctactttttgggcgtagtgatgtcttagtgatagttagggcaaggacaatggtactacgtctcttcacgtcctctaacccg

SEQ ID NO: 165362 - DNA, 587 bp, Homo sapiens
  misc_feature: GYAE6OF02GDTDG.44.73.G07.1.454.CMB.1.raw
  modified_base (222)..(222): a, c, t, g, unknown or other
  misc_feature (222)..(222): n is a, c, g, or t
tcagacagtatatacacgaccggtgctcgatttagctctacgctcagggggggggtctcaggaggcagcgctctcaggacgtcaccaccatggcctgggctctgctcctcctcaccctcctcactcaggacacagggtcctgggcccagtctgccctgactcagcctccctccgcgtccgggtctgtcggtcagtcagtcaccatctcctgcactggaaccngctaatttcagttggtaatcatgactatgtctcctggtaccagcatccacccaggccacacgcccccagacctcgtgtatttttgaggtcaaataacgccgcccctgacggggtcccggattccggttctcgtcggctccaagtctggcaacgccgcctcctcgaccgtctcgtgggctccgaggctgacgagtgagtctagtattatactgcagtctccgagtcggacgactaccgtagttgtacttttgtccgttttcgggacgggtacggtaccgagtaccgtcggtacccgttaccgttacggtaccgaccggacccgtaaggtccctcccggtacccccgtcggtaccctaccgttcccg

SEQ ID NO: 165363 - DNA, 551 bp, Homo sapiens
  misc_feature: GYAE6OF02HSKQQ.44.73.G07.1.454.CMB.1.raw
  modified_base (393)..(393): a, c, t, g, unknown or other
  misc_feature (393)..(393): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagataccactggagaaatagtgatgacgcggtctccagccaccctgtctgtgtctccaggggaaagagccaccctctcctgcagggccagtcagagtgttagcagcaacttagcctcgtaccagcagaaatctggccaggctcccaggctcctcatctatgatgcatccaacagggtcactggccaccccagacaggttcagtggcaggtgggtctgggacagacttcactctcaccgtcagcaatgtacagcctagaacgtnttttgactagtttatttactgtcagtctacggtcgttcctccgaggtcccgtctcctaccggtttccggggcgggggtaaccgtaaggggtcggagtagtacgaaggtaaccgaacgttggtcgggctcggacctaccgtattcgttcgttcttaccg

SEQ ID NO: 165364 - DNA, 538 bp, Homo sapiens
  misc_feature: GYAE6OF02GI8H3.44.73.G07.1.454.CMB.1.raw
  modified_base (397)..(397): a, c, t, g, unknown or other
  misc_feature (397)..(397): n is a, c, g, or t
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagaagcctgggtcctcggttaaggtctcctgcacggcttctggaggcatcttcagaaactatcttatcacctgggtgcgacacggcccctggacaagggcttgagtggatgggtgggctcgtccccaattttggacaagcaaactacgcacagaaattccaggcagactcacgataccgcggacgaataccacgagtcgacagcctatatggagctgcgacaccgtgagatcngagacacggcctatacttctcgcgcgagaactaaaattctacctacgttttagggcgtagtgagtgtacttatgtatagttgggacgtaagggactaagtggtacgtaccgttctacgttcacgcctaccgaccgaaccgg

SEQ ID NO: 165365 - DNA, 611 bp, Homo sapiens
  misc_feature: GYAE6OF02IPHKM.44.73.G07.1.454.CMB.1.raw
  modified_base (185)..(185): a, c, t, g, unknown or other
  misc_feature (185)..(185): n is a, c, g, or t
  modified_base (454)..(454): a, c, t, g, unknown or other
  misc_feature (454)..(454): n is a, c, g, or t
tcagacagtatatacacgaccggtgctcgatttagctctacgctcaggggggggggtctcaggaggcagcgctctcaggacgtcaccaccatggcctgggctctgctcctcctcaccctcctcactcaggacacaggatcctgggctcagtctgccctggctcagcctccctcgtgtctgggtcncctggacagtcggtcaccatctcctgccacgtgggtccagcagtgactagttggtgttaataactttgtctcctggtaccaacaccaccagcaaacgccccaaattcatcatttatgatgtacagtaacgcgccctcgacggggtcctgactcgcttctcgtggctaccaagtctggacaacgaccggccctccgtgacccgtctcgtcgggcctaccgaggctaggaggtatggacggtcctagtaacttatttcgcgtccttcctanacttagtcggacgtacgggtcgtaacgtttaggttttacttcggttacgttaaccgggaacgtacgggtaacctacggtacctacccggttacctacggtccgaaccggaccccgtaacggacccctaaccctacggttaccgtacctaccttcccg

SEQ ID NO: 165366 - DNA, 538 bp, Homo sapiens
  misc_feature: GYAE6OF02GUCDI.44.73.G07.1.454.CMB.1.raw
  modified_base (196)..(196): a, c, t, g, unknown or other
  misc_feature (196)..(196): n is a, c, g, or t
  modified_base (327)..(327): a, c, t, g, unknown or other
  misc_feature (327)..(327): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccaccgggcgaaattgtgttgacacaatctccagccaccctgtctttgctccgggggaacngccacctctcttgcagggccggccagactgttgacgacgacttagcctggtaccaacagaagcctggccaggctcccagactcctcatctatgattacttctagtagggcctctggcatccccagccccgnttcagtggcaggtgggtctgggacagacttcactctcaccatccaccagccctagacgtccctagaacgtattttgactagttttattactgttctacgaccgtaagaacgtggacctccaatcttacacgtttcggccctagggaccaaaggtgatatacaaacgactgtgctgcaccatctgttcttcacttccttcccgcctatctag

SEQ ID NO: 165367 - DNA, 538 bp, Homo sapiens
  misc_feature: GYAE6OF02F7ID2.44.73.G07.1.454.CMB.1.raw
  modified_base (205)..(205): a, c, t, g, unknown or other
  misc_feature (205)..(205): n is a, c, g, or t
  modified_base (369)..(369): a, c, t, g, unknown or other
  misc_feature (369)..(369): n is a, c, g, or t
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagaagcctgggtcctcggtgaaggtctcctgcacggcttcnggaggcatcttcagaaactatcttatcacctgggtgcgacaggcccctggacaagggcttgagtggatgggtgggctcgtccccaagttttggacaagcaaactacgcacagaaatccaggcagactcacgataccgcggacgaatccacgagtcgcagcctanagtggagctgcgacaaccgtgagatctgagacgacggccctattattctcgcgacgacgaacaaaactttactacctacgtttttgggacggtagtgatgtcttagtgtatagttgggaccgtaagggacaagtcgtacgacgtcttcgtacgcgtcctcctaacccgg

SEQ ID NO: 165368 - DNA, 534 bp, Homo sapiens
  misc_feature: GYAE6OF02GZI3J.44.73.G07.1.454.CMB.1.raw
  modified_base (376)..(376): a, c, t, g, unknown or other
  misc_feature (376)..(376): n is a, c, g, or t
  modified_base (394)..(394): a, c, t, g, unknown or other
  misc_feature (394)..(394): n is a, c, g, or t
  modified_base (417)..(417): a, c, t, g, unknown or other
  misc_feature (417)..(417): n is a, c, g, or t
  modified_base (421)..(421): a, c, t, g, unknown or other
  misc_feature (421)..(421): n is a, c, g, or t
tcagacagtatatacacgaccggtgctcgatttagctctacgctcagggggccctgggagcacagctcatcaccatggactggacctggaggttcctctttgtggtggcagcaactacaggtgtccagtcccaggtgcgtctggtgcaatctggggctgaaatgaagaagcctggggtcctcggtgaaggtctcctgcacggcttctggaggcatcttcagaaactatcttatcacctgggtgcgacaggcccctggacaagggcttgagtggatgggtgggctcgtccccaattttggacaagcaactacgcacagaattccagggcagactcacgattaccgcggacgaatccacgagtgcagcctatatggancgtgcgcaacgtgagatntgaggacacggcctatactttcngcgngagaactaaaatttctaccttacgttttcgggacggtagttgatgtcttagtgtatagttcgggcgaaggtactagtcggtctaccgtcttctacgacgtcctcgtaacccgg

SEQ ID NO: 165369 - DNA, 537 bp, Homo sapiens
  misc_feature: GYAE6OF02HNGY7.44.73.G07.1.454.CMB.1.raw
  modified_base (240)..(240): a, c, t, g, unknown or other
  misc_feature (240)..(240): n is a, c, g, or t
  modified_base (388)..(388): a, c, t, g, unknown or other
  misc_feature (388)..(388): n is a, c, g, or t
  modified_base (391)..(391): a, c, t, g, unknown or other
  misc_feature (391)..(391): n is a, c, g, or t
  modified_base (413)..(413): a, c, t, g, unknown or other
  misc_feature (413)..(413): n is a, c, g, or t
  modified_base (418)..(418): a, c, t, g, unknown or other
  misc_feature (418)..(418): n is a, c, g, or t
  modified_base (422)..(422): a, c, t, g, unknown or other
  misc_feature (422)..(422): n is a, c, g, or t
tcagacagtatatacacgaccggtgctcgatttagctctacgctcagggggccctgggagcacagctcatcaccatggactggacctggaggttcctctttgtggtggcagcaactacaggtgtccagtcccaggtgcgtctggtgcaatctggggctgaaatgaagaagcctgggtctcggtgaaggtctcctgcacggcttctggagcatcttcagaaactatcttatcacctgggtncgacaggcccctggacaagggcttgagtggatgggtgggctcgtacccagttttggacaagcaaactacgcacagtaaattccaggcagactcacgattaccgcggacgaatccaacgagtgcaacgctatagtggagctgcgacacngantctgagacacgcctatacttcngacgngaanactaaaattctaccttacgttttgggcggtagtgtatgtcttatgtattaggtttacggggcgtaagggacgtaagtcggtacctacgttctacttcgagtccctactaacccgg

SEQ ID NO: 165370 - DNA, 628 bp, Homo sapiens
  misc_feature: GYAE6OF02JW86V.44.73.G07.1.454.CMB.1.raw
  modified_base (373)..(373): a, c, t, g, unknown or other
  misc_feature (373)..(373): n is a, c, g, or t
  modified_base (377)..(377): a, c, t, g, unknown or other
  misc_feature (377)..(377): n is a, c, g, or t
tcagacagtatatacacgaccggtgctcgatttagctctacgctcagggtccctgggagcacagctcatcaccatggactggacctggaggttcctctttgtggtggcagcaactacaggtgtccagtcccaggtgcgtctggtgcaatctggggctgaaatgaagaagcctgggtcctcggtgaaggtctcctgcacggcttctggaggcatcttcagaaactatcttatcacctgggtgcgacaggcccctggacaaggctgagtggatgggtggctcgtccccaagtttggacaagcaaactacgcacagaattccgagggcagactcacgattaccgacgacgaatccaacgagtgacagcctatacgnggancgtgacgacaaccgtgagatcgtaggacggacaccggcctattactttcgtacgccgtacgaacgtaactaaaaacttttacctaccttaacggttttttacggggacggtaacggttgttaaagttcggttaaccgtttagttacgttacgttacggttttacgggggtacccgtaaagggtaacgtaacggttagggtaccgttaacccggttcttaccgtttacgaacgttccctacccgtaacccgg

SEQ ID NO: 165371 - DNA, 793 bp, Homo sapiens
  misc_feature: GYAE6OF02F2DDN.44.73.G07.1.454.CMB.1.raw
tcagacagtatatacacgaccggtgctcgatttagctctacgctcgacggggcccgtgggagcacagctcatcaccatggactggacctggacggttccttctttgtggtggcagacaactacgaggtgtccagtcccaggtgcgtctggtgcaatcgtggggctagaaatgaagaacgccgtgggtccgtcggtagtaaggtctccgtgcgacggtcttcgtgggagctattcttacaagtaaaacttattacttactcctaccggtgggtcgcgacgaccggccccgtaggaccgaagggtcttggaggtggagtggggtggtctccgtaccccttagtttacggaacgtaacgactaaaccgtacgacaacgtaacgtaaacttccggaaggtacagtacctacgaacgtaaccgttaccggacggaacgaactaccgaacggtacgtacgaccaacgtacctaagtaggtggacgtcgtacggccgtaacctaaccgtaggaacgtcgttacgtagggaacggaaccgtacccggtacccttaagtttacctttacgtcgaccggtacgtaaacgtaaaacctttaaaaactttaccctttaaccgtttaaccgggtttttacggggaacggttaacggttagttaacgttcgttaaccgtttagttaggttagttttacgggtttacggggtaaaccggtaaacgggttaacgtaacggtttacggtaccgttacccggttacctttacccgttacggtacccgtaccccgtacccgtaaaccccggg

SEQ ID NO: 165372 - DNA, 670 bp, Homo sapiens
  misc_feature: GYAE6OF02I08T6.44.73.G07.1.454.CMB.1.raw
  modified_base (348)..(348): a, c, t, g, unknown or other
  misc_feature (348)..(348): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtcgtccgggggaacagccaccctctcttgcgagggccgccagactgttgacgacgacttagcctggtaccaacagaacgcctggccaggcctacccgagacctccctacacttctatgacttacttcgtaggtacgggccttcgtggccactccccgagccccgtnttcgaggtggctaggtcgggtctgggacagtaccttcactcacacctatccaaccagacctagacgcctagaagtagtttgacgttagtttacttacgtacgttacctaaccgtaaccggttaaaggtaacgtcggtacccttacctaaactttacttaccgttaaccgtttccggtacccgttacgggtaaccgtaaacgggttacggtaacttaacgtaaccgtaaaacgtaacgttaggtacggtacgttacggacctaacctagttccttacgttacctttacgtactttcccgttcccgtacctacttccgttaacg

SEQ ID NO: 165373 - DNA, 537 bp, Homo sapiens
  misc_feature: GYAE6OF02GMLDO.44.73.G07.1.454.CMB.1.raw
  modified_base (225)..(225): a, c, t, g, unknown or other
  misc_feature (225)..(225): n is a, c, g, or t
  modified_base (241)..(241): a, c, t, g, unknown or other
  misc_feature (241)..(241): n is a, c, g, or t
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagaagcctgggtcctcggtgaaggtctcctgcacggcttctggaggcatcttcagaaactntcttatcacctgggtncgacaggcccctggacaagggcttgagtggatgggtgggctcgtccccaattttggacaagcaaactacgcacagaaattccagggcagactcacgattaccgcggacgaatccacgagtgcagcctatatggagctgcgcaacctgagatctgaggacacggccctattacttctgcgcgagaacaaaatttctacctacgttttgggacggtagttgatcgtacttatgtattagtttaggggacaagggtactaagtcggtactaccgtctcttcacgtcctccgtaacccgg

SEQ ID NO: 165374 - DNA, 568 bp, Homo sapiens
  misc_feature: GYAE6OF02ILC4K.44.73.G07.1.454.CMB.1.raw
  modified_base (329)..(329): a, c, t, g, unknown or other
  misc_feature (329)..(329): n is a, c, g, or t
  modified_base (535)..(535): a, c, t, g, unknown or other
  misc_feature (535)..(535): n is a, c, g, or t
tcagacagtatatacacgaccggtgctcgatttagctctacgctcagggggggaactgctcagttaggacccagagggaaccatggaagccccagctcagcttctcttcctcctgctactctggctcccagattccaccggcgaaattgtgttgacacaatctccagccaccctgtctttgctccgggggaacagccaccctctcttgcgagggccgccagactgttgacgacgacttagcctggtaccaacagaagcctggccaggcctccagactcctcatctatgatacttctagtagggccttcgtggcactcccgagccccgtnttcaggtggctaggtcgggtctggggaccaggtacctttcacttctcaccatcaacccagcctaagcgtcctagtaagtattttgctaagttttattacttgtactacgtaaccgtaagaggttcgtcctaccaattacttctacgtttccgcctacgggacctaagtgatagtaacaaacgtaacgtgtgctcgacacctatctntcttactacttcccttacccacctatctgtaac

SEQ ID NO: 165375 - DNA, 691 bp, Homo sapiens
  misc_feature: GYAE6OF02IHW7T.44.73.G07.1.454.CMB.1.raw
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagaagcctgggtcctcggtgaaggtctcctgcacggcttctggaggcatcttcaagaaactatcttatcaccgtgggtgcgacacggcccctggacaagggcttgagtggagtggggtggctcgtcccctaagttttggacaagacaaacgtacgacaacagaaacttcgaaggcagactcgacgattaccgcggaacgaactccgacgagtcgacacgacctatagtggacgtcgtgacgactaaccgtgaacgacttcgtaggaacggaccgacggtccctaagtttaacgtttcgtcggtaccgtacgaacggtaaaaccttaaaaacgttttacccgtacccgtttaacgggtttttacggggacggttaacgggttacgttaacgttacggtaccgtttaagtacggttaacgtttacgggttttacgggggaaccgtaaacggggtaactaaacggtttacggtaccgtacccggttactttaccgttaccgaaccggtccccgtacccgtaaaccccggg

SEQ ID NO: 165376 - DNA, 550 bp, Homo sapiens
  misc_feature: GYAE6OF02G9NQQ.44.73.G07.1.454.CMB.1.raw
  modified_base (225)..(225): a, c, t, g, unknown or other
  misc_feature (225)..(225): n is a, c, g, or t
  modified_base (383)..(383): a, c, t, g, unknown or other
  misc_feature (383)..(383): n is a, c, g, or t
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagaagcctgggtcctcggtgaaggtctcctgcacggcttctggaggcatcttcagaaactntcttatcacctgggtgcgacacggcccctggacaagggcttgagtggatgggtgggctcgtcccaattttggacagcaaactacgcacagaaattccagggcagactcacgattaccggcggaacgaactccacgagtgcagcctatatggagctgcncaacctgagatctgaggacaccggcctagtatttcgtcgcgacgagaactaaaactttactacctacgttttgggacggtagtagtagtgacttagtgtagttagttggggacctaagggactaagtacggtctaccgttctccgttacacgtcctacctaacccgg

SEQ ID NO: 165377 - DNA, 713 bp, Homo sapiens
  misc_feature: GYAE6OF02GS1U2.44.73.G07.1.454.CMB.1.raw
  modified_base (250)..(250): a, c, t, g, unknown or other
  misc_feature (250)..(250): n is a, c, g, or t
tcagacagtatatacacgaccggtgctcgatttagctctacgctcgagggggatcaggactcctcagttcaccttctcacaatgaggctcctgctcagctcctgggctgctaatgctctgggtctcagggtccagtggagatattataatgactcagttcctcccctctccctggcctccacccctggagacgccggcctccatcctcctgtaacggtctaggtgacgagtcttggagttcaagaacctntctaatggtgactggtacttgacagaacgtacgggcagtctacactactcctgatcttagttcgggttaccctacgtccgggtacctccggggtctcgtcgactaggttcagtcgaccgtaggtcgtacactccgaacaccgtacacggtactttcactaacgtcgactacagtacaacgtcgaaggtacggtacgggtacggtacgttaggtaaccggttaaggttccgggttttagggtaccttaagtttaaccgtaccggtacgttaaccgttacccgttaaacgtttaccctaaacccggttaaaccccccgtttcgtaaccccggttacgggtaacccggtaaacgggtaacccgtaaccggttaccggttacgtaaacggtaacgtttaaaccgggtccgtaaacgttggtaccggtcgttaacccgacccgttaaccgtacgttaccttaacccgg

SEQ ID NO: 165378 - DNA, 587 bp, Homo sapiens
  misc_feature: GYAE6OF02G5JX9.44.73.G07.1.454.CMB.1.raw
  modified_base (242)..(242): a, c, t, g, unknown or other
  misc_feature (242)..(242): n is a, c, g, or t
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatcgtggggctgaaatgaagaagcctgggtcctcggtgaaggtctcctgcacggcttctggaggcatcttcagaaactatcttatcacctgggtncgacacggccctggacaagggcttggagtggagtgggtggctcgtcccctaattttggacaagcaactacgcacagaattccgaggcagactcacgacttaccgcggacgaatccacgagtgcagacctatagtggagctgcgacgaaccgtgacgtatcgtggaggaccgacggacccttattactttcgagcgacgacgtaactaaaactttcctaccttacgttttgggacggtagttacgtagttgtacttagtgtagttaggtttacggggaccgtaagggtaacgtaagttacggtacctaccggttcttcgttaccgacgtcccgtacctaacccggg

SEQ ID NO: 165379 - DNA, 549 bp, Homo sapiens
  misc_feature: GYAE6OF02F5GDH.44.73.G07.1.454.CMB.1.raw
  modified_base (227)..(227): a, c, t, g, unknown or other
  misc_feature (227)..(227): n is a, c, g, or t
tcagacagtatatacacgaccggtgctcgatttagctctacgctcaggggccctgggagcacagctcatcaccatggactggacctggaggttcctctttctggtggcagcaactacaggtgtccagtcccaggtgcgtctggtgcaatctggggctgaaatgaagaagcctgggtcctcggtgaaggtctccgtgcacggcttcgtggaggcatcttcagaaactntcttatcacctgggtgcgacacggcccctggacaagggcttgagtggatgggtgggctcgtccccaattttggacaagcaaactcgcacagaattccagggcagactcacgattaccgcggacaatccacgagtgcagcctatatggagctgcacaaccgtgagatctgacggacaccggcctattactttctgcgcgaacgaactaaaatttacctaccttacgtttttggggacggtagttgatgtacttatgtattagttcgggcgaaggtactaacgtggtacgtaccgttcttacgttcacgtacctcctaacccgg

SEQ ID NO: 165380 - DNA, 605 bp, Homo sapiens
  misc_feature: GYAE6OF02FZUYN.44.73.G07.1.454.CMB.1.raw
  modified_base (312)..(312): a, c, t, g, unknown or other
  misc_feature (312)..(312): n is a, c, g, or t
  modified_base (365)..(365): a, c, t, g, unknown or other
  misc_feature (365)..(365): n is a, c, g, or t
tcagacagtatatacacgaccggtgctcgatttagctctacgctcaggggccctgggagcacagcctcatcaccatggactggacctggaggttcctctttgtggtggcagcaactacaggtgtccagtcccaggtgcgtctggtgcaatctggggctgaaatgaagaagcctgggtcctcggtgaaggtctcctgcacggcttcgtggaggcatcttcagaaactatcttatcacctgggtgcgacaggcccctggacgaggcttgagtggagtgggtggctcgtaccctatttggacagcaactacgcanagaatccgaggcagactcacgattaccggcgacgaactccgacgagtcgcganccgtaatacgtggacgtctgcgaccaacgtgagatacgtaggacgacgaccggacccttattacttctacgcgacgactaactaaaactttaccgtaccgttacgttttacggggacggtagttgtagttagtactttaagtagtagttacggttacgggaaccggtaacgggtacgtaacgttcggttaccgtacccggttaccttaccgttacgaccgtacccgtacccgtaacccgg

SEQ ID NO: 165381 - DNA, 655 bp, Homo sapiens
  misc_feature: GYAE6OF02F8MCO.44.73.G07.1.454.CMB.1.raw
  modified_base (242)..(242): a, c, t, g, unknown or other
  misc_feature (242)..(242): n is a, c, g, or t
  modified_base (461)..(461): a, c, t, g, unknown or other
  misc_feature (461)..(461): n is a, c, g, or t
tcagacagtatatacacgaccggtgctcgatttagctctacgctcaggggccctgggagcacagctcatcaccatggactggacctggcggttcctctttgtggtggcagcagctacaggtgtccagtcccaggtgcagctggtgcagtctggggctgaggtgaagaagcctgggtcctcggtgaaggtctcctgcaaggcttctggaggcaccttcttcagctatgtctttttattgggtncgacaggcccctggacaagggcttgagtggctgggagggatcactccctattctttggtgcatcgaattacgcacagtaagtttcaggacagacgtcaccacttaccgcgacgaatccgacgacgtacacgtacctacgacgtggacgtcgtggagcgagggctaggaagacgtcgtacggaaagaccgaccggacctaacgttccttaatttttccgngttcggacgtacggtaccgttccccgttaccggttaccttaaccgttttccaacgttaaccgttccccctttactaccgtaccgtttaaccggtcccctaacgtaacctaacgtttaacgggttaaaccgttttccgggttaccccggtaacccccgggttccgggggtaccctaaccgggggttaaccccccg

SEQ ID NO: 165382 - DNA, 657 bp, Homo sapiens
  misc_feature: GYAE6OF02JS7NY.44.73.G07.1.454.CMB.1.raw
  modified_base (142)..(142): a, c, t, g, unknown or other
  misc_feature (142)..(142): n is a, c, g, or t
  modified_base (308)..(308): a, c, t, g, unknown or other
  misc_feature (308)..(308): n is a, c, g, or t
  modified_base (644)..(644): a, c, t, g, unknown or other
  misc_feature (644)..(644): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccaccgngaattgtgttgacacaatctccagccaccctgtctttgcgtccggggaacaggccaccgttctccttcgctacgggccgccgagacctggttcgacggactacttagcctaggtaccaagtaggacgtccgtggaccaggcctcccgagacctccgtcatctagtnacttactttcaggtacggccttcgtcggacctacgtcccaggtcccgtcttcgacgtcggactacggtggtccgtaggtactagtacgttccgaacgtttcctaccgacctaactcccgaaccctgtacccgtaagccgtcgtacgagttactttcgacttagtttataccttgttactaaccgtaacgtagttaacgtcgtacctaacgtaattaccttccgttaacgttccggaccgttacggtaacccgtaagttcggacttagtaaaccgtaaacgagttacgtcgaactacgtacggctagtccttgtacctactaccgtccttaacccgngttactcccgtag

SEQ ID NO: 165383 - DNA, 525 bp, Homo sapiens
  misc_feature: GYAE6OF02F30F2.44.73.G07.1.454.CMB.1.raw
  modified_base (394)..(394): a, c, t, g, unknown or other
  misc_feature (394)..(394): n is a, c, g, or t
  modified_base (420)..(420): a, c, t, g, unknown or other
  misc_feature (420)..(420): n is a, c, g, or t
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagaagcctgggtcctcggtgaaggtctcctgcacggcttctggaggcatcttcagaaactatcttatcacctgggtgcgacacggcccctggacaagggcttgagtggatgggtgggctcgtccccaattttggacaagcaaactacgcacagaaatccagggcagactcacgattaccgcggacgaatccacgagtgcagcctatatggagctgcgcaacctgagatcngaggacacggccctattattctgcgngagactaaaatttctacctacgttttgggcggtagtgatgtcttatgtatagtttaggggccaagggacaagtcgtcacgtctcgttcacgtcctcctaacccgg

SEQ ID NO: 165384 - DNA, 596 bp, Homo sapiens
  misc_feature: GYAE6OF02HY1UI.44.73.G07.1.454.CMB.1.raw
  modified_base (287)..(287): a, c, t, g, unknown or other
  misc_feature (287)..(287): n is a, c, g, or t
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagaagcctgggtcctcggtgaaggtctcctgcacggcttctggaggcatcttcagaaactatcttatcacctgggtgcgacaggcccctggacaaggcttgagtggatgggtgatcactcctntttttggctcactcacctacgcacgacgacttccgggcagaattacgattaccgcgacagtccacagacacagtctcatgacaatgtagttcttagaactcgacgacacggcctactactactgtgcgagacggtcccgtacccgagtctcgacacgtcgggacgtccgttttggaagtacgttccgggtaggggggaccctaacgggggtaaccccgttggggtacttaacggtttcggtacctacccgttccgtacggtaccctttaccccgaacccggtaaccgggtccccctagtttaccccggg

SEQ ID NO: 165385 - DNA, 747 bp, Homo sapiens
  misc_feature: GYAE6OF02HSR7R.44.73.G07.1.454.CMB.1.raw
  modified_base (232)..(232): a, c, t, g, unknown or other
  misc_feature (232)..(232): n is a, c, g, or t
  modified_base (251)..(251): a, c, t, g, unknown or other
  misc_feature (251)..(251): n is a, c, g, or t
tcagacagtatatacacgaccggtgctcgatttagctctacgctcagggggatcaggactcctcagttcaccttctcacaatgaggctccctgctcagctccgtggggctgctaatgctctgggtctcgagggtccagtggagatattataatgactcagtcctcccctctcccgtcggtcccgtccaccccgtggagacggcccgcctcatcctctgtaggtctagtgagngtcgttggaggtcagaacntctatgtgagtgtatgacgagacggacggcagtcctaccgacaaccttcctagtacttcgttacgtttcgggtccacggtccgggtacccgttccggggtctcgtacggtacgtacgggttcacggttcgacctaggtcgactaacgttacaaccacctacgtaagttaactttaccaacctacgtacgacctaacgtaactaccgagtacgaagggtacggtaggggaacgtccggtagtaaccgttaggtttacggggtttaggtacctttaagttcgtacgtacgtaaccttaacgttaaccgtttacccgttaaaccccggttaaccccgttccgttaaccccgggttacgggtaaccgtaaaccgggtaaaccttaccggtaaccggtttacggaaaccggtttaacggttaaaccggtaccggttaaacggttcggaacgggttaccgtacggtaacccccgttaaacggtcctttcccggtttaacccg

SEQ ID NO: 165386 - DNA, 577 bp, Homo sapiens
  misc_feature: GYAE6OF02FZ7X8.44.73.G07.1.454.CMB.1.raw
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagaagcctgggtcctcggtgaaggtctcctgcacggcttctggaggcatcttcagaaactatcttatcacctgggtcgcgacacggcccctggacaagggcttgagtggatgggtggctcgtccccatttggacagcaaactacgcacagaacttccaggcagactcacgattaccgcggacaactccacgagtgacacgcctatagtaggacgcgtcggcgaccaaccgtgaacgatcgtagacggaccgaccggtcccttagttatttcctggaccgacgaacgtaaactaaaactttactaccgttacgttttggggacgtagtcgtagtgtacttatagtagttagttgggacctaagggtactaagtcggtacgtaccgtcttccgttacacgtcctccgtaacccgg

SEQ ID NO: 165387 - DNA, 561 bp, Homo sapiens
  misc_feature: GYAE6OF02HZULQ.44.73.G07.1.454.CMB.1.raw
  modified_base (226)..(226): a, c, t, g, unknown or other
  misc_feature (226)..(226): n is a, c, g, or t
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagaagcctgggtcctcggtgaaggtctcctgcacggcttcgtggaggcatcttcagaaactntcttatcacctgggtgcgacacggccccctggacaaagggccttggagtggatggggtgggctcgtccccaattttggacaagcaaactacgcacagaaattccagggcagactcacgattaccgcggacgaatccacgagtgcagcctatatggagctgcgcaacctgagatctggaggacgaccggccctaatagtttctgcgacgagaactaaaactttactacctacgtttttagggacggtacgtagtagtgtacttatagtatagtttcgggacgtaagggactaagtaggtactaccgttcttccttcgacgtcctaccctaacccgg

SEQ ID NO: 165388 - DNA, 594 bp, Homo sapiens
  misc_feature: GYAE6OF02GVDTQ.44.73.G07.1.454.CMB.1.raw
tcagacagtatatacacgaccggtgctcgatttagctctacgctcagggggatcaggactcctcagttcaccttctcacaatgaggctccctgctcagctcctggggctgctaatgctctgggtctcagggtccagtggagatattataatgactcagtctcccctctccctggccgtcaccctggagagccggcctccatctcctgtaggtctagtgagagtcttggagtcagaacatctatgtggactggtacttgcagaagaccgggcagtctccacactcctgatctagtttcggtccacgtcgggtccgttccggggtctcgtgacgtaggttcaggtcgccgtagtcgcatcaacacaactagtactttccactacgtcgacacagtacagcgaggtacggtgggacggcgtaggacggtagttgggttggggttacttagtttacgtcgactacgttaccgtaagttaccctaaccgtaaccccgttctaaccggttacgggacgtaacggacctacgtacgttaggtaacgtaacgttaacggacgtaacgttggtacggtcgtcgacctacgtacgttcgttacg

SEQ ID NO: 165389 - DNA, 531 bp, Homo sapiens
  misc_feature: GYAE6OF02H5QIK.44.73.G07.1.454.CMB.1.raw
  modified_base (231)..(231): a, c, t, g, unknown or other
  misc_feature (231)..(231): n is a, c, g, or t
  modified_base (240)..(240): a, c, t, g, unknown or other
  misc_feature (240)..(240): n is a, c, g, or t
  modified_base (332)..(332): a, c, t, g, unknown or other
  misc_feature (332)..(332): n is a, c, g, or t
  modified_base (413)..(413): a, c, t, g, unknown or other
  misc_feature (413)..(413): n is a, c, g, or t
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagaagcctgggtcctcggtgaaggtctcctgcacggcttctggaggcatcttcagaaactatcttancactgggtncgacaggcccctggacaagggcttggagtggatgggtggctcgtcccctaatttggacaagcaaactacgcacagaacttccagggcagacncacgattaccgcgacgaatccacgagtcgcagcctatagtggagctgcgcaacctgagatcgagacacggcctatacttcngcgacgagaactaaaactttcctaccttacgttttcgggacggtagtagattgcttagtgtattagtttcgggacctaagggacagtgtcaccgttctctcacgcctaccactaccgg

SEQ ID NO: 165390 - DNA, 759 bp, Homo sapiens
  misc_feature: GYAE6OF02GHD53.44.73.G07.1.454.CMB.1.raw
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatcgtggggctggaggtgaagaagccgtgggtcctcggtgaaggtctcctgcaaggtcttctggacggcaccttcttcagtctatgtcttttagtttgggtgcgacgacggtcccctggacgaagggtcttggagtggcgtgggagggtatcactcccttatccgtttggtcgctagtccgaagttacgacaacgagtaacgtttcgaaggtacaggtacgtaccaccgtacgttacccgggacggaaccgtaaacgttcccgaacggtaaagtaacccgaacggtaccctaacgaagttacgggaacggtctagggaacgtccgaagggtccgtagggagaagtttcgtaaaggaaccgaccggtaaccggtacctaagtttaccgttaagttttccgtagttaccgggcgtaaacgggtacccgttccccgttacgttaaccttaaccgttttaccaacgtttcccgttacccctacgttaaccgttaaccgttaccctaccccgaaagttaaccgttaacggtaacggttaaacgttttcccgggttaccccggaaccccgggtttggggaacccccgtaacggggttaaccccgccgggttaaccccg

SEQ ID NO: 165391 - DNA, 540 bp, Homo sapiens
  misc_feature: GYAE6OF02HESQ8.44.73.G07.1.454.CMB.1.raw
  modified_base (241)..(241): a, c, t, g, unknown or other
  misc_feature (241)..(241): n is a, c, g, or t
  modified_base (376)..(376): a, c, t, g, unknown or other
  misc_feature (376)..(376): n is a, c, g, or t
  modified_base (514)..(514): a, c, t, g, unknown or other
  misc_feature (514)..(514): n is a, c, g, or t
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagaagcctgggtcctcggtgaaggtctcctgcacggcttctggaggcatcttcagaaactatcttatcacctgggtncgacaggcccctggacaagggcttgagtggatgggtgggctcgtccccaattttggacaagcaaactacgcacagaaattccagggcagactcacgattaccgcggacgaatccacgagtgcagcctatatgganctagcgcaacctgagatcgtgaggacacggccctagtatttctagcgcgagaacaaaactttactacctacgtttttgggacggtagtgatgacttatgattagtttcggggctaagggacaagtggtacgaccgttntccgttcacgtccctacctaacccgg

SEQ ID NO: 165392 - DNA, 663 bp, Homo sapiens
  misc_feature: GYAE6OF02G982M.44.73.G07.1.454.CMB.1.raw
  modified_base (206)..(206): a, c, t, g, unknown or other
  misc_feature (206)..(206): n is a, c, g, or t
  modified_base (234)..(234): a, c, t, g, unknown or other
  misc_feature (234)..(234): n is a, c, g, or t
  modified_base (244)..(244): a, c, t, g, unknown or other
  misc_feature (244)..(244): n is a, c, g, or t
  modified_base (277)..(277): a, c, t, g, unknown or other
  misc_feature (277)..(277): n is a, c, g, or t
  modified_base (308)..(308): a, c, t, g, unknown or other
  misc_feature (308)..(308): n is a, c, g, or t
  modified_base (327)..(327): a, c, t, g, unknown or other
  misc_feature (327)..(327): n is a, c, g, or t
  modified_base (365)..(365): a, c, t, g, unknown or other
  misc_feature (365)..(365): n is a, c, g, or t
tcagacagtatatacacgaccggtgctcgatttagctctacgctcagggccctgggagcacagctcatcaccatggactggacctggaggttcctctttgtggtggcagcaactacaggtgtccagtcccaggtgcgtctggtgcaatctggggctggaaatgaagaagcctgggtcctcggtgaaggtctcctgccacggcttgnggaggcatcgttcagaaactatcttaancacgtgggtncgacacgccctggacaaggcttgagtgagtggnggctgtcccaatttggactagcaatacgcanagaaatcgaggtcagactnacgatacgcgacgaatcacgagtgcagctatactgganacgtgacgcaacctagacgtatacgtgaacggtacaaccgggtccctaagttaacttttcgcgaccggtacgtaaggaaacctaaaaaagttttaaccgttaaccgtaaccgtttttttacggggaccggttaaggttacggaacgtttacgtaccgtttaaagttagtaacgtttaacggtttttacgggggaacccggttaaaaggggtaacgtaaaacggtttacgggtaaccgttaacccggtttacgtacccgtttttaccgaaccggttacccttaccccgtaaaccccggg

SEQ ID NO: 165393 - DNA, 656 bp, Homo sapiens
  misc_feature: GYAE6OF02FMDM6.44.73.G07.1.454.CMB.1.raw
  modified_base (297)..(297): a, c, t, g, unknown or other
  misc_feature (297)..(297): n is a, c, g, or t
  modified_base (369)..(369): a, c, t, g, unknown or other
  misc_feature (369)..(369): n is a, c, g, or t
tcagacagtatatacacgaccggtgctcgatttagctctacgctcagggggggaactgctcagttaggacccagagggaaccatggaagccccagctcagcttctcttcctcctgctactctggctcccagattccaccggcgaaattgtgttgacacaatctccagccaccctgtctttgtctccgggggaacagccaccctctcttgcagggccggccagactgttgacgacgacttagcctggtaccaacagaagcctggccaggctcccagacctcctcatctatgatacttntagtagggcctcgtggcactcccagccccgtcttcagtcggctaggtgggtctggggacagacttcacttcncaccatccaaccacgcctagcgacctagaagtatttgcttagttttattacttgttacctacgtaaccgtaagtaacggtcggtacccttaccgtaaattactttaccgtaaccgttttccgggaccccgttaggggtaaacccgtaaaagggttcgggtaacttaacgtaaccgtaaaaacggtaaccgttggtacgggtacctcgtacccgtaacccgtattaccgttcgttaccctttacgtaccgtttccccgttaccccgaccttacgttaccgttagtaac

SEQ ID NO: 165394 - DNA, 537 bp, Homo sapiens
  misc_feature: GYAE6OF02IV7M6.44.73.G07.1.454.CMB.1.raw
tcagacagtatatacacgaccggtgctcgatttagctctacgctcagggggatcaggactcctcagttcaccttctcacaatgaggctccctgctcagctcctggggctgctaatgctctggggtctcagggtccagtggagatattataatgactcagtctcccctctccctggccgtcacccctggagagccggcctccatctcctgtaggtctagtgagagtcttggaggtcagaacatctatgtggactggtacttgcagaagaccgggcagtctccacaactcctgatctatttgggtccacgtcgggcctccggggtctcgtgacaggttcagtgccagtcgcatcacacacagtatttcacactgcacatcagcagagtggaggctagacgtagtggttggggtcttagttactgctatacctaagttacctaaccgtaacccgttcacccgttcgggacgaacgggacacgtacgttggaagtagttaaggacgtaacgtgtacggcgtcgacctaccgtatcgttacg

SEQ ID NO: 165395 - DNA, 766 bp, Homo sapiens
  misc_feature: GYAE6OF02H9B5H.44.73.G07.1.454.CMB.1.raw
  modified_base (191)..(191): a, c, t, g, unknown or other
  misc_feature (191)..(191): n is a, c, g, or t
  modified_base (203)..(203): a, c, t, g, unknown or other
  misc_feature (203)..(203): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagagatcaccggagatattgtgttgacacagtctccaggcacctgtcttgtctcagggganagagccacctcncctgtagggccagtcggagtgttgctaagtacctagcctaggtaccaacagaaacctggaccaggctcccgaggcctcctcatctatgatcgacactccaacgacgggtcacgtggaccaccccgagacctagggttaccaagggttcggcgtaaggttcggggttacgtagggggaacctaacggtactttccaaacgttccgtacctacccggttacaacggtcctaaacgttcggtaaccgaacggtacccgttaagggtaaacgttaacgttttttacggaccgtttaaaggtttttaaacgttttaaccgttacgggttacctaaggtaccgtaacgggttcccgttttacccgttcccggaacgggtccccggtaaccgtttaccgttacccggttttaccgggggggaccgggggggtaacccgtaaacgggggttcgggaaacgggtaacttaccgggaaccggtaaccggtaaaccgttgggtcgggtacctacggtaccctaaccgtacgttcgttacgttcctttacgacgtttccccgtaccccggtaccc

SEQ ID NO: 165396 - DNA, 613 bp, Homo sapiens
  misc_feature: GYAE6OF02HCQ70.44.73.G07.1.454.CMB.1.raw
  modified_base (408)..(408): a, c, t, g, unknown or other
  misc_feature (408)..(408): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccgggggaacagccaccctctcttgcagggccggccagactgttgacgacgacttagcctggtaccaacagaagcctggccaggctcccagacctcctcatctatgattacttctaggtagggcccttcgtgggcactccccaggccccgtctttcaggtgggacaggttcggggtctggggacaggaccttcactctcaacctatccaccagccctaggacncctagaagtattttgacttagtttattacttgtactactaccgttaagaagtcggtacctaccgtaattacttacctacgtttaccggcccgttacgggacctaaggtacggtactaacgtacaaacgtactaggtcggtcgtacggccaccgtacttcgttcgtttaccttctacttcccgtttacccgccttacttccgtacg

SEQ ID NO: 165397 - DNA, 651 bp, Homo sapiens
  misc_feature: GYAE6OF02F1XEB.44.73.G07.1.454.CMB.1.raw
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacagtctccaggcaccctgtctttgtctccaggggagagagccaccctctcctgtacggccagtcggagtgttgctaagtacctagcctggtaccaacagaaacctggaccaggcctcccaggctcctcatctatgatgcatcccaacgagggtcacgtggaccaccccgagaccaggttccaggtcggctaggtcgggtcgtaggggactaggtaccttacacctcgtactaccgtcacgcaagtcgtaactcgtccgtagaacgttatttcggacttaagtttaacttacgttagtacgacgtcgtacgtccgtttacccgtccgtacggtccctcgttaccgttaaccggttccggggaccgggggtacctaaggggtcggaacgtactaccggaacggtaccgtaacgtgggtaccgtcgttaccgacgtaccctacgttccgttagttacctttccgtaccgttcccgttaccccgtacttacgttacg

SEQ ID NO: 165398 - DNA, 763 bp, Homo sapiens
  misc_feature: GYAE6OF02ITJ3X.44.73.G07.1.454.CMB.1.raw
  modified_base (198)..(198): a, c, t, g, unknown or other
  misc_feature (198)..(198): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtcctttgtctaccgggggaacncgccacctctccttgcagggccgcagactgttgacgacgacttagcctacggtaaccaacgagaacgtccgtcggcccgaggctacccgagtaacctccctacactctatagattacctttactaggtacgggccttcgcgaccaccgttcccacggtcccgtactcgtggtacggctagggttcgggtacgtcgggaactacggtaacctcgaaccttctaccgaacctactacctaacccacggtaaccctagggtaaccgtacccgtacggtaaagttacttttacgggaacctttacggttttaaacttccgtttaagttacccgtaaccttaaccggtaaaggtacgggttaccgtacccttaaccgtaaacgtttaaatttacccgtaccgtttttaacccgggtaccccgtaacggggtaaacctaaaccgggttagtaaccgttaactaaccggtaaaaccgttacgttaacggtccggtactacggtaacccaaccttacgtcctttaccggttactttaaccgcggttacccttcccgtacctacgtttctaacg

SEQ ID NO: 165399 - DNA, 532 bp, Homo sapiens
  misc_feature: GYAE6OF02FR7YS.44.73.G07.1.454.CMB.1.raw
tcagacagtatatacacgaccggtgctcgatttagctctacgctcagggggatcaggactcctcagttcaccttctcacaatgaggctccctgctcagctcctggggctgctaatgctctgggtctcagggtccagtggagatattataatgactcagtctcccctctccctggccgtcacccctggagagccggcctccatctcctgtaggtctagtgagagtcttggaggtcagaacatctatgtggactggtacttgcagaagaccgggcagtctccacaactcctgatctatttgggttccactcgggcctccggggtctctgacaggttcagtgccagtgcatcacacacagatttcacactgcacatcagcagagtggagctgacgatgttgggtctattactgcatcaagtttctaaccgtaaaccccgttcacccgtttcgggacaacggggaccacggaccttaggaacgtaattaacggaccgtaacgttggtgggccttaggaccctaccattaccgttcg

SEQ ID NO: 165400 - DNA, 699 bp, Homo sapiens
  misc_feature: GYAE6OF02IF2XX.44.73.G07.1.454.CMB.1.raw
  modified_base (196)..(196): a, c, t, g, unknown or other
  misc_feature (196)..(196): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtcttgtcgtccggggaacgngccacccgtctcttgcgagggccgcagactgttgacgcgtacttagcctggtaccaacagaagcctcggccaggcctaccccgagaccttcctcgattcctatgatacctttgtaggtacggggtccttacgtggcactccccgaggccccgtacgttcaggttcggacgtaggttgggtcgtagggactaggtaccttcgaacctctaccaaccacgttaccaccgtacgcccgtaagacgtcccgtaagtaacgttacgtttttacgacgttaacgttttacgtttaaccgtgttaccgtacgtagaccggtttcccggttacctacccggtaacgggtccccgtactacccggttccgggtttaccgggggaccgggggtaccgtaacggggtaggacgtacggtacgaacggtacggtacgtggtcggtaccgtcggacctaccgtagttccgttcgtttaccgttcgtacgttcccttcccggactcgttaccgtaag

SEQ ID NO: 165401 - DNA, 533 bp, Homo sapiens
  misc_feature: GYAE6OF02GVBD8.44.73.G07.1.454.CMB.1.raw
  modified_base (324)..(324): a, c, t, g, unknown or other
  misc_feature (324)..(324): n is a, c, g, or t
  modified_base (379)..(379): a, c, t, g, unknown or other
  misc_feature (379)..(379): n is a, c, g, or t
tcagacagtatatacacgaccggtgctcgatttagctctacgctcaggggggaactgctcagttaggacccagagggaaccatggaagccccagctcagcttctcttcctcctgctactctggctcccagattccaccggcgaaattgtgttgacacaatctccagccaccctgtctttgtctccgggggaacgagccaccctctcttgcagggccggccagactgttgacgacgacttagcctggtaccaacagaagcctggccaggctcccagactcctcatctatgatacttctagtagggcctctggcatcccagcccgnttcagtggcaggtgggtctggggacagactttcactctcaccatcacagcctagngcctgaagtattttgctagtttattactgtctacaccgtaagagtggcctacaatacttcactttcggccctgggaaccaaagtggaatatacaaaacgtacgtgtggctgcacattctgttccttacacttcttccccgctacttctagtaac

SEQ ID NO: 165402 - DNA, 617 bp, Homo sapiens
  misc_feature: GYAE6OF02H4KXU.44.73.G07.1.454.CMB.1.raw
  modified_base (222)..(222): a, c, t, g, unknown or other
  misc_feature (222)..(222): n is a, c, g, or t
  modified_base (237)..(237): a, c, t, g, unknown or other
  misc_feature (237)..(237): n is a, c, g, or t
tcagacagtatatacacgaccggtgctcgatttagctctacgctcaggggccctgggagcacagctcatcaccatggactgggacctggaggttcctctttgtggtggcagcaactacaggtgtccagtcccaggtgcgtctggtgcaatctggggctgaaatgaagagcctgggtcctcggtgaggtctcctgcacggcttctggagcatcttcagaactntcttatcactgggtncgacacggccctggacaagggcttggagtggagtggggtggctcgtccctatttggacaagcaactacgcacagaattccgaggcagactcacgattaccgcggacaatccagagtcgacacgtacctatagtggatctcgcgaccaactggaacgagttcgtaggacggacgaccggtaccctttaattacgttttcgcggccgacgtaaggaaaccttaaaacgttttacccttaccgtttacggtttttacggggaccggttaggtagtacgttacgtacttagtagtagtttaggtttcggggaaccgtaacggggtactaagtcggtaccgtaccgttacgttaccgttaccgacgttcccctaccgtaacccgg

SEQ ID NO: 165403 - DNA, 669 bp, Homo sapiens
  misc_feature: GYAE6OF02JZWTN.44.73.G07.1.454.CMB.1.raw
  modified_base (264)..(264): a, c, t, g, unknown or other
  misc_feature (264)..(264): n is a, c, g, or t
  modified_base (368)..(368): a, c, t, g, unknown or other
  misc_feature (368)..(368): n is a, c, g, or t
tcagacagtatatacacgaccggtgctcgatttagctctacgctcagggggaggaactgctcagttaggacccagaggaaccatggaagcccagctcagcttctcttcctcctgctactctggctcccagtacttccaccggcgaaattgtgttgacacaatctccagccacctgtcttgtcgtccggggaacagccacctctcgttgcagggccgccagctggttcgacgacgacttacgccgttaggtacccaatacggaanccgtggccgaaggcctcccagactcctcactctatgactctataggacggtcctagtcggccactcccgacgcccgtctcgtaaggtcgacgtagtcgggtacngggtacctagtcctactacgttcacacctaatccacgacgtccctagggtacctcgtacgtaatttacgttagtacttacgtttaactacggtttcttaccgtaacgtacgtaaacggtacggtttaccgaccgttaccgtaaacttcgttaccgtttacccgtacccggttacgggtacccggaaaccgttaacggtacgttacgtaatacccgtaaaagttccgttaaggtacgtcgtacgctaaccgtgtacgttcgtacttaccgttactaaccctttcccggtacacgttactacg

SEQ ID NO: 165404 - DNA, 748 bp, Homo sapiens
  misc_feature: GYAE6OF02ICDFO.44.73.G07.1.454.CMB.1.raw
  modified_base (212)..(212): a, c, t, g, unknown or other
  misc_feature (212)..(212): n is a, c, g, or t
  modified_base (232)..(232): a, c, t, g, unknown or other
  misc_feature (232)..(232): n is a, c, g, or t
  modified_base (239)..(239): a, c, t, g, unknown or other
  misc_feature (239)..(239): n is a, c, g, or t
tcagacagtatatacacgaccggtgctcgatttagctctacgctcgaggggccctgggagcacagctcatcaccatggactggacctggaggttccctctttgtggtggcagcgaactacaggtgtccagtcccaggtgcgtctggtgcaatcgtggggactgaaatgaagagcctgggtcctcggtgaaggtcctcgtgcacggtcttcgnggagcatcgttcaagaactntacttanccacgtgggtgcgacgacggccctggaactaagggcttaggagtcggagtggggtgggcgttccgtacccctaagttttacggacgtaagtaccgtaaaactcggaccacgtaacggtaaaacttccggaaggcgacggactacgacgtacgttaccgacgggtacgaagtaccgacgtaggcgacgtacgtactacgtaagtcggagtcgtaggaccgaccgaaccgtggaacggtacttacgtacggaacgggtacccgaccgggtaacccttaacgttacgttttaccgtcggtaccggtaacgtaacgtaaaacgttaaaacgttttaacctaccggtttaccggtttttacggggacggttacggttacgtaacggtacgtacgtttaagtcggttaaggtttaaccgggtttacggggaaccgttaaacgggtacgtaacggtttacggtacgtacccgttaccgttacgttacccgtaacggtcccctaacccggtaaccgg

SEQ ID NO: 165405 - DNA, 578 bp, Homo sapiens
  misc_feature: GYAE6OF02GXFR2.44.73.G07.1.454.CMB.1.raw
  modified_base (244)..(244): a, c, t, g, unknown or other
  misc_feature (244)..(244): n is a, c, g, or t
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagaagcctgggtcctcggtgaaggtctcctgcacggcttcgtggaggcatcttcaagaaactatcttatcacctgggtcncgacacggcccctggacaagggctgagtggatgggtggctcgtccctaagttttggactaagcaaactcgcacagaattccagggcagactcacgataccgacgacgaatccaagacgtgcacgcctactagtggagctagcgacaaccgtgagatctgaggacacggcctatactttctcgcgcgagaactaaaactttactacctacgttttacgggacggtagtagtagtagtacttagtagtattagttacggggaccgtaacgggaacgtaagttacggtaccgtaccggttccgttaccgttcgtaccgtacctacccgtaacccggg

SEQ ID NO: 165406 - DNA, 546 bp, Homo sapiens
  misc_feature: GYAE6OF02FP4IF.44.73.G07.1.454.CMB.1.raw
  modified_base (239)..(239): a, c, t, g, unknown or other
  misc_feature (239)..(239): n is a, c, g, or t
  modified_base (396)..(396): a, c, t, g, unknown or other
  misc_feature (396)..(396): n is a, c, g, or t
  modified_base (426)..(426): a, c, t, g, unknown or other
  misc_feature (426)..(426): n is a, c, g, or t
  modified_base (529)..(529): a, c, t, g, unknown or other
  misc_feature (529)..(529): n is a, c, g, or t
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagagcctgggtcctcggtgaaggtctcctgcacggcttctggaggcatcttcagaactatcttatcacctgggtncgacaggcccctggacaagggcttgagtggatgggtggctcggtccccaattttggactaagcaactacgcacagaaattccgagggcagacgtcacgattaccgcgacgaatccacgacgtgccagccctatagtggagctgcgcaacctgagtanctgaggacacggccctattacttctgccgngacgaactaaaactttacaccttacgttttgggacggtagtgatgtcttatgattagttggggcctaagggactaacgtgtacgtacccgttcttccttaccncgtccctaccaacccgg

SEQ ID NO: 165407 - DNA, 562 bp, Homo sapiens
  misc_feature: GYAE6OF02FNRH0.44.73.G07.1.454.CMB.1.raw
  modified_base (271)..(271): a, c, t, g, unknown or other
  misc_feature (271)..(271): n is a, c, g, or t
tcagacagtatatacacgaccggtgctcgatttagctctacgctcagggggatcaggactcctcagttcaccttctcacaatgaggctccctgctcagctcctggggctgctaatgctctgggtctcagggtccagtggagatattataatgactcagtctcccctctccctggccgtcacccctggagagccggcctccatctcctgtaggtctagtgagagtcttggaggtcagaacatctatgtggactggtactgcagaagccgggnagtcctccacaactcctgatctattgggtccacgtcgggcctcggggtctcgtgacgaggttcagtcgccagtcgcatcacacacagtactttcactactgcctacactcgagcgagaggtggaggctgacggtagtgggttcggggtccttagttacgtcggactagtccctaagtccgtaacctaaccccgttctaacccgtttcgggaccgtaacggggtaccacgtacgttagaggtaacttaaggaccgtaacggtcgtcggtctcggacaccgtactcgttaccg

SEQ ID NO: 165408 - DNA, 682 bp, Homo sapiens
  misc_feature: GYAE6OF02FIC5E.44.73.G07.1.454.CMB.1.raw
  modified_base (245)..(245): a, c, t, g, unknown or other
  misc_feature (245)..(245): n is a, c, g, or t
  modified_base (390)..(390): a, c, t, g, unknown or other
  misc_feature (390)..(390): n is a, c, g, or t
tcagacagtatatacacgaccggtgctcgatttagctctacgctcaggggccctgggagcacagctcatcaccatggactggacctggaggttcctcttgtggtggcagcaactacaggtgtccagtcccaggtgcgtctggtgcaatcgtggggctgaaatgaagaagcctgggtcctcggtgaaggtctcctgcacggcttcgtgggaggcattcgttcagaaactatcttatcacctgggtncgacacggcccctggacaagggcttgagtggatgggtggctcggtccccagttttggacagacaactacgcacagaattccagggcagactcacgattaccgcgacgaatccacgagtgcagcctatagtggagcgtgcgcaccngagactacgtaggtacggaccgacggtacccctaattacgtttacgtcggtaccgtacgaacggtaaaccgttaaaaactttttacccgtacccgtttaactttttttacggggggacggtaacgggtttagtacgtttacgttacgtttaacgttaggttacgtttacgggtttaccgggggtaaccgtaaacgggggttaacctaaagggtttacccgggttaacccgttaccggttacccgttcccgtttaaccggacccggtttacccgtacccccttaaccccgggg

SEQ ID NO: 165409 - DNA, 639 bp, Homo sapiens
  misc_feature: GYAE6OF02IX82T.44.73.G07.1.454.CMB.1.raw
  modified_base (242)..(242): a, c, t, g, unknown or other
  misc_feature (242)..(242): n is a, c, g, or t
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagaagcctgggtcctcggtgaaggtctcctgcacggcttctggaggcatcttcaagaactatcttatccacctgggtncgacacggcccctggacagggcttgagtggagtgggtgggctcgtaccctaagttttcggaacagacaaactacgacaacgaagtaaacttccgagggcaacggactacgaacgtacgttaccggacggaacgtaactaccacggacgtgacagaccctagtagtaggagtctggaccgactaaccgtggaatacgtcgtaggaacggaccaccgggtacccttaagttacgtttcgtaggccgtacgtaacgtaaacttaaactttaccgttacctttaacggttttcgggacgtagttgtaagtgtacttagttagacgtttaggttcggggacgtaagggactaaggttcgtaccgaccgttcgtcgttaccgacgtacccgtacgtaacccgg

SEQ ID NO: 165410 - DNA, 713 bp, Homo sapiens
  misc_feature: GYAE6OF02HWXZ8.44.73.G07.1.454.CMB.1.raw
  modified_base (206)..(206): a, c, t, g, unknown or other
  misc_feature (206)..(206): n is a, c, g, or t
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagagcgtgggtcctcggtgaaggtctcctgcacggtcttcgnggaggcatcttacgaagtaaacttatcttactcctacgtgggtgaccgacgacggcccctaggacgaaggtctgagtggagtgggtggctccgtaccctaagtttggaacagtacaacgtacgcacgaacgtaaacttccgaagggcaacgacgtacgacgtacttaaccggcggtaacgaactaccgacgagtacgacgacgacctatagtaggacgcgtacggacgaccgtaacgtggaacgtacgtagtacggaacgggaccgtacccggtacccttaagtttacgtttccgtacggccgtaacgaacgtaaacttaaaacgtttaccgtaccttacggtttttcggggacggttaggttacgtaagttcggtaagtttataggttacgtttaacgggtttacgggggaaccggtaaaacgggtaacgttaaacggtcggtttaacccgaccggtttccgttacccgttaccggtaaccgttcccgtacccgtaaaccccgggg

SEQ ID NO: 165411 - DNA, 705 bp, Homo sapiens
  misc_feature: GYAE6OF02GGCTS.44.73.G07.1.454.CMB.1.raw
  modified_base (182)..(182): a, c, t, g, unknown or other
  misc_feature (182)..(182): n is a, c, g, or t
  modified_base (224)..(224): a, c, t, g, unknown or other
  misc_feature (224)..(224): n is a, c, g, or t
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatcgtggggctgaatgaagagcctgggtcctcggngaaggtctctgcacggcttcgtggagcatcttcaagaaactntcttatcaccgtgggtgcgacgacggcccctggacgaagggtctgaggtggagtgggtggcgtccgtaccctagtttggacagacaactacgacacagtaaacttccgaggacacgactacgacgtacgttaccgacggaacaacgtacccgacgaggtcgaccgacgtaccctaagtgtaggacgtcgtcggcgacctaaccgtgacgtacgtcgttacggaacggtaccgaccggtaccttagttaacgtttcgtacggtccgaacgtaacgtaaaaccttaaaacgttttaccgttacccgtttaacggtttttacggggaccgggttaagttcgtaacgtacgttacgtttacgtaggttacgtttacgggtttacggggtaaccggtaaacgggtaacgtaacggtttcggtacccgttacccggttaccgttacccgttaccggtacccgtacccgttaccccgtaaaccccggg

SEQ ID NO: 165412 - DNA, 575 bp, Homo sapiens
  misc_feature: GYAE6OF02GIU3A.44.73.G07.1.454.CMB.1.raw
  modified_base (226)..(226): a, c, t, g, unknown or other
  misc_feature (226)..(226): n is a, c, g, or t
  modified_base (339)..(339): a, c, t, g, unknown or other
  misc_feature (339)..(339): n is a, c, g, or t
  modified_base (351)..(351): a, c, t, g, unknown or other
  misc_feature (351)..(351): n is a, c, g, or t
  modified_base (382)..(382): a, c, t, g, unknown or other
  misc_feature (382)..(382): n is a, c, g, or t
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagaagcctgggtcctcggtgaaggtctcctgcacggcttcgtggaggcatcttcagaaactntcttatcacctgggtgcgacacggcccctggaccaagggcttgagtggagtggggtggctcgtccctaatttcggacaagcaaactacgcacaagaaattccgagggcagacncacgattaccgnggaacaatccacgagtgcagctatagtgganactgcgacaacctgagatcgtagacggaccgacggacccttattactttctcggcgcgaacgtaactaaaaactttctaccttacgtttttcgggacggtagtagatgtacttagtagtagttagttgggaacaagggtactaagtacggtaccaccggttcctacgttacgccgtacctacccgtaacccgg

SEQ ID NO: 165413 - DNA, 688 bp, Homo sapiens
  misc_feature: GYAE6OF02H6VHJ.44.73.G07.1.454.CMB.1.raw
  modified_base (275)..(275): a, c, t, g, unknown or other
  misc_feature (275)..(275): n is a, c, g, or t
  modified_base (349)..(349): a, c, t, g, unknown or other
  misc_feature (349)..(349): n is a, c, g, or t
tcagacagtatatacacgaccggtgctcgatttagctctacgctcagggggatcaggactcctcagttcaccttctcacaatgaggcctccctgctcagctcctggggctgctaatgctctgggtctcagggtccaggtggagatattataatgactcagtcctcccctctccctggccgtcaccctggagcgccggcctcatctctgtaggtctaggtgagacgtcgttggaggtcagaacatctagtgtggctggtactgcagaacggccggnacgtctaccacactctgatcttagtttcggtccacgtccgggccgttccggggtctcgtcgtacgtggttacgnggtcgccgtagttcgactactaccgaacctacgaacgtaacgttacgtttacccaccgtaaccgttcggacctaaccgtaacgttaccgaggaccgtaagggtacgggtcgggaacggtaccgtagggtaaccggttaggtttaggggtttccggggttaatttaccgtttacggtacgtactaacgttaccgtaaacggtttacccctaacccgtaaaccccgtttacctaccggttaccggggaacgtaacgggtaacctaccggtacgttaggaacgttaacgttaacggacgtaacgttcggtacggtcctacggaccctaacgtacttgttccg

SEQ ID NO: 165414 - DNA, 747 bp, Homo sapiens
  misc_feature: GYAE6OF02IPLXO.44.73.G07.1.454.CMB.1.raw
tcagacagtatatacacgaccggtgctcgatttagctctacgctcagggggactgctcagttaggaccagagggaaccatggaagcccagctcagcttctcttcctcctgctactctggctcccagacttccaccggcgaaatttgtgttgacactaatctccagcccaccttgtctttcggtcgtaccgggggaacacgcccacctctccgttgcgacggggcccggccaggactggttcgacgacgtacttagcctaggtaaccaaacgagtaacgccgtaggccaaggcctaccgagacctcctacacgtctataggtactacgtttctaggttacggcccttcgtaggcctaactcccgaacgccccgttcgttcagggttccggcaggggttcgggtcctaggggaactggtactttcactcgcctaaccgctaccgtaaccgaacggtccttaagccgggccttaagaacgttacttttacggacgttaacgttttacgttacgttacgtaccgttaactaaaccggttaacgtaacggttacggtcccttaaaccgttaaatttaaccgttttacgtaacccgtttttccggggaaccccgtttacggggaaaacccgtaacggttacgggttaacttaacttaacccgggtaaaaacgtaccgttacggttacgcgtacgaccgtaacgtacgtcgtcgttacctttcaccctttcgtccctacgtcttccggtataac

SEQ ID NO: 165415 - DNA, 742 bp, Homo sapiens
  misc_feature: GYAE6OF02JRB83.44.73.G07.1.454.CMB.1.raw
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatcgtgggctgaatgaagaagccgtgggtcctcggtgaaggtctcctgccgacggtcttcgtggaggcatcttacaagaaacttatcttatccaccgtgggtcgcgacgacggccccgtaggacgtagggtcgttgaggtcggagttgggtcggtccgtccgtacccctaagtttacggacaacgtacaaaccgtaccgacaacgaagtaaacgttaccgagggacgacgtacctaacacgtaactacccggacggtaaccgaactacgaacgtagtcgctacgtactaatagtacggcgcgtacgcgacgaaccgtaggacgtactcgtcggaagacccgtaccggtccctttagtttacgtttccgtacggtaccgaacggtaacgtaaaccttaaaaccttttaccggttaaccgtttaccggtttttacggggaggttaccggttaggtaaccttggttaccgtttaagtcggttaacgtttacgggtttcggggaaaccggtaacgggtaacgttaaccggttacggttaacccgttaccggtttaccttaaccgtttaccgacccggttaccccacccggtaaacccgg

SEQ ID NO: 165416 - DNA, 765 bp, Homo sapiens
  misc_feature: GYAE6OF02FOFKW.44.73.G07.1.454.CMB.1.raw
tcagacagtatatacacgaccggtgctcgatttagctctacgctcagggggaggaactgctcagttaggacccagagggaccatggaagccccagctcagcttctcttcctcctgctactctggctcccagattccaccggcgaaattgtgttgacacaatctccagccaccctgtctttgtctccgggggaacagccaccctctcttgcagggccggccagacctggttgacgacgtacttacgcctggtaccaacagaacgccgtggccaggcctcccagacctcctcactctatgtactacttctaggtacggggaccttcgtcgggcacttccccgagtccccgtctttcgaggttcgcgtaggtcggggtcgtgggacacggaccttcgacctcgtaccaccgtaacttcccaaccgaacggtccctaacggtccgtacgtacggtaaacgtagtttttcgacgttaacggtttttaacttaaccgtttcgttaacccgttaaccgtaaccgggtttaaacgtaacggttaccgggtaacccttacccgtaaactttacgtttacccttaaccgttttcccgggaccccgtttaacggggaaacccttaaagggttacggttaaacgtaacgttaaccgtaaaaaccgtaacgttacggttcgggtaccgttccggtaaccctaaccgtaactttccgttaccgtttacttaccttaccgttccccgtttacccccggtacccttaccgttcgttaaccg

SEQ ID NO: 165417 - DNA, 763 bp, Homo sapiens
  misc_feature: GYAE6OF02I1CRV.44.73.G07.1.454.CMB.1.raw
tcagacagtatatacacgaccggtgctcgatttagctctacgctcagggggggaactgctcagttaggacccagagggaaccatggaagccccagctcagcttctcttcctcctgctactctggctcccagagatcaccggagatattgtgttgacacagtctccaggccaccctgttcctttgtcctccgaggggagagacgcccacccttctcctggtacgggccaggtccggagttgttgacgtaacgtaccgtagccctaggtaccaacaacgaaacctggccaggcctcccaggcctcctcatctatgatcgactatacccgaagtacgggtaccacgtacgggccccaaccccgaagtaccggtaggtttaccgaggttcggactaggggttcgggtccgtacgggggaacacggtacctttcaccgtttcctaccgtaccgtcagtaccaagttcgaccgagtccgtaagtacgtttacttttcgtacgtttaagttttattaccgttacgtacgtacggtactaccgggttaccgttaccccgtaccggtaccggtccccgttaccgtttacccggttaccggggtttaccggggggacccggggggttaacgtaacggggttcgggtaaaggtaccgttaacgggacgtaaccgggttaacgttcggggttaccggtacggttccgaacccggtaaccttacgttaccgtttacgtttacctttaccgttcccgtaccccgttcttacgttacg

SEQ ID NO: 165418 - DNA, 594 bp, Homo sapiens
  misc_feature: GYAE6OF02GCFSL.44.73.G07.1.454.CMB.1.raw
  modified_base (375)..(375): a, c, t, g, unknown or other
  misc_feature (375)..(375): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtctccgggggaacagccaccctctcttgcagggccggccagactgttgacgacgacttagcctggtaccaacagagcctggccaggctcccagactcctcatctatgatacttctagtcgggcctctggcatcccagcccgcttcagtggcaggtgggtctgggacaggtacttcacttctcaccatccaccngcctagacgcctaggaacgtattttgctaggttttattaccgtgtactacaaccgttaaggaagtcggccttaccaattacttcctacgtttccggcccttcgggaacctaaaggtcggtaattaactaccgaaacgtaactggttacggactacggcctaacccattccgttacgttctttaccactttacccgttccccgaccttactccgttaacg

SEQ ID NO: 165419 - DNA, 812 bp, Homo sapiens
  misc_feature: GYAE6OF02IE8JB.44.73.G07.1.454.CMB.1.raw
  modified_base (263)..(263): a, c, t, g, unknown or other
  misc_feature (263)..(263): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtcgtccgggggaacagccacccttctcttgcgacgggcccggcagtactgttcgacgacgacttagccgttggtaccaaanagaacgcctaggccgaggcctccacgaccttcctcaatctagttggtgctacgtcccaaccggacggggacctacgttacgggttacctccccggagtccctaggttaccgaggttacgggcgtagggttcgggttccgtacggggtaaccgaacgggtttaacggtttcccaaccgtttacctacccgtaaaccgtacgttcccgaaacggggtccccgggtcccttccggggaaccttacggtttcccgttagggttaacgggtttctttttacgggttactttaacgtttttaacgtttacttacggttacctacggtaccgttaaagttaaacgttaaaacgtttacccgttcgggtaccctttcgttaccggtaccgggttttcccgggggaacgggggtacctaaaggggtcggaaaccgtagtaaacccgtaaaacgggttcgttacgggtacggttcacccggttctaacccggttgtttaccgtccgttttaccgttacgttacctttccccgttacccgaccgtttacgttcttaacgg

SEQ ID NO: 165420 - DNA, 804 bp, Homo sapiens
  misc_feature: GYAE6OF02GVBHH.44.73.G07.1.454.CMB.1.raw
  modified_base (345)..(345): a, c, t, g, unknown or other
  misc_feature (345)..(345): n is a, c, g, or t
tcagacagtatatacacgaccggtgctcgatttagctctacgctcaggggggaactgctcagttaggacccagagggaaccatggaagccccagctcagcttctcttctcctgctactctggctccagattccaccggcgaaattgtgttgacacaatctccagccaccctgtctttgtctccgggggaacagccaccctctcttgcgagggccgcagactggttgacgacgacttacgccgttaggtaccaacagaacggcctggaccaggcctcccgagacctccgtcatctatgattacttcgtaggtacgggccttcgtggacacttcccgacgccccgtntttcgaaggtcggctacgggttcgggtctcgggggaactagggttacctttccgaacttcccgtaccgaacctagttacccaacccgtaacgtcccgttaaaggaaccgtcccgttaaggtaaacgtttagtttttacggacgtttaacggttttactttaaccgttcgtttaaccgtaaccgtaacccggttaaaggtaaacggttcggtaccccttaaccgtaaactttacgtttaccgttacccggttttaccgggacccggttaaccgggtaaaccggttaaaacgggttacgggttaaacgttaacgtaaaccgtaaaaccggtaaaccgttagggttaccggacgttaccggtaacccgtaacccggttaacctttccggttacgtttaccctttccgttaacgtttccccgtttaaccccgtacccttaaccgtttacccgtaacgttaacg

SEQ ID NO: 165421 - DNA, 779 bp, Homo sapiens
  misc_feature: GYAE6OF02H37DT.44.73.G07.1.454.CMB.1.raw
  modified_base (256)..(256): a, c, t, g, unknown or other
  misc_feature (256)..(256): n is a, c, g, or t
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatcgtgggctagaaatgaagagccgtgggtcctcggtagaaggtctccgtgcacggtcttcgtggaggctatccttacaagtaaactattacttaatcaacgttgggtnccgaccgacggtcccgtaggaacgaacgggtcttaggaggtaggtagtgggtaggtaatacgtacttcccgtttcgtttttacggacttaccgtaactaccgtaccttacgacgaaccggtaacggttaccgtcccggggaataacggtaacgttaaccgtaacgttaacccggcgaaacgtaacgtaccaacgagtaacaccgtacgtactacacgttagaacgtaagtcgtaactttacgttacaaaccgtaccgtaacgtacgtaaccggtaccgttacctaagttaccgtaggttacgacgggtacggtaccgtacccgtacccgaccgttacgtacggtactaggtacggtaccgttaccgtttagaacggtacgttaccgggacggggtaaccggtaccggggtaaccccgttggttaaccgttaacggtttccgtaacccggttaaccgtccgttacgaccccgtttaaccccgaaaccgggtacccgggtacccccttaacgggtttacccccgg

SEQ ID NO: 165422 - DNA, 563 bp, Homo sapiens
  misc_feature: GYAE6OF02HOL98.44.73.G07.1.454.CMB.1.raw
  modified_base (358)..(358): a, c, t, g, unknown or other
  misc_feature (358)..(358): n is a, c, g, or t
  modified_base (420)..(420): a, c, t, g, unknown or other
  misc_feature (420)..(420): n is a, c, g, or t
  modified_base (445)..(445): a, c, t, g, unknown or other
  misc_feature (445)..(445): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagataccactggagaaatagtgatgacgcagtctccagccaccctgtctgtgtctccaggggaaagagttttccaccctctcctgcagggccagtcagagtgttaccagcaacttagcctggtaccaccagaaacctgggcaggctcccaggcctcctcatctatggaacatccaccagggccactggtatcccacccagggttcaggtggcaggtcgggtccggganagagttcactctcaccatcagccggcctgcagtctgaggtacttttgctagtttatactgtnagtctagtataataactggtccttntctacgtttcgggaccggggggtacctaagggtcggagtagtacgaaacgtacgtaggtggtacgtggacctaaccgattcgttgttcttctacgttccgttaccccgtcgtacttcg

SEQ ID NO: 165423 - DNA, 726 bp, Homo sapiens
  misc_feature: GYAE6OF02IF882.44.73.G07.1.454.CMB.1.raw
  modified_base (194)..(194): a, c, t, g, unknown or other
  misc_feature (194)..(194): n is a, c, g, or t
  modified_base (208)..(208): a, c, t, g, unknown or other
  misc_feature (208)..(208): n is a, c, g, or t
  modified_base (253)..(253): a, c, t, g, unknown or other
  misc_feature (253)..(253): n is a, c, g, or t
tcagacagtatatacacgaccggtgctcgatttagctctacgctcagggggaggaactgctcagttaggacccagagggaaccatggaagccccagctcagcttctcttcctctgctactctggctccagataccgacgggaattgtgttgacacaatctccagcccaccttgttctttgctccgaaggggaancgccaccctctccngcacggccagtcagagtgttaggacttacttagcctagtatcaancgacacctggccaggcctccgaggctcctcatctatgacttgacctatacctaagtacgggccgtaccgggcacgtaccccacggaccctagggtttaccagggttcggacgtacggttcgggttaccgttaggaacgtaaccgtagtaacccgtttccgaaccttacctccctaacctaagtccgaacgtcccgggaccgtaccggacgggtacccgggtaaacggttaggttttacgtacgtttaacggttttacgttacgttacgttaccgtaaccgtaaccggttacgaccgtacgttaccggtaccgttaacggttaccgttaggttttacgggaccggtaacggggtaaacccgacgggttacgtagggtacgtacccgtaacgaaaccgtacgtcggtacgggtctacgacgtacctacgttcgttacggttaccttcctacgtttacccttcccgtaccttaccg

SEQ ID NO: 165424 - DNA, 596 bp, Homo sapiens
  misc_feature: GYAE6OF02G4UJK.44.73.G07.1.454.CMB.1.raw
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagaagcctgggtcctcggtgaaggtctcctgcacggcttctggaggcatcttcagaaactatcttatcaccgtgggtgcgacacggcccctggaccaagggccttgagtggatggggtggctcgtccccaattttggacagacaactacgcacagaaattccagggcagactcacgactaccgcggaacaagtccaaggacgtacgcgacgccctaatagtaggacgcgtgcgaccgaacctgacgattcgtaggaggacgaccggccctattactttctcgccggacgaagaacgtaaaatttacctaccttacgtttttacgggacggtagtagtagtcgtcttagtgtattaggttcggggtaccgtaaagggtacgtaagtacggtacgtacccgttcgtaccgttcaccgtcctacccgtaacccgg

SEQ ID NO: 165425 - DNA, 745 bp, Homo sapiens
  misc_feature: GYAE6OF02FR1KK.44.73.G07.1.454.CMB.1.raw
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccacgccacccttgtctttgtcgtccgggggaacgagcccaccctctcttgcacgggccggcagactgttgacgacgacttagccgtggtaccaacagaacgcctggccaggcctccgagacctcctcatctatgacttacttctaaggtacgggtccttcgtggcctactccccgaacgccccgtcttccgtaggtcggacgtaggttgggtcgtagggaccaacgtacttccacttcacgtacctagtacccaaccgtacgtacccgaacgacgtaccgttaggtaaacggtttattttacggacgtttaacgttttacgttaaccgttcgtaaccgtaacccgtaaaccggttaaggtaacgggtcggtacccttaaccgtaaaacttctttaccgttaccgtttacccggtcccggttaaccgggtaacgttaaacgggtcgtaaacgttaactaaaccgtaaaaccgtaacgtcggttaccggacgttacggtacccctaacgttcgttacctttacggttaccctttacgttaccctttacccggttaccccgtacctaccggtttacctaacgg

SEQ ID NO: 165426 - DNA, 754 bp, Homo sapiens
  misc_feature: GYAE6OF02GECVS.44.73.G07.1.454.CMB.1.raw
  modified_base (282)..(283): a, c, t, g, unknown or other
  misc_feature (282)..(283): n is a, c, g, or t
  modified_base (288)..(288): a, c, t, g, unknown or other
  misc_feature (288)..(288): n is a, c, g, or t
tcagacagtatatacacgaccggtgctcgatttagctctacgctcagggggatcaggactcctcagttcaccttctcacaatgaggctccctgctcagctcctggggctgctaatgctctgggtctcgagggtccagtggagatattataatgactcagtctcccctctccctggccgtccaccccgtggagacgccggccctaccatcctcctggtaggtctagtggagagtcgttgggagtcagaacatctatgtggactggtactgcagacggaccggnngtccnccacactccgtgatcttagtttcggtccacgtcgggcccgtcggggtctctcggactaggttcagtcgcctaggtcgactacgtcaccactacgaagttctttaccacgtaccgtagaccaacgtactacgaacggaccgaagggtacgggacggggtaacgggtaccggtacggtaaccgggtaggttttacggggtttacggggggtttacttaacggtttacgtacggtaccttaacgtacccgttaacgtttaacccgttaaacccccgttaaacccccggtttaccgttaaaccccgggttccggggtaaaccggtaaaccgggggtaacccgttacggttaaccggtttaacgggtaaacggttaacggtttaaaccggtaaccgggtaaaccggtttagggttaccggggttacctaccgggttaaccctaccccggttacgttaccggttttaacccg

SEQ ID NO: 165427 - DNA, 692 bp, Homo sapiens
  misc_feature: GYAE6OF02JX4I1.44.73.G07.1.454.CMB.1.raw
  modified_base (482)..(482): a, c, t, g, unknown or other
  misc_feature (482)..(482): n is a, c, g, or t
tcagacagtatatacacgaccggtgctcgatttagctctacgctcagggggatcaggactcctcagttcaccttctcacaatgaggctccctgctcagctccgtggggctgctaatgctctgggtctcgacgggtccaggtggagtatattataatgactcgagtcctcccctctccctggccgtccacccgtggagcggccggcctccatctccgtgtacggtctaggtgagtagttcgttgggagtacgaagaactatacttagtggtggtacgttggttacttgacaaggaaaccggcccgggactacgtaccctcccaaacgtaccctccgtagtactttacgttaacggtttccgggttaccgtaccgggttcccgggtcccggttccggggtccttacgtacggtacgtcggttacgacggtcgaccgtgtctcgtacacgaacacacttaagttacttacactactggacactancgagcgtaggtagacgggtaacgtcgtaacgacggtagttcggggttcggttacttagtaccgtcgacgttacccttaccgtaaccgtttacccgaaacccgttacccgttaccgtaccggtaccggaacgacggtaaccacgttaaggtagtaacggtacgtaacggtaacggacgttggtacgcgtacgtaccacgttacttataccg

SEQ ID NO: 165428 - DNA, 593 bp, Homo sapiens
  misc_feature: GYAE6OF02HRBAD.44.73.G07.1.454.CMB.1.raw
  modified_base (244)..(244): a, c, t, g, unknown or other
  misc_feature (244)..(244): n is a, c, g, or t
tcagacagtatatacacgaccggtgctcgatttagctctacgctcagggggccctgggagcacagctcatcaccatggactggacctggaggttcctctttgtggtggcagcaactacaggtgtccagtcccaggtgcgtctggtgcaatctggggctgaaatgaagaagcctgggtcctcggtgaaggtctcctgcacggcttcgtggaggcatcttcaagaaactatcttatcacctgggtncgacacggcccctggacaagggcttgagtggagtgggtgggctcgtcccctaattttggacaagcaaactacgcaacagaaattccagggcagactcaacgattaccggcggacgaatccacgagtagcagcctatagtggagctgcgaccaacgtgagctcgtggacggaccaccggccttaattacgtttcgtaggccgtacgaacgtaacctaaaatttcctaccttacggttttacgggcggtagtgtaatcgtacttagtagtattagtttacggggacgtaagggtactaagttacggtcgtaaccgttcgtaccgttacgacgtccccgtaccgtaacccgg

SEQ ID NO: 165429 - DNA, 774 bp, Homo sapiens
  misc_feature: GYAE6OF02FOP3R.44.73.G07.1.454.CMB.1.raw
  modified_base (254)..(254): a, c, t, g, unknown or other
  misc_feature (254)..(254): n is a, c, g, or t
  modified_base (583)..(583): a, c, t, g, unknown or other
  misc_feature (583)..(583): n is a, c, g, or t
tcagacagtatatacacgaccggtgctcgatttagctctacgctcagggccctcgggagcacacgctcatcaccatggactggacctggaggttcctcgtttgtggtggcgagcaactacgaggtcgtcctagtcccaggtgcgtctggtgcaatcgtgggctgaaatgaagagcctgggtcctcggtagaacggtcctaccgtgcctacggctttcgacgggaggcctaagttccttacgaacgtaaaacttnttacgttacactaccgtgggttcgacgacgtacggtccctaggaaccgaggtcttaggaggtggaggtcgggtggccgtaccggtaccccttaaggtttcggaacaagacctaaaccgtacgactaaccgaagtaaacttaccggacggtctacgaccgtacgtaccggtacgttaaccggccgaacgtaacgttacccaaggtacgtacgcgaaccgttacctaaggttacgtcggaacgtcgtaccggacgtaaccgaacccgttaggaacgttacgtaccgggtgaacccggtaacgtacccggtaccttagtttaccgttaccgngaaccggtagaaacgtaaacttaacgtttaccctaccggttttacgggttttacgggccgtaacgtttaggactttacgacgttagtacgttaccggtttaggtacccgggttaaggaaaccggttaactacggttctaacccggttacgttacgttccgttaccaccggttacccacccggtaaccccgg

SEQ ID NO: 165430 - DNA, 933 bp, Homo sapiens
  misc_feature: GYAE6OF02HIRUQ.44.73.G07.1.454.CMB.1.raw
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatcgtggggctagaaatgaagaagccgtggtcctcggtgaaggtctcctgcgacggtcttcgtggacggctatcttacaagaaactattacttactactaccgttgggtcgacggacgacggccccgtaggacgtaacgggtcgttaggacggtgggtaggttggggtacggggtcccgttccggttaccccgttaagtttttcggaaaccgtaacggtacccgaaaaccgttacccggacgaaaccgtaaaggtaaaacccgttacccggaacgggtaccgtaacggtaacccgttaccgtaaaccgggttaaccgtttaaaccccgggaaccgggtaaaaccgtaaaccgttaccccggaacggtaacgtacggaccgtaccggtaacccttaagttaaccggtcgggtaacgtaccggtacgacccggtaaccgtaaacccggttggaacgtacgttacggtaacggaacgggtaccggtaaccggtacccctttaaagtttaacgttttccgttacggtaccgggtaacgtaaactaaaaccgtttaaaaaccgttttaccctttaaccggtttttaacggggtttttaccggggaccgggtttaacggttacgttaacgggttacgtttaacgttttagttaacggttacggtttaacgggtttaccgggggtaaaccgtaaaccggggtaacgttaacggttacccgggttaacccgttacccggtttcttaccccgtttaaccggtacccgttacccccggttaccgtaaaccccgggg

SEQ ID NO: 165431 - DNA, 687 bp, Homo sapiens
  misc_feature: GYAE6OF02HEVUH.44.73.G07.1.454.CMB.1.raw
  modified_base (247)..(247): a, c, t, g, unknown or other
  misc_feature (247)..(247): n is a, c, g, or t
  modified_base (252)..(252): a, c, t, g, unknown or other
  misc_feature (252)..(252): n is a, c, g, or t
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagaagcctgggtcctcggtgaaggtctcctgcacggcttcgtgggaggctatcttcaagaaactatcttatcaccgtgggtcncgacncggcccctggacaagggcttgagtggagtgggtgggctcgtcccctaagtttcggacaagcaaactcgcacgagaattccaggcagactacacgattaccgacggaacgaactccaacggagtcgacgacgtcctaagtatagggacgcgtcggaccgtaccgaaccgtggaacggtactacgtcggaacggtaccgaaccggtaccccttaagttacgtttactcggaccgacgtaacgaacttaaaaactttaccgtacccgtttaacggtttttacgggggaccggttaaggttacggtaacgttacggtacgtttacgtaggtacgtttacggtttacggggaccgtaaacggggtaacgtaacggttacgggtacccgtaccggttaccttacgttaccgtaaccggttacccgtaccccgtaacccggg

SEQ ID NO: 165432 - DNA, 761 bp, Homo sapiens
  misc_feature: GYAE6OF02GKD37.44.73.G07.1.454.CMB.1.raw
  modified_base (231)..(231): a, c, t, g, unknown or other
  misc_feature (231)..(231): n is a, c, g, or t
  modified_base (250)..(250): a, c, t, g, unknown or other
  misc_feature (250)..(250): n is a, c, g, or t
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagaagccgtgggtcctcggtgaacggtctcctgcacggtcttgtggagctatcttacagtaaacttntcttactctaccgtgggtnccgacgacgccccgtaggacgaaggtctaggaggtggagtgggtaggcctccgtaccccgtaagtttcggaacgtaacgtaccaaaacgtacgacctaacgaacgtaaacgttaccgaggtcgacggactccgtaacgtaccgttaccggaaccggaacctaaactcccgacggtacgtcgacacgtacctagtaacggtcggtagtacgtacgacgtccctaaaccgttggaataccgtcgtacgggaacggaacccgtaccgtaccttagttaacgtttccgtacgccggtaacgaaacgttaaaacctttaaacgtttaccgtaccgttttacgggttttacgggaccggttaggttacttacgtacgttaagtttacgtacggtttacgttaacgggtttacgggtaaacggtaaaccggttagtaagggttaccccggtttaaccgtaaccgttttcccgttacccggttaaccgtaccggtaccccttacccgggtaaaccccgg

SEQ ID NO: 165433 - DNA, 675 bp, Homo sapiens
  misc_feature: GYAE6OF02FGZG7.44.73.G07.1.454.CMB.1.raw
  modified_base (224)..(224): a, c, t, g, unknown or other
  misc_feature (224)..(224): n is a, c, g, or t
  modified_base (311)..(311): a, c, t, g, unknown or other
  misc_feature (311)..(311): n is a, c, g, or t
  modified_base (322)..(322): a, c, t, g, unknown or other
  misc_feature (322)..(322): n is a, c, g, or t
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatcgtgggctgaaatgaagagcctgggtcctcggtgaaggtctccgtgcacggtcttcgtggagcatctcagaactntctatcacgtgggtcgcgacacggcccctggacgagggtcttggaggtggagtggggtcgggcctccgacccctaagtttcggacanactaaactacnctaacgaagtaactccgaggacagactacaacgtacttaccggacggaacgtaactccgacggagtcgctacgaccttatacgtggacgcgtcgaccgacaaccgtgaacgtactcgtaggaacggtaccgaccggacctttattacttacgcggtaccgtaacgtaacgtaaaccttaaaactttccttaaccgtttacgtttttacggggacggttaacggttgaacgttcgttacgttacgttagttaggttacggtttacgggaaccggtaacgggtaaccttaacggttacggtaccgttacccgttacgttacccgttacggacccttcccgtacccgtaacccggg

SEQ ID NO: 165434 - DNA, 744 bp, Homo sapiens
  misc_feature: GYAE6OF02IPXTO.44.73.G07.1.454.CMB.1.raw
  modified_base (145)..(145): a, c, t, g, unknown or other
  misc_feature (145)..(145): n is a, c, g, or t
  modified_base (222)..(222): a, c, t, g, unknown or other
  misc_feature (222)..(222): n is a, c, g, or t
  modified_base (230)..(230): a, c, t, g, unknown or other
  misc_feature (230)..(230): n is a, c, g, or t
  modified_base (248)..(248): a, c, t, g, unknown or other
  misc_feature (248)..(248): n is a, c, g, or t
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtncaatcgtggggctgaaatgaagaagcctgggtcctcggtagaaggtctccgtgcgacggtcttctggaggcatcttnagaaactntcttagtccacgtgggtnccgacacggccctaggacaacgggcgttgaggtcggagtgggtgggctccgttacccctaagttttggacctaagacgtaaactaccggacacgtaacgtaaagttccgaagggaccgtaagaccgtaccgtaaccgacgtttaacccggacccggtaaacgaaacgttaccccgaacgtacggttcgacgaaccggtacttaaacgtacgtaacggggtacgaccgttacggaccgtaacccgaaacttacggaacgtacgtcggtaaagggacgtaacccgaccggtacccttaagttaccgtttcgtacggcgtacggtaacgtaaaccgttaaaaaccgttttccgtaaccgtttacggtttttacgggaaccgggttagtacggttaagttcggtaacctttagttagtacgttagtttacggggtaacccaagggtaactaagtcgtacgtaccgttcgttacctacgtcctaccgtacccgtaaccggg

SEQ ID NO: 165435 - DNA, 718 bp, Homo sapiens
  misc_feature: GYAE6OF02GU49Q.44.73.G07.1.454.CMB.1.raw
  modified_base (145)..(145): a, c, t, g, unknown or other
  misc_feature (145)..(145): n is a, c, g, or t
  modified_base (192)..(192): a, c, t, g, unknown or other
  misc_feature (192)..(192): n is a, c, g, or t
  modified_base (651)..(651): a, c, t, g, unknown or other
  misc_feature (651)..(651): n is a, c, g, or t
  modified_base (699)..(699): a, c, t, g, unknown or other
  misc_feature (699)..(699): n is a, c, g, or t
  modified_base (709)..(709): a, c, t, g, unknown or other
  misc_feature (709)..(709): n is a, c, g, or t
  modified_base (715)..(715): a, c, t, g, unknown or other
  misc_feature (715)..(715): n is a, c, g, or t
tcagacagtatatacacgaccggtgctcgatttagctctacgctcagggggaggaactgctcagttaggacccagagggaaccatggaagccccagctcagcttctcttcctcctgctactctggcctcccagacttccaccggngtaaattgtgtttgaccactaatcctccagcccaccctgtcttgtcnccgggtaacaggccaccctcgtcctcgcctacgggtccgcagtactggttcgacgggactacttacgcccgtagtacccaaacgtacggacgtccgtagacccaggccctcccgagccctaccgtcctaacgtctaactcgtaacgttactttaccgtaaggtaccggaccttcgtacgggtacccaccggttacccacggtcccggtacttaccgaggtccggtaaccgtaggtcggggtccgtcgggaaccgtacgcgtttacgaaccttccttaccgaaccctatacccacccggtaagtccccgtaaggacctaccggtaaccgttagtaaccgtttttcgaaccgtttacgtttaaccttacccggttcttaacccgttaacgtaacccgttaaggtaacgtcgtacctactaatcttacctacgttcccgacctacggaccttaaggacgtanaacgtaccgaaagtaccgtgtacgctacgcactcgtctcgtacttacnctaccgtccnctactntcc

SEQ ID NO: 165436 - DNA, 747 bp, Homo sapiens
  misc_feature: GYAE6OF02I2QHS.44.73.G07.1.454.CMB.1.raw
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctagaaatgaagagcctggtcctcggtgaaggtctcctgcacggtcttcgtggaggctatccttacgaagtaaacttattactttaactcctaccgttgggtcgcgacgacggcccctggaccgaagggcttagagtggagttagggggtggcgttccggtaccctaagttttcgggacaagtaccgtaaactcgaccaacgaataaacgttaccgaagggtccaagtaccgtacgaccgtattacccggacggtaacgaactccgacggtagtacgacagtacctagtacgtggaacgtcgtacggaccgtaccgtaaaccgtacggaacgtacgtacgttaacgggaaccgggtaaccaacccgggtcccctttaaggtttaacttttcgcgggtaccgtaaccggaacgtaaaccttaaaaacgtttacccttaacccggtttacgttttacggggacggttacgggtttagacgtttacggttaactttaagtcgttagtttaggttacggggaacggtaaggtacgtaaggttccggttccgtaaccgtttcgttaccgtacgcccgttacgtaccccgtaacccgg

SEQ ID NO: 165437 - DNA, 752 bp, Homo sapiens
  misc_feature: GYAE6OF02I6NU9.44.73.G07.1.454.CMB.1.raw
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagagcctgggtcctcggtgaaggtctcctgcacggcttctggaggcatctcagaactatacttactcctaccgtgggtcgaccgtacgaccggccccgtaggaaccgaaggggtccttaggaggtagggtaggttgggggtcgggtccgttcccggtacccctttaaggttttacgggaaccgtaacggtacctaaaaccgttacggaccaacgtaacgtaaacttccggaagggtaccaacgtacctacgacgtaacgttacccggacggtaaccaactccgaacggagtacgacacggtacctagtacggtggacgtcgtcggaccgtaccgtaaccgtaggaacgtacgttcggtaacggaaccggaaccgtacccggtaccctttaagttaccgttttaccgacggtaccggtaccgtaaacggtaaaacttaaaaccgtttaccttacccgtttacggttttggggacggttagttgtacgtagtactttagtacgttagttacggttacggggaacctaagggactaggtaccgtaccgtaccggttaccttacgtaccgaccgttacccaccgtaacccgg

SEQ ID NO: 165438 - DNA, 691 bp, Homo sapiens
  misc_feature: GYAE6OF02IHJVJ.44.73.G07.1.454.CMB.1.raw
  modified_base (288)..(288): a, c, t, g, unknown or other
  misc_feature (288)..(288): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccctaccctgtctttgtcgtaccgggggacagccacctctctgcacgggccgccagactgtgacgacgacttagccgtggtaaccaacgagacgcctaggccaggcctccgagacctccncagtctatcgtacttacttctacggtacggtcccttcggtacggcctaaccgtcccgaccggtcccgttcttacgtaggtcgggctagggttcgggtctacggggactacggtaccttaccacctttcacccaaccgtctacccgaaccgacgtaccctaggaccgtccgtagtaagttacttttagacgtttagtttacttacgtcgttactaccgtaacgttaagtaacgtccgtactacctaattacttaccttacgttcccgaccgttacggaaccgtaagtgtaactaacgtaacgaaaccgtacgttcgtacgtcgtcgtaacgacccttacgttaccgttaccgttacttaccttacgttcccccgtttaccccgtccgttacgtaacgtttaacc

SEQ ID NO: 165439 - DNA, 759 bp, Homo sapiens
  misc_feature: GYAE6OF02IG3IT.44.73.G07.1.454.CMB.1.raw
  modified_base (98)..(98): a, c, t, g, unknown or other
  misc_feature (98)..(98): n is a, c, g, or t
  modified_base (464)..(464): a, c, t, g, unknown or other
  misc_feature (464)..(464): n is a, c, g, or t
  modified_base (470)..(470): a, c, t, g, unknown or other
  misc_feature (470)..(470): n is a, c, g, or t
tcagacagtatatacacgaccggtgctcgatttagctctacgctcgaggggccctgggagcacagctcatcaccatggactggacctggaggttcctntttgtggtggcagcaactacaggtgtccagtccaggtgcgtctggtgcaatcgtggggctagaaatgaagagccgtgggtcctcgggtagaacggttcctccgtgccgtacggtctttcggagggacggcctaacgttcgttacgaaacgtaaacttcgttacgttaactccgtaccggttgggtacgaccgtaaccgaccggtccccgtaggaaccgtacggtcgtaggtagtacgggtaggtggggtccggtccttccggtaccccgtttaaggttacggaaccgaacgacctaaacgtacgccaagtaacgaaacgttccggaaggactacgactacgacgtacgtaccgacggtaacgaacncgtagnggtaccgaccgagtacgttaactaggtacgcgtactacgaccgtaccgtaaagtcgaagtcgtacgtaggaaccggaaccgtcccggttaactagtttacgtaccggtacgacgtacgtaaacggttaacttaaacctttcgtaccggtttacggttacgggtacgtaagtcggttaaacgtgttaaccgttagtacgttagttaccgggttacggaacgtaacggttataaccggttaccggtaccttaccgttcgaccgttaccgacgttccgtaccggtaacccgg

SEQ ID NO: 165440 - DNA, 728 bp, Homo sapiens
  misc_feature: GYAE6OF02ID8Y7.44.73.G07.1.454.CMB.1.raw
  modified_base (260)..(260): a, c, t, g, unknown or other
  misc_feature (260)..(260): n is a, c, g, or t
tcagacagtatatacacgaccggtgctcgatttagctctacgctcagggggaggaactgctcagttaggacccagagggaaccatggaagccccagctcagcttctcttcctctgctactctgctccagacttccaccggcgaaattgtgttagacacaatctccacgccaccctgttctttgtccgtccgggggaacgcgccaccctctcttgcgagggccgcagactgttagacgcgacttacgcctacggtaccaanagtacgctcggcaggctacccagaccttcctacacgttctaatcgtactaccttagtacgtacgggtccttcgtaggaccgtactacccacgtcccgtcttaccggaagttgggactacgggtcggtaccgtacgggactacgaaccgtttcaccttacctacaaaccctcttaacccaaccgacgtaccctaacgggtaccgttaccgtaggtaaaccgtttagttttaacgacctttaaacgttttaactttaccgtagttaacccggaaggtaaccttaaagtttaacgtaaacgttcggtaacgtttcccggacccgttacccgttaccggaaaccggtaaacgggacctacgtaaccgtgaaacgttaaactaaacgtaaccgtggtacgagttaccgactaactactcgttacgttaccttcgtacttcccggtcccgtaactacggttaccctaagttaac

SEQ ID NO: 165441 - DNA, 577 bp, Homo sapiens
  misc_feature: GYAE6OF02GLGKE.44.73.G07.1.454.CMB.1.raw
  modified_base (375)..(375): a, c, t, g, unknown or other
  misc_feature (375)..(375): n is a, c, g, or t
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatctggggctgaaatgaagaagcctgggtcctcggtgaaggtctcctgcacggcttctggagcatcttcagaactatcttatcacctgggtgcgacacggccctggacaagggcttgagtggagtgggtggctcgtccccagttttggactagcaacgtacgcacagaacttcgagggcacgactcacgacttaccgcggacgaactccacgagtgcagacctatagnggagctgcgcaaccgtgagactcgtagacggacgaccggccttattcgttacgtcgcgcgaactaacgttaaaactttccgtaccgtttacggttttcgggacggtagtagtcgtgtacgttagtagtagttaggttacgggacgtaacggactaaggtcggtacctacggttcttccgtacgtctccctaccgtaacccgg

SEQ ID NO: 165442 - DNA, 662 bp, Homo sapiens
  misc_feature: GYAE6OF02G7598.44.73.G07.1.454.CMB.1.raw
  modified_base (278)..(278): a, c, t, g, unknown or other
  misc_feature (278)..(278): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccacctgtctttgctccggggaacagccacctctcttgcagggccgcagactgttgacgacgtactagcctggtaccaacagaacgcctggccaggcctcccagactccncagtctatgaattccttactaggtacgggtcccttgtcggacctaacgttccccgacgccccgtcttcgagtcggacctaggttcgggtctggacctaggtaccttcgaactcgtacacgtactccactacgcctagaccgtcctaggtaacgtttcgtttaggactttaacgttttattacgtcgttaccttaacgaaccgttaaaggtacgtacggacccttacaaagtttactccgttaccgttccggacccgtttacgggaacttaaacggtcgtaacttaacgtaaccgtaaaacgtcgttggtaccgcgttaccggactaacccgtattccgtaggtttaccacgttacttccccgtaccgtaccttacgtacttacg

SEQ ID NO: 165443 - DNA, 733 bp, Homo sapiens
  misc_feature: GYAE6OF02FF3Z1.44.73.G07.1.454.CMB.1.raw
tcagacagtatatacacgaccggtgctcgatttagctctacgctcaggggccctgggagcacagctcatcaccatggactggacctggacggttcctcttgtggtggcagcaactacaggtcgtccagtcccaggtcgcgtctggtcgactaagtcgtgggctagaaagtggaacgacgtccgtcgggtcctcggtagaacggtctccgtcgccgcgtcttcgaggacgtactacttctacaacgtaaccttctactacgtccgtacggtggtacgacgaccgtccggacccgtaggaaccggtaggtccgttaggaggttacggtaggtcggggtccggtacccgttaccggttacccttaaggttacgaacgtaaacaactaaaccgtacgaaccgaacgtaacgtaaccgtaccggacggacacgtaacctaccgaacgtaccgtaccggaacggtacctaacgaccgtagacgtacgacgacgtacgtagtacggtacgacgtcgaccgtacgaccaggtgacgtacgtacggtacgaccgtacctaccgtacttattcgtacgcgtaaccgacgtaaacttaaaccttaactttaccgtggtttaccgggtagtacgtagttacgtacgttacgttagtaacgttaggttacgtagggacccggtaaggtaccgtaacctcggttccaaccgtcgttacaccggtcaccgttacccgaccggttaccg

SEQ ID NO: 165444 - DNA, 819 bp, Homo sapiens
  misc_feature: GYAE6OF02GE62I.44.73.G07.1.454.CMB.1.raw
tcagacagtatatacacgaccggtgctcgatttagctctacgctcagggggaggaactgctcagttaggacccagagggaaccatggaagccccagctcagcttctcttcctcctgctactctggctcccagacttccaccggcgaaattgtgttgacacaatctccagccaccctgtctttgtcgtccgggggaacacgcctacctctcttgcgacgggccggcagtacgtgttcgacgacgtacttacgcctggtaccaacgagaacgtccgtgggccacggcctcccgagacctcctacacttctatcgtattacctttcgtacgggttacgggtcccttacggtcggacctaccgtccccgacggtccccgtcgtttacgaggttcggccgtagggtcgggttcgtagggaccctaggtacctttccgacctttccgtacctaccgtaacttacccgaaccgaccggttaccgtaacgaaccgttccgtaaggtaaacgttttacgttttacggtacgtttaacgttttacttaccgttacgtttaaccgtaaacccgtaaccggttaaacgtacggttaccggttaccttaaccgtaaagttaccgttttaccttaacccggttttcccggaacccgggtttacgggtaaaccgttaacgggttacgtaaacgttaacgttaaacccgaaacggttaacgtttacggtacggtaccctacggtaacccttaaccgttaccgttccgtttacggttacctttacccgtttacctttaccccggttacccctaaccgtttacgttaccgttaacgg

SEQ ID NO: 165445 - DNA, 715 bp, Homo sapiens
  misc_feature: GYAE6OF02GQCGI.44.73.G07.1.454.CMB.1.raw
  modified_base (208)..(208): a, c, t, g, unknown or other
  misc_feature (208)..(208): n is a, c, g, or t
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatcgtgggctagaaatgaagaagccgtgggtcctggtgaaggtctcctgcgacggcttcgnggaggctatcttacaagtaaactattacttatcctaccggtgggtcgacgaccgacggccccgtggaacgagggtcttaggaggtggtagtgggtcggtccgttaccggtaccccgttaagttttacgggaacgtaaacgacctaaaccgtaccgacaaccgaagtaaaccttaccggacggacaacgtacctaccgacgtaacgttacccggacggaaccgtaacgtaccgacggacgtacgactaacgtaccttacgtaaggtaggtaccgtcgtacggtccgaaccgtaaccgaggtaacgtagtcgtaggaacggaccgaccggtaccttaagttcgtttcgtacgccgtacgaaacgtaaacgttaaacgtttacctaccgtttacgtttagggacgttagtatagtcttagttagtagttacgttggtacgggaacggtaagtacggtaacgtcgtacgtaccgttacgtaccgttaccgacgtacccgaccgtaacccgg

SEQ ID NO: 165446 - DNA, 708 bp, Homo sapiens
  misc_feature: GYAE6OF02G17MA.44.73.G07.1.454.CMB.1.raw
  modified_base (663)..(663): a, c, t, g, unknown or other
  misc_feature (663)..(663): n is a, c, g, or t
  modified_base (695)..(695): a, c, t, g, unknown or other
  misc_feature (695)..(695): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccacctgtcttgtcgtccggggaacgcgccacctctcttcgcgacgggccggaccagtacgtggttcggaccgacgtacttacgccgtacggtaaccaaacgaacggaacgccgtcggaccgacgggcccttacccgacggaccttccctacattactatgtaacttacgtttacgtaggtacgggtccttcgtcggcctaccgtcccacgtccccgtcttccgaggtcggcgtgggtcgggtcggtacgggtacacgtacttccgtaccttaccgtacccaaccgtactacccgtaaccgaccgtacccgtaacggacgtacccgtaggtaacgtttacgttttcggactttagttttacttacgttcgtaccttaaccaccgacgtaaacggtaacggtccgtaaccttactaactttcgttaccttaccgtttcccggaccgttacggtaaacgtaaggtgtaactacgtaaccgaagtacgtggcgtacgntaccgtactacttcgtcttactctacttcccncccgtactcgtac

SEQ ID NO: 165447 - DNA, 588 bp, Homo sapiens
  misc_feature: GYAE6OF02F41OI.44.73.G07.1.454.CMB.1.raw
  modified_base (286)..(286): a, c, t, g, unknown or other
  misc_feature (286)..(286): n is a, c, g, or t
  modified_base (384)..(384): a, c, t, g, unknown or other
  misc_feature (384)..(384): n is a, c, g, or t
tcagacagtatatacacgaccggtgctcgatttagctctacgctcagggggatcaggactcctcagttcaccttctcacaatgaggctccctgctcagctcctggggctgctaatgctctgggtctcagggtccagtggagatattataatgactcagtctcccctctccctggcccgtcacccctggagagccggcctccatctcctgtaggtctagtgagagtcttggaggtcagacatctatgtggactggtacttgcagaagaccgggcagtctccacaacncctgatctaatttgggtccacgtcgggcctcggggtctcgtgactaggttcagtgccagtgctatcacacacagatttcacaactgcaacgtatacgngactacgagtcgggacggtctggacgtagtggtttggggttctaagttactggactacgtacctaaagttccttaaaccgtaaccccggtttacaacccgtttcggggacgaacgggtaccgaccggtacgttacggtaaggtaactttaacgggaccgaaccgttggtaccggtacttcggacctaacctacgttaccttacg

SEQ ID NO: 165448 - DNA, 544 bp, Homo sapiens
  misc_feature: GYAE6OF02GGJGG.44.73.G07.1.454.CMB.1.raw
  modified_base (255)..(255): a, c, t, g, unknown or other
  misc_feature (255)..(255): n is a, c, g, or t
  modified_base (260)..(260): a, c, t, g, unknown or other
  misc_feature (260)..(260): n is a, c, g, or t
  modified_base (349)..(349): a, c, t, g, unknown or other
  misc_feature (349)..(349): n is a, c, g, or t
  modified_base (372)..(372): a, c, t, g, unknown or other
  misc_feature (372)..(372): n is a, c, g, or t
  modified_base (380)..(380): a, c, t, g, unknown or other
  misc_feature (380)..(380): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagccaccctgtctttgtcgtccgggggaacagccaccctctcttgcagggccggccagactgttgacgacgacttagcctggtaccaanagaancctggccaggcctccgagactcctcatctatgattacttctagtaggcctctggcactccacgccgcttcagtggcagtggctaggacngtacttcactctcaccatccacngcctaganacctgaagtatttagctagttattactcgtactacacgtaagtagtcggtacctacaacttatactacgtttcgtaccgtaggacaaagtgatagtacaaacgtacgtgtacgtgcgacacctactcgttacgtcttactacttccgtaccgacctagtctacg

SEQ ID NO: 165449 - DNA, 714 bp, Homo sapiens
  misc_feature: GYAE6OF02HJVO0.44.73.G07.1.454.CMB.1.raw
  modified_base (118)..(118): a, c, t, g, unknown or other
  misc_feature (118)..(118): n is a, c, g, or t
  modified_base (230)..(230): a, c, t, g, unknown or other
  misc_feature (230)..(230): n is a, c, g, or t
tcagacagtatatacacgaccggtgctcgatttagctctacgctcagggggatcaggactcctcagttcaccgttctcacaatgaggcctccctgctcagctccgtgggctgcctaangctctgggtctacgagggtccagtggagatattataatgactcagtcctcccctctcccgtggccgtaccaccccgtggacgacgcccggcctcatcctctggtagtctagngagagttcgttggagtcagaacatctagtggtggacttggtactgacgaagaacggccggctacgtcctaccacgtaacctcctagtacttcgttagtttcggtccctaccggtcgggtcccgttcgggtctcgtagtacgtcggtatacggtcgcgtaacggtcgacctaatcccgaacctaacgaaccgtagtttaaccgtttcccaaacttcgtaacgaccaacgtacgtacgaagacccggtaaagggtcgggtacgggaacgtaccggtacggaacggttggtttaacgggggtttcggtttacttacgttacggtacgtaacgttaccttaaccgtaaccggtttaaccctaaacccgttaaccccgttacgttaacccggtacgggaacgtaaccgggtaacgtaccgtaaggttacgtaaagtaccggtaagtaccgtacggtcgtggtacccttgacctacgttagccgtttacg

SEQ ID NO: 165450 - DNA, 620 bp, Homo sapiens
  misc_feature: GYAE6OF02FWRS5.44.73.G07.1.454.CMB.1.raw
  modified_base (228)..(228): a, c, t, g, unknown or other
  misc_feature (228)..(228): n is a, c, g, or t
  modified_base (257)..(257): a, c, t, g, unknown or other
  misc_feature (257)..(257): n is a, c, g, or t
  modified_base (275)..(275): a, c, t, g, unknown or other
  misc_feature (275)..(275): n is a, c, g, or t
  modified_base (282)..(282): a, c, t, g, unknown or other
  misc_feature (282)..(282): n is a, c, g, or t
  modified_base (311)..(311): a, c, t, g, unknown or other
  misc_feature (311)..(311): n is a, c, g, or t
  modified_base (318)..(318): a, c, t, g, unknown or other
  misc_feature (318)..(318): n is a, c, g, or t
  modified_base (407)..(407): a, c, t, g, unknown or other
  misc_feature (407)..(407): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccgaccggcgaaattgtgttgacacaatctccagccaccctgtctttgtctccgggggaacagccacctctctgcaggccggccagactgttnacgacgacttagcctggtaccaacagaanctgcaggctccagactcncatcatnatacttctagaggtcctcgtgcactcccngcccgtntacgagtcggctaggtgggtctgggacaagcttccacgtcctcaacctatacccgaaccaggaccctaaggacgtccctagaaacgttnttttacgactttaaggtttattaccgttagtaccttaacgtaacggttaaacgaagttcccgggtaacctaccgtaaatttactttaccgaccgttttccggacccgttagggaaccgtaaaggtcgtaattaaccgaacgaaacgtaactgtaggcctaggacctactacttcttacgttcgttacacttcccttacccgactactcgtacg

SEQ ID NO: 165451 - DNA, 826 bp, Homo sapiens
  misc_feature: GYAE6OF02GZFA5.44.73.G07.1.454.CMB.1.raw
  modified_base (558)..(558): a, c, t, g, unknown or other
  misc_feature (558)..(558): n is a, c, g, or t
tcagacagtatatacacgaccggtgctcgatttagctctacgctcaggggccctgggagcacagctcatcaccatgactggacctggaggttcctctttgtggtggcagcaactacaggtcgtccagtcccgaggtgcgtctggtgcaagtcgtggggtctagaatggaacgaggtcccgtgggtccctagggtgaacgggttctaccgtgccgacggtcttacgtggacggctacgttcttacgaacgtaaaccttatacctttaagtacccgtaccggttggggccacggtaccgtaccggccccgtagggaccgtacgggtaccttaggtaacggtcggtggttacggggtccgggtccgtacccggttccccttaaggttttaccggaaacctaacggaacctaaaccggtaccggacgtaaccgaacgtaaccgttaaccggaacgggacaacgtacgtacgacgtacgtaccggttacgacgtaacctcgaaaggcgtagacgtacgccgttagtcggtagacgtcgtacgacctacgtaacgacggttaanacgtagtacggacggtaccgtacccgtaccgttaacgttacctagtcgaccgggtacgtaaacgtaacctttaaaccgtttaccgttaaccgtttacgggtttaccgggaaccggtaggtttactaaccggttcgtttacgtaacgtttacggtacgggtttacggtacgggtaaacccgggttaacgaaccggtaacggttaccggtaccgtacccgtttacggtttccgtaccggtacccggttacccttaccccggaacccgggg

SEQ ID NO: 165452 - DNA, 761 bp, Homo sapiens
  misc_feature: GYAE6OF02HLZQG.44.73.G07.1.454.CMB.1.raw
tcagacagtatatacacgaccggtgctcgatttagctctacgctcaggggccctgggagcacagctcatcaccatggactggactggaggttcctctttgtggtggcagcaactacaggtcgtccagtcccaggtgcgttcgtggtcgcgaagtcgtgggggcttagaaaatgaaagaacggtccgtggggttcctcgggtaggaacggtcctccgtgcgacggtcttcgtgggagctatcgttacgaagaaacttatcttagtcctacggttgggacgcgacgacggtccccgtaggaacgacggtacgtgaggtggaggtcggggtcggcgttccgtaccgtagtttacggacaagacaacgtacgactaacgaagtaaactacgagggacagactcacgtactaccggcgaacgactacacgtagtcgacacgtacgtaagtagtggaatcggtcggaccgaacccgtaacgacgaacgtacgtcgtacggaacggtaccgaccggttaccctagttaaccttttcggcggtaacgtaacggtaaacggaaaaaccttaaacgtttacccttaaccgttttaacgggttttcggggtaacgtaacggttacggtaaccttaggtaacctttaaggttaacggttaaggtttacgggtttaaccggggtaaacggtaaacgggtaaccttaagggttcccgtaaaccggttacccgtttcgtacttacccggaacggtttacccccgacggtaacccgg

SEQ ID NO: 165453 - DNA, 828 bp, Homo sapiens
  misc_feature: GYAE6OF02GRUIL.44.73.G07.1.454.CMB.1.raw
  modified_base (227)..(227): a, c, t, g, unknown or other
  misc_feature (227)..(227): n is a, c, g, or t
  modified_base (242)..(242): a, c, t, g, unknown or other
  misc_feature (242)..(242): n is a, c, g, or t
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatcgtggggctgaaatgaagaagcctgggtcctcggtgaaggtctcctgcacggcttcgtggagctatcttcagaaactntcttatcacgtggtncgacgacgccctggacaaggctagagtggagtgggtacggctccggtaccctaagttttcgacgtaagactaaaccgtacgtacacgaacgaaacgttaccgagggacgaagtacctacaacgacgttaacccggacggtaacgaacttacccgacggtaacgtcggaccgacgacccttaaagtaagtacggtacggacgttcggcccgtaaccgtaaacccgtggtaaacgtacgttaccggtacgtaaacggggtacccaaccccggggtaccccctttaaggtttaccggtttttaccgtaccgggtacccgggtaaccggttaaaccggtaaaacccgtttaaaaaacgtttttccccgtttaaaccccgttttaagggtttttttacccgggggaacgggtttaacgggttacggtaacgttttacggtacccgttttaaagtaccggtttaagtttaccgggggttttacggggtaacccggtaaaacggggttaccaaagggtttaccgggtaaccctacccgggttttacgtcccgttaccggtaacccgttaccccgttacccgtaaaccccgggg

SEQ ID NO: 165454 - DNA, 773 bp, Homo sapiens
  misc_feature: GYAE6OF02IGRC5.44.73.G07.1.454.CMB.1.raw
tcagacagtatatacacgaccggtgctcgatttagctctacgctcagggggaggaactgctcagttaggacccagagggaaccatggaagccccagctcagcttctcttcctctgctactctggctccagattccgaccggacgaaattgtgttgacacaactctccagccaccctgttctttgtcgtccgggggaacgacgccacctctcttgcgacgggccggccagactgttcgacgacgacttagcctaggtaaccaacgagaacgccgtggacccacggcctacccgagtaccttcctacacttacctatacgtaacttacctttacgtaaggtaccgggtacccttccggttacggacctaccgtccccgaccggtcccccgtcgtttacgaagggttcggacgtagggttcggggtaccgtagggacctaagtaccgttacaccttcaccgacctacgtacccaaccgtacgtaccgtacggacgtaccgttaaggtaagtttactttttacgacgtttaagtttaactttaccgttacgttaacctaaccgtaaaccggtttaaagacggttccggtaccttaaccttaaagtcctttaccgttacggtttcccggtaccgtaacgggtaaccttaaagggttcgtaactaaacgtaaccgaaaacgttacgtggttacggacctaggtaacccaccgttagttacccgttcgttaccttccgtaaccgttttccccgtaaccccgtcttacgtttcccgttaag

SEQ ID NO: 165455 - DNA, 675 bp, Homo sapiens
  misc_feature: GYAE6OF02F2EP1.44.73.G07.1.454.CMB.1.raw
  modified_base (144)..(144): a, c, t, g, unknown or other
  misc_feature (144)..(144): n is a, c, g, or t
  modified_base (249)..(249): a, c, t, g, unknown or other
  misc_feature (249)..(249): n is a, c, g, or t
  modified_base (306)..(306): a, c, t, g, unknown or other
  misc_feature (306)..(306): n is a, c, g, or t
  modified_base (456)..(456): a, c, t, g, unknown or other
  misc_feature (456)..(456): n is a, c, g, or t
  modified_base (657)..(657): a, c, t, g, unknown or other
  misc_feature (657)..(657): n is a, c, g, or t
tcagacagtatatacacgaccggtgctcgatttagctctacgctcagggggatcaggactcctcagttcaccttctcacaatgaggcctccctgctcagctccgtggggctgactaatgctctgggtctcagggtccagtgganatattataatgactcagtcctccctctccctggccgtcacccgtggagacgcccggcctccatcctcctgtaggtctagtgagtgtcgttggacgtcagaaactntctatggtagacgttggtacttgcaaggacgaccggcacgtctaccactacctcgtntatcttagtttcgggtaccacggtccgggtccggttccggggttcctcgtacgtacgtacggttcgtagtcgaccgtaggtcgctactccgaacaacctaccgtaaggttaactttccgaaccacgtacgacctaactactacgacggtntaagggtacggtacgggtacggtcgtacggtaacgttggttaggggtttacggtcttacgtacgtcgactactaccgttaacgttacccgtaaacccgtaccccgtttacgacccggttacgggaccgtaaggacccgtacgtacgtaggtaacgttaagttaaccggtacgtaccgttaggttcgaaccgtacgtaaccnccgttacgttccgttacg

SEQ ID NO: 165456 - DNA, 1012 bp, Homo sapiens
  misc_feature: GYAE6OF02JU04H.44.73.G07.1.454.CMB.1.raw
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatcgtggggctagaatgaagagccgtgggtcctgggtagaaggtctcctgcacgggtcttcgtggaggctattcgttacaagtaaacttattcttataccaccgtgggtagcgacgtaccggccccgtaggaaccggaaggccgttaggacggtcggtacggtgggggtagggtactaccgtacgtaccccgtttaagttccgttttacgggtacgtacgtacgtaacggttaaacgttaccgaccgtaacgtaaggttaaacggttttaccgaaggggtaaccgaacggtaaccgttaccgaaaccttaaccggttaacccggaacgggtaaaccgtaaccgtaacccggtaaaccgggtaacgtaaccgtaacccgtaacccgttacgtaacggtacgggtaacgtccgggttaaacggaaccgggttaccgtaaacgggtaccgtaaaggggtaaaccggtaccgttaaaccgggtacggtaaaacccggggaaaccgtacccggggttaaccttaaacggttttaccctttaaggtttttcccgtttaaagggttacccggggaaacggtaaaccccgggttaaaccccggtaccccgttttaaccgggttaaacccttttaaaacccgtttttacccgtaaacccgttttaccccgggtttaaccccttacgttaacccggtttaaacccgtttaacccccggttaaaccctttaaacccgtaaaccggttaaaccggtttttaaaccggtaaccgggttttttaaccccggggttaccccccgttaaaaccccggggggtaccccgggggttacccgggtaaaacccccgggggttttaaccccggttaacccccgggg

SEQ ID NO: 165457 - DNA, 696 bp, Homo sapiens
  misc_feature: GYAE6OF02HFAHC.44.73.G07.1.454.CMB.1.raw
  modified_base (283)..(283): a, c, t, g, unknown or other
  misc_feature (283)..(283): n is a, c, g, or t
  modified_base (291)..(291): a, c, t, g, unknown or other
  misc_feature (291)..(291): n is a, c, g, or t
  modified_base (317)..(317): a, c, t, g, unknown or other
  misc_feature (317)..(317): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccaccggcgaaaattgtgttcgacacaatctccagccaccctgtctttgtctccgggggaacgagccaccctctcttgcagggccggccagactgttgacgactactagcctggtaccaacagaagcctggccaggctccagactccncatctatnattactctagtacggcctcgtggacnctacccgacgcccgtcttccgagttcggacgtaggtcgggtcgtacgggactacggtactttcgaaccttaccgtacaacccgacttaccaacccgacgtacctaacggaacgtcctaggtaacgttaacgttttgtaacgttaattttaattaccgttaggttaaccttaaccgtaaacccggttaaaggtaacggttaccggtacccttaacgtaaacttacgtttaaccttacgtttaccggacccgtaacgggtaacctaaaaggttacggtaactaactaaccgaaaacggtacttagggtacgtctacggaccctaacgtactccgttacgttaccttacgtaccgttaccttccccgtactacttacgtacg

SEQ ID NO: 165458 - DNA, 705 bp, Homo sapiens
  misc_feature: GYAE6OF02FQE1B.44.73.G07.1.454.CMB.1.raw
  modified_base (233)..(233): a, c, t, g, unknown or other
  misc_feature (233)..(233): n is a, c, g, or t
  modified_base (298)..(298): a, c, t, g, unknown or other
  misc_feature (298)..(298): n is a, c, g, or t
tcagacagtatatacacgaccggtgctcgatttagctctacgctcagggggatcaggactcctcagttcaccttctcacaatgaggctccctgctcagctccgtggggctgctaatgctctgggtctcgagggtccaggtggagattattataatgactcagtcctcccctctcccgtggcccgtcaccccgtggacgacggcccggcctccatccgtcttggtaggtctagngagtgtcttggacgtcaagaactatctagtgtggtactggtaacttgacgagtaacggaccgggntacgttccgtccaaactaaccttccgtagtacttaccgttaaggtttccggggtccccaacggttcccggggacccggttcccggggttactccggttaggaaccttggggttaccaaggttccgacctagggtcgactactacgaacacgtaccgtagttaactttccgaactacgtgactacgtactcgtacggacgtaggaggtcggaggtccgtagtaacgtacggtttggttacgggtacttaacgtacgttacgacttaacgtacccgttaacgtacccttaaacccgtaaccccggttcgtaaccgttaccgggacgaacgggtactacgtacggttaggaacgtaacgttacgaccgtaacgttgggtacgcgttcgaacccgtacttcgtcgttaccg

SEQ ID NO: 165459 - DNA, 815 bp, Homo sapiens
  misc_feature: GYAE6OF02H8P0J.44.73.G07.1.454.CMB.1.raw
  modified_base (808)..(808): a, c, t, g, unknown or other
  misc_feature (808)..(808): n is a, c, g, or t
tcagacagtatatacacgaccggtgctcgatttagctctacgctcagggggaggaactgctcagttaggaccagagggaaccatggaagccccagctcagcttctcttcctcctgctactctggctccagattccaccggcgaaattgtgttagacacaatctccagcccacctgttctttgtacgtccgggggaacacgtccacccttctcttgcacgggccggaccagtacttgttcgacgacgtacttagccgtacggtaccaacgagaacgtccgtacggccacggtcctcccgacgacctcctcacttctagtggtacttacgtttactaggtaacggtccttacgtcggaccaacgtcccaccggcccgttacgttaccgaggttcgcgtaggtcgggttccgtagggtaaccctacggttaccttccgtaaccttacgtacctaacccgtacgtacccaacccgttacgtacccgtaacggaccgttcccgtaggtaacgtttacgttttacgttcctttaagttttaacgtttacgttaccgttaccgttaaccgttaacggttaaacgtaaccgggttaccgttacccgtttaaccgttaacttacccgtttacgttaacccggttttacccgggtacccgttaaccgggtaaaccggttaaacggttacgggttaaacttaaccgtaaacgtaaaaccgttaccgtcggttaccggacgttaaccggacccgttaaccttacgttacgttacgttccgttaaccgttccttacccggttcccccgtacgttaccgttnttaacgg

SEQ ID NO: 165460 - DNA, 675 bp, Homo sapiens
  misc_feature: GYAE6OF02JX2YO.44.73.G07.1.454.CMB.1.raw
  modified_base (133)..(133): a, c, t, g, unknown or other
  misc_feature (133)..(133): n is a, c, g, or t
  modified_base (168)..(168): a, c, t, g, unknown or other
  misc_feature (168)..(168): n is a, c, g, or t
  modified_base (198)..(198): a, c, t, g, unknown or other
  misc_feature (198)..(198): n is a, c, g, or t
  modified_base (200)..(200): a, c, t, g, unknown or other
  misc_feature (200)..(200): n is a, c, g, or t
  modified_base (203)..(203): a, c, t, g, unknown or other
  misc_feature (203)..(203): n is a, c, g, or t
  modified_base (215)..(215): a, c, t, g, unknown or other
  misc_feature (215)..(215): n is a, c, g, or t
  modified_base (221)..(221): a, c, t, g, unknown or other
  misc_feature (221)..(221): n is a, c, g, or t
tcagacagtatatacacgaccggtgctcgatttagctctacgctcaggggccctgggagcacagctcatcgaccatggactggacctggaggttcctctttgtggtggcagtcaactcaggtgtccagtcccnggtgcgtctggtgcatctgggctgaatgaagagcnggtcctcggtgagtctctgcacggcttcgngngcngtctgacgaatncttacncacgtggtgcacgcgaccctggacaagggtcttgagtggacgtgggtcggcgtaccggtcccctaagttttaggaccaacggtccaaacttacgcgacacggtaaatttccgagggacacggtactacgagtaccttacggcggaacgaacttcccgagtacggtacgcgaacgtccgttagtacgttagggactacgtcgtccgacctacccgtgggaactagtcctagggtcgtacgaccgtacccgtagttaactttgtggcgtcgtaaggtaaccttaaaaacttttcgttacccgttaggtttttcggggaaccgttagttacgtaacttcggttaatttacggtaaggtcgtttaaggttaccggggacgttaaacgtacggtaacggttggttaccccgtacggtttccgtacgtttaaccggcgttttccccgaccgtaaacccgg

SEQ ID NO: 165461 - DNA, 725 bp, Homo sapiens
  misc_feature: GYAE6OF02G1FGT.44.73.G07.1.454.CMB.1.raw
  modified_base (197)..(197): a, c, t, g, unknown or other
  misc_feature (197)..(197): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatctccagcccacctgtctttcgtcgtccggggaacncgccaccctctcgttgcgacgggccggccagtactgttgacgacgtacttagccgtagtaccaacgagaacgccgtcggaccacggtcctcccgaacgtacctcctacgacttctaagtcgtaacttaccttacgtaaggtacggtcctacgttacggaccgtaccgtacccgaccggtccccggtcttacgacgggttcggcgtaacgggttcgggtaccggtacggtacacggtaccttacgaccgttccacctacacgtaccacgacctacgtacgtactccgtagtaacgttatttcgtactagttttactgttacgtacgtaacgtacggtaacgtagtccggtacctaacgtaactttacttacgttaccgtttaccgggtaccgtacgggtaaaccttaagggtactacgttaaaccgtacgaaaccgttagtcggtaccgtacgtaccgtcgaacccttagttccgtatttaaccggtttacacccggtttacccttaccccgactttacgtaccttaag

SEQ ID NO: 165462 - DNA, 730 bp, Homo sapiens
  misc_feature: GYAE6OF02G7575.44.73.G07.1.454.CMB.1.raw
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatcgtggggctagaaatgaagaagccgtgggtcctcggtgaaggtcctcctcgcgacggcttcgtggaggcattcgttacaagtaaactacttcttactctaccgtgggtcgcgacgacggtcccgtggacgaagggtcttggaggtggagtgggtggccgtccgtacccgtaagtttacggactaacgactaacgtacgacaacgaagtaacgtacgacggacacgactcgacgtacgtaccggaccgaacgactaccgaacgagtacgcacgtctaagtacgtggtacgcgtcgaccgactaacgtagacgtagtcgaggacggaacccgtaccgtacccgttattaacgttttaccgacggtaccggtaacgtaacgtaaactttaaaagtttacccggttaaccgttttacggttttcggggacggttagttacgttaacgttacgtaacgtttaagtcggttaagtttacggggttaacgggtaaccggtaagggttaaccggtaaaggttcccggttaaccgttaccggttaccgttaccgttaacccggtaccgttacccgtacccggtaacccgg

SEQ ID NO: 165463 - DNA, 743 bp, Homo sapiens
  misc_feature: GYAE6OF02FGSM7.44.73.G07.1.454.CMB.1.raw
  modified_base (193)..(193): a, c, t, g, unknown or other
  misc_feature (193)..(193): n is a, c, g, or t
  modified_base (690)..(690): a, c, t, g, unknown or other
  misc_feature (690)..(690): n is a, c, g, or t
tcagacagtatatacacgaccggtgctcgatttagctctacgctcaggggggaactgctcagttaggacccagagggaaccatggaagccccagctcagcttctcttcctcctgctactctggctcccagattccaccggcgaaattgtgttgacacaatctccagccaccctgtctttgtctccggggaacncgccaccctctcttgcgagggccgacagactggttcgacgacgtaccttacgccgtcggtaaccaacacggtaaacgccgtggcccgaacggtcctaccccgaggacccttcccgtcctaactcgtaactacgtaacttaccgtttaccgtaagggttaccgggtacccttgtacgggtacctacgttccccgacggtaccccgtccttacgtacggtcggccgtagggtcggtttacggacggggtaacctacggtacctttaccgaccgtttaccgacctaaaccctcgtacccctaacccgtacggtacccgttaacgaacgtcccgttaaggtaaacgttttcgtttacgtacgttaagttttaccttacgttagttaccctaacgtaacgtacgtacggtcgtaccttacaattctacctaccgtttccggaccctacgggtaacctaaggtgtaagttaccaacgaaacgttgtacgtcgcacgcgtaccngttacctacgttcctactccgttcccgtaccctccgtacttactacgttaacc

SEQ ID NO: 165464 - DNA, 737 bp, Homo sapiens
  misc_feature: GYAE6OF02HKAO2.44.73.G07.1.454.CMB.1.raw
  modified_base (263)..(263): a, c, t, g, unknown or other
  misc_feature (263)..(263): n is a, c, g, or t
tcagacagtatatacacgaccggtgctcgatttagctctacgctcagggggatcaggactcctcagttcaccttctcacaatgaggctccctgctcagctccgtggggctgctaatgctcgtgggtctcgagggtccaggtggagattaattaataatgactcagttcctcccctctcccgtggcccgtccacccgtggagacgccccggtcctccattcctccgtggtaggtctagtgagtgtcgttgggaagtcaagaacnttctagtgtggtacttggttacttgacgaaggacggaccggatacgttccaccaacgtactctagtacgttcttaggtttcggtcctaccggtccgggtccgtccggggtcttccgtagtacgtaggtcgtgtcggtcgagttcgactactacaacgactaaacgacgtttacttaccgaacctacgtacgtaccaccttaacggtaccaacggtacgtaacgggtaccgggtagggaccgggtagttacggaacggtttaggtttacggggtttacgggtttaaccttaacgtacgtcgtaccttaaccgttacggttaacccgtttaacctaaccccggttaaacccgggtttaccccttaaccggggttaaccgggaacgtaaaccggggactacggtttacgttacggaacgttaacgtaccggtacggtaacgttggaccggttacgcgtaccgtactagttcgttacc

SEQ ID NO: 165465 - DNA, 897 bp, Homo sapiens
  misc_feature: GYAE6OF02FT2Z7.44.73.G07.1.454.CMB.1.raw
  modified_base (212)..(212): a, c, t, g, unknown or other
  misc_feature (212)..(212): n is a, c, g, or t
tcagacagtatatacacgaccggtgctcgatttagctctacgctcagggggccctgggagcacagctcatcaccatggactggacctggaggttcctctttgtggtggcagcaactacaggtgtccagtcccagggtgcgtctggtgcaatcgtggggctgaatggaagagccgtgggtcctcggtgaaggtctctgacacggtcttgtggnggcatcttcaagaacttatcttatccacgtgggtcgacgaccgacggtcccctggacgaggcgttgacggtggtagtggggtcgggtctccgttacccgtaagtttggacgtaacgacaaaccgtacgtacgaacgtaagtaaaaccgttccgacggggaccgtaacgacggttaccaaccgttacggttaaccccggacgggtaaaccgaaagttaccccgaacggtaaaggttccgacgaccggttaccgtaaacgtagttaacggggcgtccgtaacggtccggaacccgtaaccggtagggtaacttcgtaggttaccggaacggtaacccccgggtaccggaccctttacggtttaacgttcggtaacggttacccggacggaaaacgttaaaacccgttaaaacgttttaacccgttaccgttttacgggttttaacccgggggtaccggtttaacggtaacgggtttaactaccgggtttacgtttaaccgttaacgggtttactttacgggggtttaacccggggttaaccccgggttaaagggggtaaacccgttaaagggtttccccggggtttaaccggttttaaccccgggtttacccccggtttttaccgtttaaccccggtaacggttttaccccccccggggtaacccccggttaaaaaccccccggggg

SEQ ID NO: 165466 - DNA, 1089 bp, Homo sapiens
  misc_feature: GYAE6OF02G9MEE.44.73.G07.1.454.CMB.1.raw
tcagacagtatatacacgaccggtgctcgatttagctctacgctcaggggagaactgcgtcagttaggacccagagggtaaccactggaagccccagctcacgcttctcttcctcctgcttactctggcctcccagattccaccggcgaaatttgtcgttagacactaatctccagcccaccctgtctttcgtcgtccgggggaacagccacccctgtcttgcgacgggcccggtccacgtacgtcgttacggaccgtacgtacgttaggcccttacgggttaacccaaacgaaggtaaacggccccgtaggggaccccaacggggtcccttaaccccccgaaggtaccccttaccccgttaccctaactttaccgttaacttacggtaaacctttaaacccgtttttcccggtaaagggttaaccgggggtccccttttaccggtacggggtacccctaacccgttaaccccccggtaccgggtacccccccgttcgttttacccggaacgggtttacggggacccgttaagggggtttccggggttccggttaacgggggtaaccgtaacgggttacccttttccggaaccctttaccgttaacccgtaaccctaacttaccccaacccgtaaccgggtacccgttaaacggggaccgttacccggttaagggttaaaaccggtttacgtttttttaccggaaacccggttttaagtttttttaaccgttttaaccgtttcggtttaaacccgttaaacccgggtttaaaacccggttaaacgggttaaaccgggtttccggaacccctttaacccggttaaattttacccggttttaaccccgttacccgggtttttacccggggtacccccggttaacgggggtaaaccccgtttaaaagggggttaacgggtttaaaccgttaaaccggttaaaccgggtaaaaaccggttacgggttacgggttaccgggtacggtttacccggtaacctaacccggttaacgggtttactttcccggtttacctttaacccttaccgttttacccccgtaccccggttacctttacggttacccttaaccgg

SEQ ID NO: 165467 - DNA, 894 bp, Homo sapiens
  misc_feature: GYAE6OF02HND2T.44.73.G07.1.454.CMB.1.raw
  modified_base (187)..(187): a, c, t, g, unknown or other
  misc_feature (187)..(187): n is a, c, g, or t
tcagacagtatatacacgaccggtgctcgatttagctctacgctcagggggaggaactgctcagttaggacccagagggaaccatggaagccccagctcagcttctcttcctctgctactctgctaccagacttccgacggcgtaaattgtgttcggaactacaactctccgacgtacccacccttnttcgtttcggtcccgggtaccggggggaacacggtcccacccttcttaccgttggacctacgggggcccggactacggaacgttggttacggaacgtacgtaccttacggccggttaacggtaacccaaaggagtaacgtcccggtacggccgacggcctaccccgacggtaccttcccgactaacttccgtaacgttacgtactttaaccgttacgtaacgggttacggtacccttccgtaggtccgtaaccgtccccgaccggtcccgtacgttacggaacggttcggacggttcgggttaccgggttcgggtacggtaacgtacggtttaaccttaccggtacctttacgccggtaaaccttacctaacccggtacccaacggtaccggtaacgttacggtaaccgtaggttaaacgtttcggtttaccgtttaacggtttaacgttttacgttaaccgttaccggtttaaccttaaccgggttaaaccggtaaaggttaaccggttaccgggttaacccttacgttaaagttaccttcgtttaaccgttcccgggtacccgggtaacggtaccggtaaggttaacgtacgtaaccgttaaacgaacgttacgtggtaccgtacgtaaccgtcaaccgttcttggttacccgtttacttacgttacccgttacccgttccccggacctttacgtccgtttaacg

SEQ ID NO: 165468 - DNA, 728 bp, Homo sapiens
  misc_feature: GYAE6OF02FNGR5.44.73.G07.1.454.CMB.1.raw
  modified_base (194)..(194): a, c, t, g, unknown or other
  misc_feature (194)..(194): n is a, c, g, or t
  modified_base (511)..(511): a, c, t, g, unknown or other
  misc_feature (511)..(511): n is a, c, g, or t
tcagacagtatatacacgaccggtgctcgatttagctctacgctcagggggaggaactgctcagttaggacccagagggaaccatggaagccccagctcagcttctcttcctcctgctactctggctcccagagatcaccggagatagttgtgttgacacagtcctccaggcaccctgtcttgtctcgaggganagacgccaccctctcctggtacgggccaggtcggagttgttgactaagtacctagcctggtaaccaacgagaaacctggccaggcctccgaaggtcctcctacactctactgaactgactactaccaacgtacgggtcaacgtcggccaaccccgagaaccgaggttacacggtggacgtaggtcgggtacgtcgggaacagtaccgttcaccgttccgtaccgacccggttcaaaggtaccctaaaggttaccgtaaccgtacgtcccgttaaaggtaagtaactttttacgggaactttaacgtttaacttacgnggttaaccgtagtaacctaagttaactaaagttcggtaccgttacgggtccccttccggttaccggaaccgtaaaggggaccctaacgaccggtaacgggtaactaaacggtttaaacccgtacggtaccggttacggccgtaacgtaacccgtaacctacgtttaccttacggttaaccctttacgacctttaccccgtcccggtaacctaaccgg

SEQ ID NO: 165469 - DNA, 738 bp, Homo sapiens
  misc_feature: GYAE6OF02II3O9.44.73.G07.1.454.CMB.1.raw
tcagacagtatatacacgaccggtgctcgatttagctctacgctcagggggaggaactgctcagttaggacccagagggaaccatggaagccccagctcagcttctcttcctcctgctactctggctcccagattccaccggcgaaattgtgttgacacaatcctccagccaccctgttctttgtcgtccgggggaacacgccacccgtctcttgccgagggcccgcagaccgttggttcgacgacgtacttacgccttaggtaacccaacaggaacgccgtaggccgaggcctccccgaggacctcctacactactatacgtacttactttacgtacgggtacggtcctcgtggcctactcccgacgcccgtcttcgagttcggacgtagggttcggcgtaggaccaagtaccgttcactacctaccacctactccaacccgtacgacctacgactaccgtacgtaacgttacgtttacgtacgttaacgtttacgtttacgttacgtaccttaccgtaacgtaacggtaacggtacggtacccgttaccgtaactttacctttaccgttaccgtttacccgtacccggttaccggtaaccgtaacggtagtaacttaactaaccgggggggtaaactaacgttacggtacgtcgtacggtcctaaccgtacgttacgttacgtttaccgttaccttaccgttccgttaccccgttaccgtaccgttaccgttaacg

SEQ ID NO: 165470 - DNA, 810 bp, Homo sapiens
  misc_feature: GYAE6OF02J2TDJ.44.73.G07.1.454.CMB.1.raw
tcagacagtatatacacgaccggtgctcgatttagctctacgctcagggggaggaactgctcagttaggacccagagggaaccatggaagccccagctcagcttctcttcctcctgctactctggctcccagacttccaccggcgaaattcgtgttgacactaactctccacgcccaccctgttctttcgtccgtaccggggaacgacgccaccctctcttgcgacgggccgaccacgactgttcgacgacgactacgccgtcggtaaccaacgacggaacgccgtcggaccgtacggtcctacccgacgtaccttaccctacacgttaccgtaacttacgtaaccgttaccttaccgtaggtaccggtcccttacgttcgaaccgtaccgttaccccgaccggtccccggtactttccggaacggtccgggtaccgtacgggttccgggtaccggtacgggtaactaccggtacctttaccgtaaccttccgtacccgaaccgttactaacccgcccgtaaaccgtccgtaacggtacgtaccgtacgttaacgttacgttttccgaacgtttaacgtttaacttccgtacttaccgttaaacgtaaccgtaaaggttaccgtaccggttaccctacgttaaacgttcttaccgttaaccgtttccggtacccgttaaccgggtaaccttaaacggtacgtaacttaaactacccggaaaagttaccgtcggtccgtacgttaccggaaccgtactcgttaccgttcgtactttccgttactaccgttaccctcgttacttcgttaacg

SEQ ID NO: 165471 - DNA, 814 bp, Homo sapiens
  misc_feature: GYAE6OF02GUBQN.44.73.G07.1.454.CMB.1.raw
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatcgtgggctgaaatgaagaacgccgtgggtcctcggtagaaggtcctcgtgcgacggtcttcgtggacggcagttcttcaagaaactatcttaatccgtaccgtgggtcgaccgaccgacggccccgtaggacgtaagggtccgttaggacgtgggagttggggtgggtccgtcccggttacccctaagttttacgggaacaacgaaccgtaaaaccgtaccggacgaaccgtaaacgtaaaacgttacccgaacggggacctaagaccgtaaccgtaacggtacgtttaacccggaccggaaaccgtaaaccgtacccgaacggtacggtacggaccgtaacgtacccgttaactaagtcgggacgtcgttacggaccggtaacctaacccggttagaacggtaggttaccgtaggaacgggaccgtaacccggtacccttaagtttaacgtttacgtacggtaccggtacgtaaagtaaaccttaaaacgtttaccgtacccgtttacggtttttagggaccggttaagtagtaacgttgttaacgtagttaccgttagtttacgggtttaccggggtaaccggaaaggttaccgtaaaggtttaccgggtaaccttacccggttccgttaccgttccgaccgtcccgtacccgtaaccccggg

SEQ ID NO: 165472 - DNA, 996 bp, Homo sapiens
  misc_feature: GYAE6OF02FT4VV.44.73.G07.1.454.CMB.1.raw
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtgcaatcgtggggctgaaatgaagagccgtgggtcctcggtgaacggtctcctgcacggtcttcgtggaggcatcttcaacgtaaactatcttatcctaccgtgggtcgcgacgacggccctggaacgaagggtcttaggacggtggaggttggggtcgggtccgttccggttaccccttaagttttacggaacgtaacgacctaaaccgtacgtacgaaccgtaacggtaaacgttccggaacgggtactacggtaccgtacgaaccggtaaccgttaacccgggacggtaacgtaactacccgtaacggtacggtacgaccgacgtacctaagttacggtacggtaacgtccgtacgtaccggtaaccgtaaccgttacggaacgttacgtaccggtaacggaaccgggtaacccggtaacccggggttaaccctttaacggtttaaccgttttacccggttaccgggtacccgggttaaccggtaaaaccggtttaaaaaccgttttaaaaaacccgtttttacccgttaaacccgggtttttttaaccgggtttttttaccggggggaacccgggggttttaacggttaccgggtttaaaccgggttttaaccgtttaaccgggtttttaaccgtttaacgggttttaaccgggtttttaaaccggggggtttaccccgggggttaaaacccgggttaaaaccgggggggtttaaaaccggttaacccgggggttttaacccggtttaccccgggttaaacccccgggtttttccgttaaccccgggttttaacccgggtaacccccggttaccccccggtttaaccccggttaaaacccccccggggg

SEQ ID NO: 165473 - DNA, 1011 bp, Homo sapiens
  misc_feature: GYAE6OF02IS1MV.44.73.G07.1.454.CMB.1.raw
  modified_base (247)..(247): a, c, t, g, unknown or other
  misc_feature (247)..(247): n is a, c, g, or t
tcagacagtatatacacgaccggtgctcgatttagctctacgctcgagggggggaactgctcagttaggacccagagggaaccatggaagccccagctcagcttctcttcctcctgctactcgtcggcctcccagtacttcccgaaccgggaagtaaacttggttgttcgacggactaacggttcctccgaacgggccctaccccgttgtttccgttttacggtcctaccggaaggggggtaaaacncggtcccctaccccttccgtccgttcggaccggtaccggggacctacggttacaggtacggtttaggttaccgaaccaaccccgtaacccaaacgtccgttacccgttttcgttaaccggccgtttaacggtaaccgacgtaaccgtaaacggaaccggtcccgttccgggaaccccgtcggaacccccgttcccggttaaccggtccttaccccgttaacgtaacttaaccggtaaccgagtttaccggaacctaccgtacgaccggtaacgacggcccgttcgaccgtacgaccgtaccgtaagggtaaccgtgggttacccgggaacgttcggggtaacccgggtgggtttaacgggtaccgggtacgggtaaaaccgtaccgggttttacctaacccggttacccgtctaccgggtaaccgtaacgtacgtaaccggtaacgggtaaccgggtaccggttacgggaccggtaccgggtacggtaacggttacgtttaccggttaccggtttaacgtttaacggtttaacgtttaccgttacggtaccgtaacggttacggttacggttacgggttaccgttcccggttacggttaccgttaccgggttaccggtaaccggggtttaaccggaaccgggtacccgggttaaaccgggttaaacggtaaaccggttaaccggtaaacggtaacccgttaacgggtaaccttaacggtaccggttaccgtaaccgttaccgttaccgttcgtttaaccccggg

SEQ ID NO: 165474 - DNA, 790 bp, Homo sapiens
  misc_feature: GYAE6OF02IO3GI.44.73.G07.1.454.CMB.1.raw
tcagacagtatatacacgaccggtgctcgatttagctctacgctcagggggaggaactgctcagttaggacccagagggaaccatggaagccccagctcagcttctcttcctctgctactctggctccagattccaccggcgaaattgtgttgacacaatctccacgccacctgttctttcgtcgtaccggggaacgacgcccaccgtctcttgcgacgggcccggaccagtacgtgttcgacgacgtacgttagccgtggtaaccaacgagaacgtccgtcggaccaggcctccgacggtcctcctcaactctagtgtatcgacacgtaccgaacgtacgggtaccacgtacggacccaacccgaacgaaccgtacggtacgtacgggtcggacggtacgggtcgggtacggtcgggtaactacggtaccgttacgtaccgttctaccgtaacctaactccgacgaccgacgtccgtacgactacgtagtaacggtaagtttagtttcgtacgtttaacgtttaacttacgttagtacctaggtctaaagttacgttaagtccgtcgttaaccggttcccgttacccggtacccggtaaaccggtaaccggggtaaccttaaccgggaaccggttaaacgggaaactttaaacccggttaaaacggtacccgggttacgggtttaccgggtaccgttacccggtaaacgtacccgttaacgttttcccggttacgttttacctttaacccgtaacccgtttcccggtttaccccggttaccttaaccgg

SEQ ID NO: 165475 - DNA, 888 bp, Homo sapiens
  misc_feature: GYAE6OF02GFM4I.44.73.G07.1.454.CMB.1.raw
  modified_base (643)..(643): a, c, t, g, unknown or other
  misc_feature (643)..(643): n is a, c, g, or t
tcagacagtatatacacgaccggtgctcgatttagctctacgctcaggggggatcaggactcctcagttcaccttctcacaatgaggctccctgctcagctccgtggggctgactaatcgctcgtgggtctcgacgggtccagtggagattattataatgactcacgtcctccctctcccgtcgggcccgtccaccccgtgggacgaccggccccggtccctcctacttccgttccgttaggttacgggttccgtaaggtacggtaagtaggtttaccggttggggaacggtcgaaacggtaacctaacgttcttaaggttgggttaacgggttaccgtttaacggggtttaccgttggaaccggtaaacgggtaaccggggaccccgggacgttaaccggttaccctaaccccgtaaaccgtaaacccgtttccgttaacggttacggttttacccgttttaacggggtttttaccgggtacccgttaccccggggggtttccggggttacccccggggtttcccggggggttaaccttccggtaacggtaaccgggttcgtttaccgacggttccgccgtaaggtcgtactactaccacggaacaacggtacttcttacgaccgtacgttgaaccacgtanaccgaggttacgacgggtagggtacggcggttacgtaacggtcgggtacgtttcggggggtttacgttaaccttacgggttactacgtacccgttaacggttaaccgtaccgtttaaccgttaaccccggttaacccgttaccgttacgggacgggtaactaaccgggtaccgtacggtagttacggtaattaacggtacggaaccgtttcgcggttacgctaccggacctgttacgtccttacg

SEQ ID NO: 165476 - DNA, 411 bp, Homo sapiens
  misc_feature: GYAE6OF02GQI9W.44.73.G07.1.454.CMB.1.raw
  modified_base (185)..(185): a, c, t, g, unknown or other
  misc_feature (185)..(185): n is a, c, g, or t
  modified_base (207)..(207): a, c, t, g, unknown or other
  misc_feature (207)..(207): n is a, c, g, or t
  modified_base (340)..(340): a, c, t, g, unknown or other
  misc_feature (340)..(340): n is a, c, g, or t
  modified_base (343)..(343): a, c, t, g, unknown or other
  misc_feature (343)..(343): n is a, c, g, or t
  modified_base (345)..(345): a, c, t, g, unknown or other
  misc_feature (345)..(345): n is a, c, g, or t
  modified_base (349)..(411): a, c, t, g, unknown or other
  misc_feature (349)..(411): n is a, c, g, or t
tcagacagtatatacacgaccggtgctcgatttagctctacgctcaggggggggggtctcaggaggcagcgctctcgggacgtctccaccatggcctgggctctgctattcctcaccctcctcactcaggacacagggtcctgggcccagtctgccctgactcagcctgcctcgtgtctgggtcncctggacagtcgtcacatctcngcactggacgccaggcgtcacgcccgaaggcccaaccccatcgcctactctccggttccccgacccttcctactattacttacttgtcgtggacgtccggggctagggacctaaggggcctacgtagtacggntgntncgannnnnnnnnnnnnnnnnnnnnnnnnnnnnnnnnnnnnnnnnnnnnnnnnnnnnnnnnnnnnnn

SEQ ID NO: 165477 - DNA, 844 bp, Homo sapiens
  misc_feature: GYAE6OF02J0I4X.44.73.G07.1.454.CMB.1.raw
tcagacagtatatacacgaccggtgctcgatttagctctacgctcagggggaggaactgctcagttaggacccagagggaaccatggaagcccagctcagcttctcttcctcctgctactctgctccagattccacggcgtaaatgtgttgacacaatctccagccacctgttcttgtcgtccggggaacgcgccacccttctcttcgcgagggccgccagtactgttacgacggacgtaaagttacgccttacggtaaccaaacgaggaacggcctagggacccacggtccctaccccgaagtacctccctcaacgttcctaagtacgtaacttaaccgttactaagggtaccgggtccttacggtcggacctacgtccccgaacgtccccgtctttacgacggttggaccgtaggtcggggttcgacgggaactacggtaccttcgaccttcgtaccgaacctgtacctaaccgacggtacctacgtaacggtaccgttaacggtaacgttaacgtttttcggaacccgttttaaggttttaccttaaaccgttgttaaccgtacgtacggttaccggttccctttacccggtacggaccggttaccccgtacgtttacccggtttaccgggtttaccccggggggaaccgggggttaacccggtaaacggggttaccgggtaaacgttaacggttacccggtaaggggtttaaaaccgaccgggtttgggtacccggggtaacctttccggaacccgttaaacgttccggtttcggttaccggttttaccttaccgtttaacccgtcccgtttacccgggacctttacgggttaccctagg

SEQ ID NO: 165478 - DNA, 835 bp, Homo sapiens
  misc_feature: GYAE6OF02GGRRU.44.73.G07.1.454.CMB.1.raw
  modified_base (409)..(409): a, c, t, g, unknown or other
  misc_feature (409)..(409): n is a, c, g, or t
tcagacagtatatacacgaccggtgctcgatttagctctacgctcaggggccctgggagcacagctcatcaccatggactggacctggagttcctcttgtggtggcagcaactacaggtgtccagtcccagggtgcgtcgtggtgacaagtcgtgggtctagtaaagtgaaagacgtccgtagggtccgtcggtaggtacggtctcctgcgtacggtcttcgtggacggtcacttcttacgaacgtaacttacgtacttagtacctacggtgggtcgtacggaccgaccggtcccgtaggaacgtaacgggtcgtaggaaggtgaggtgggtcggtaccgtcccgtaccgttaagttagaacgtaacgaacctaaacgtccgaactagtaacgtaacgtacgacggtanaccgtactaccggtaagtaccgtaccggacgtaaccgtaactacgaacgtcgtacgaccaacgtacctaagtacggtacggtcgtacggtcgtaccgtaaccgtacgtacggtaactacgtacggtacggaacccgggtacctaacccgttaccgttaactttacgtacccggtacggtaacgtaccgtaaaaccggtaaaccgttaaaacctttacccggtaaccggtttaccgggtttacgggaaccggttgggttaactacggttaccgttaattagggttaaccggttgggttaaacccgggttacggggtaaaccgggtaaaccgggttacgttaaccggtaaccgggtttacccttaaccgggttccccggttaaccgttaccccggaaccggttacccccctaacgggtaaacccccgg

SEQ ID NO: 165479 - DNA, 829 bp, Homo sapiens
  misc_feature: GYAE6OF02FXBBN.44.73.G07.1.454.CMB.1.raw
tcagacagtatatacacgaccggtgctcgatttagctctacgctcaggggccctgggagcacagctcatcaccatggactggacctggaggttcctctttgtggtggcagcaactacaggtgtccagtcccaggtgcgtctggtcgcaatcgtggggctgaaatgaagaagccgtgggtcctcggtagaacggttcctccgtgcacggcttcgtggacggctagttcttacgaacgtaaaacttacgttactttactccgtaaccggttgggtacgaccgacgaccggccccgttaggaaccgtaacgggtcttaggaggtggtaaggtcgggggtcgggtccgttacccggttaccccttaagtttttacggaaccgtaaacggtaacctaaaaccgttaccgaccaaacgtaaagtaaaacctttacccgaagggtaccaacgtacccgttaccgtaaccgtaacgtttaacccggacggtaacctaaacgtacccgaaccgtaggttccgaccgtaacggtacccttaaggtacgtcggggaactccgtcggaccgtaacctaaccgggttagaacgtcgttacggaaggtaccgggaccaacccggtacccttagtttaaccgtttcgacgccgtaaccggtaaacgtaaaacctttaaaacgtttcccgtaaccggtttaccggtttacggggaacggttacgttaggtaacttcggtaagtttacgttagttacgttagggttcgggaaacgtaagggtacgtaacgtcggtaaccgtaccggttccttacgtaccgtaccggtaccctaccgtaaccccggg

SEQ ID NO: 165480 - DNA, 264 bp, Homo sapiens
  misc_feature: GYAE6OF02HLACG.44.73.G07.1.454.CMB.1.raw
  modified_base (230)..(264): a, c, t, g, unknown or other
  misc_feature (230)..(264): n is a, c, g, or t
tcagacagtatatacacgaccggtgctcgatttagctctacgctcaggggccctgggagcacagctcatcaccatggactggacctggaggttcctctttgtggtggcagcaactacaggtgtccaagtcccagggtgcgtctggtgcaatcgtggggctagaaatgaagaagccgtggtccgtcggtgaacggtctcctgcgacggcttcgtgggacgcctacctttcnnnnnnnnnnnnnnnnnnnnnnnnnnnnnnnnnnn

SEQ ID NO: 165481 - DNA, 779 bp, Homo sapiens
  misc_feature: GYAE6OF02HLD6M.44.73.G07.1.454.CMB.1.raw
  modified_base (276)..(276): a, c, t, g, unknown or other
  misc_feature (276)..(276): n is a, c, g, or t
  modified_base (723)..(723): a, c, t, g, unknown or other
  misc_feature (723)..(723): n is a, c, g, or t
tcagacagtatatacacgaccggtgctcgatttagctctacgctcagggggaggaactgctcagttaggacccagagggaaccatggaagccccagctcagcttctcttcctcctgctactctggcctccagacttccgaccggcgaaatttcgtgttgacacaatcctccacgccaccttgtctttgtccgtccggggaacgacgccaccctctctcgcgacgggccgccacgctcgttcgaacgacgtacgtacggctacggtaccacgagacnccgtaggaccacggccgtacccacgtacctacctccactactacgtagtaacttacgtttacgttacgggtaccggggtccccttacgtacggtaccgtaaccctaccccgaccggtaccccgtccgttaccggtaacgggttacggaccgttacggggttccgggttcgggtacgggtaaccgtaaccggttaaccggttaccttaaccgtccttacccgtaaacccgtactaaccccgtaaaccgaccggttacccgtacgtaccggtttaacccgtaagttaaccgtttacggttttaacaccgttttaagtttaaccttcgtaaaccggttacctaaccgttaacccggagtaaacgggtccgtacctacttaactcgttaccgttcgttaccggcccgtaacgggaaacttaagtccgtaatactaacgaattacgtcggtnaccgtacgcctaacgtcgtctttccgattcccataccctccggtctacgtgtaacc

SEQ ID NO: 165482 - DNA, 661 bp, Homo sapiens
  misc_feature: GYAE6OF02GHCOR.44.73.G07.1.454.CMB.1.raw
tcagacagtatatacacgaccggtgctcgatttagctctacgctcagggggaggaactgctcagttaggacccagagggaaccatggaagccccagctcagcttctcttcctcctgctactctggctcccagacttccaccggcgtaaattgtgttgacacaatctccagcccaccctgtctttgtccgtccgggggaacgagcccacccttctcctgcgagggccagtcagagtgttagcagcaacgttacgcctacgtacagacaagaactcgaggaccaggcctaccgaggtcctacccgtcacttctagtcggtagccactacccacggacggcctacgttcggtactcccgagccgtaggttcaggtcggtacctaggttcgggtctaggaacgacgtacgtaccgttccaactccgtaccaccgtagccgacggtccggacctaagggaccggtaacggtaagttcgtttacgactttaagtttacgtaaccgttgtaccgtagtccgtacgttccgttaccgcggacggtcccgtcttacggtaccggttcgggggaccgggtacgtagggtgacgacgtacgacgtaccgtaggtcggtcgtacctggaccctacgtagttccgttcgtacgttcctccgttcccgtccctac

SEQ ID NO: 165483 - DNA, 814 bp, Homo sapiens
  misc_feature: GYAE6OF02IWZWA.44.73.G07.1.454.CMB.1.raw
tcagacagtatatacacgaccggtgctcgatttagctctacgctcgaggggccctgggagcacagctcatcaccatggactggacctggaggttcctctttctggtggcagcaactacgaggtgtccagtcccaggtcgcgtctggtgcaacgtcgtgggctagaaagtgaagacgccgttgggtcctcggtgaacggtctccgtgacgacggtcttcgtaggacgctaattcgttacgagtaaaccttagtacttactcctaccggttagggtacgaccgaaccggtccccgtaggaaccggtaacggttaccgttaggtacggtacggtacggttcggggtcggtccgttacccggtaccccttaaggttttacggaacctaacggtaaccgtaaaccgttacgaccgaaacgtaacggtaaaacctttccgggaacgggtaaccaacggttaacctaccgtaaccgtaaaccggtttacccggaaccgggtaacgtaaacccgtaccggtaacgggttacgtacggtaaccgacgtaccgtagtacgacgggtacgtcgtacggacaaccgtacgtaggaacgtaacgtacgtcgaacggtccgtacggtcccttaagtccttacggcgtacggacgtaaacgtaaaccttaaagtttccgaacgttttacggttccgggacgttacgtacgttacggtcgtagttaagtcgttaagttaccgggttacgggaacctagggaaacttacgggtacgttaccgttacgttcccttaccgtagtaccccgaacttacccgggaaccgtaccgg

SEQ ID NO: 165484 - DNA, 677 bp, Homo sapiens
  misc_feature: GYAE6OF02GZ35U.44.73.G07.1.454.CMB.1.raw
  modified_base (63)..(63): a, c, t, g, unknown or other
  misc_feature (63)..(63): n is a, c, g, or t
  modified_base (173)..(173): a, c, t, g, unknown or other
  misc_feature (173)..(173): n is a, c, g, or t
  modified_base (191)..(191): a, c, t, g, unknown or other
  misc_feature (191)..(191): n is a, c, g, or t
  modified_base (199)..(199): a, c, t, g, unknown or other
  misc_feature (199)..(199): n is a, c, g, or t
  modified_base (289)..(289): a, c, t, g, unknown or other
  misc_feature (289)..(289): n is a, c, g, or t
  modified_base (468)..(468): a, c, t, g, unknown or other
  misc_feature (468)..(468): n is a, c, g, or t
tcagacagtatatacacgaccggtgctcgatttagctctacgctcagggggaggaactgctcngttaggacccagagggaaccatggaagccccagctcaggcttctcttcctcctgctactctggctccagataccaccggggaaattgtgttgcacaatctcagccacctntctttgtctcgagggaangccacctncctgcagggcagtcagtagtgttaggactacttaggccttggtatcaactgacctacctggtaccaggtccttcccgaggtccttacctnaacttctaggtcatacggctactaccgaaaggtcgggccgcgggcaactcccagtcccgtgggtttcaagggtcgtacgaggttcggttcaggtacgacaacggttcttcctaacgttacccgtaaaccagttcgaacgggtccgtacgtagggaacggtaccggtaagtacgttttanccgttaagtttacgtacgttcgaactaccggtactacgacggtacgtacgtacccgttagtaactttgggtttacgccgaacggggtaaccctagggttccgagggttaccgtaactaacgtaaccgggtacgttggacggtccgttacggaacctccgttaatccgttccggttacttccggtaccctccggtttacccgacttaccg

SEQ ID NO: 165485 - DNA, 686 bp, Homo sapiens
  misc_feature: GYAE6OF01EEB8I.35.54.E10.1.454.CMB.1.raw
  modified_base (182)..(182): a, c, t, g, unknown or other
  misc_feature (182)..(182): n is a, c, g, or t
  modified_base (225)..(225): a, c, t, g, unknown or other
  misc_feature (225)..(225): n is a, c, g, or t
  modified_base (303)..(303): a, c, t, g, unknown or other
  misc_feature (303)..(303): n is a, c, g, or t
tcagtacagatcgtcacgaccggtgctcgatttagatcgtagcagaacacacaaaggggtctgagagaggagcccagccctgggattttcaggtgttttcatttggtgatcaggactgaacagagagaactcaccatggagtttgggctgagcggtgtgttctaggtcggctatttaaaggngtcagtgtgagtgcagctgttgagtctggggagcttggcacgngtcgtcgggtcctgacgctctcgtgtcgctaacgtctcgtgtacttcgtagtttagtactacctagtcgtacgtatgngtcgtcggtccgtccggccgggtccggtccggacgggacgggtcggtacggtacggtacgggtacgtacgtaacgtagttagtagttaggtagtcgtacgtacgtaacgtaacgtacgtacgtacggtacgtacgtacgtaccgtaccggtacgggtaaccgggtaccggttaccgtaccgtacgtaccgtaccgtaacgaacgtaacgtaacgtaaccgtaacgtaacgtacgtacgtaactacgtacgtacgtaacgtaacgtaacgtaacgtacgtacgtacgacgacgacggacgtacgtacgtaccgttaacgttagttacgttacgtacgtacggtaacgttacggttacggttaggttacggtcggtagggtacgg

SEQ ID NO: 165486 - DNA, 605 bp, Homo sapiens
  misc_feature: GYAE6OF01AQ4QX.35.54.E10.1.454.CMB.1.raw
tcagtacagatcgtcacgaccggtgctcgatttagatcgtagcagaacacacaaaggggtctgagagaggagcccagccctgggattttcaggtgttttcatttggtgatcaggactgaacagagagaactcaccatggagtttgggctgagcgtgcgttttctaggtggctatttaaaaggtgtccagtgtgaggtgcagctgttggagtctgggggaggcttggcacagccgtgggggggtcccctggagactctcctgtgcagcctctggattcagttttagcacctatggcatgagctgctccgccggcgtccgacgggaaggggcgtggagtgggtcgtcgtaacctattagtagtaggttaggtggtctctaataactacgactaggttacgacgacgacgtaccgtacggaacgggccggttccggaccactcttaccacgagactaactaccgtacgaacgaacgactatatactacgactaataacgaacacgactacgagacggaccggacggtacgaccggtaccgttacttacgttaactacgtacgtacgtaaacgttacgttaggttaggtggtcggttggttaaccgggg

SEQ ID NO: 165487 - DNA, 565 bp, Homo sapiens
  misc_feature: GYAE6OF01BKIM5.35.54.E10.1.454.CMB.1.raw
tcagtacagatcgtcacgaccggtgctcgatttagatcgtagcagaacacacaaaggggtctgagagaggagcccagccctgggattttcaggtgttttcatttggtgatcaggactgaacagagagaactcaccatggagtttgggctgagctggcttttcttgtggctattttaaaaggtgtccagtgtgaggtgcagctgttggagtcgtgggggaggcttggcacagcctgggggggtccctgagctctcctgtgcagcctctggattctagttttagcacctatggcatgagctggcctccggccggctccgaggggagggctgggagtgggtctcactattgatgggtagtgctcataacacagtacggtacgacacgacgtccggtggacggggtcccggttacaccagtcctaccagacgacgaattacccgaaggaaccacgcttgtaactctaacaagtcggaactaggtctaggagacggaccgaggaccaccggtaccttatacttactggtcgacgtaaagttacgaacgacggtggcgtggcgtaacgggg

SEQ ID NO: 165488 - DNA, 638 bp, Homo sapiens
  misc_feature: GYAE6OF01EOH3Z.35.54.E10.1.454.CMB.1.raw
  modified_base (298)..(298): a, c, t, g, unknown or other
  misc_feature (298)..(298): n is a, c, g, or t
  modified_base (302)..(302): a, c, t, g, unknown or other
  misc_feature (302)..(302): n is a, c, g, or t
  modified_base (533)..(533): a, c, t, g, unknown or other
  misc_feature (533)..(533): n is a, c, g, or t
  modified_base (585)..(585): a, c, t, g, unknown or other
  misc_feature (585)..(585): n is a, c, g, or t
  modified_base (620)..(620): a, c, t, g, unknown or other
  misc_feature (620)..(620): n is a, c, g, or t
tcagtacagatcgtcacgaccggtgctcgatttagatcgtagcagaacacacaaaggggtctgagagaggagcccagccctgggattttcaggttgttttcattttggtgatcaggactgaacagagagaactcaccatggagtttgggctgagcgtgtctttcttgtggtctatttaaaggtgtcagtgtgaggtgcagctgttggagtcgtggggagcttggcacgagccgtcgggggtccctgagtctctcctgtcgcagcctcgtggattctagtttagcctacctagtcgganatgngcgtggccgtccggccggctccggaggggagggcgtaggcggttggtctacgtaactaagttgtagtgggtaacgtgaccttacgaactaaacacgtagtcggtaacgcgaacgtaccgtaccggtaggaccgggtaccgttacaccgtacgtacctacgaaagtacgaacctaacgtaccgaacggtaactaccgtacgtactacgtactacgaaactaacgtacgaacncgtaccgtagaaccgcgacggacgaaccgtacggtctttaaacgtattacgnggtacgtaaaccgtacggtttacgtaggttacggngttacggtcgggtaacgg

SEQ ID NO: 165489 - DNA, 666 bp, Homo sapiens
  misc_feature: GYAE6OF01DLD5L.35.54.E10.1.454.CMB.1.raw
  modified_base (407)..(407): a, c, t, g, unknown or other
  misc_feature (407)..(407): n is a, c, g, or t
  modified_base (422)..(422): a, c, t, g, unknown or other
  misc_feature (422)..(422): n is a, c, g, or t
tcagtacagatcgtcacgaccggtgctcgatttagatcgtagcagaacacacaaaaggggtctgagagaggagcccagccctgggattttcaggtgttttcatttggtgatcaggactgaacagagagaactcaccatggagtttggctgagcgtgtcttttcttggtggctatttaaaaggtgtccagtgtgaggtgcagctgtggagtcgtggggagcttggcacgagccgtgggggtccctgagacctctcctgtgcagcctcgtggtattcgtagttttacgctacctagtggctagtgacgtcgtcggccgtcccggccggccgtaccggagggggaacggtcgtacgggtaggtcgggtactacgtaacttgttagagttggtagtcgtctacaactaacncgtacgtacggtacncgtacgacgtccggtaggaccgggtccgttacacctactccgtacaagacgactaacgtaccgaagaccacgtacgtaatcgtacacgtaactaaacgacgtaacgacgtacctaacggacggtaaccggacccggtaacggaccgtaccggttaaccgtttaacgttaacgttacgtaggtaaccggtaggttaaacggttccggtaagggtttcggacgggttacggtacggggtaaacggg

SEQ ID NO: 165490 - DNA, 730 bp, Homo sapiens
  misc_feature: GYAE6OF01AQAOT.35.54.E10.1.454.CMB.1.raw
  modified_base (182)..(182): a, c, t, g, unknown or other
  misc_feature (182)..(182): n is a, c, g, or t
  modified_base (196)..(196): a, c, t, g, unknown or other
  misc_feature (196)..(196): n is a, c, g, or t
  modified_base (228)..(228): a, c, t, g, unknown or other
  misc_feature (228)..(228): n is a, c, g, or t
  modified_base (339)..(339): a, c, t, g, unknown or other
  misc_feature (339)..(339): n is a, c, g, or t
tcagtacagatcgtcacgaccggtgctcgatttagatcgtagcagaacacacaaaggggtctgagagaggagcccagccctgggattttcaggtgttttcatttggtgatcaggactgaacagagagaactcaccatggagtttgggctgagcgtgtcgtttctaggtgctagtttaaaggntcagtgtgagtgcngctgttggcgtcgtggggacgtgttggcacgnggtccggtgggggtccctggacgtctctccgtgtcgctacggtcctcgtggtaccttcgttaggtttaacgccgtaacctagtggacagttaggacgtcgtcggtaacccnccgggtccggccgttaccgggaggggtaacgggtcgttacgggaggttcgggtacctaacggtattaagttgtaagtggttacggctccttaagtaacgaactacgtaggttaacggtcccagtacgtacgtaccgggtagtaacccggggtctaccacacgttccaacgtacggaactaccctaacgtccgaaaggttaacccacgttacttaactcgacgtaacgtaaacgtaacgtaaccgacgtaccgacggacggaaccggaccgggtaaccggtaacgtacccggttacgtttaaccgtttacgtaacggttcggtaacggttaaccgttaaaggttacggtcgggttacgttacgggtaacggttcgggtaaagggttaccggg

SEQ ID NO: 165491 - DNA, 607 bp, Homo sapiens
  misc_feature: GYAE6OF01DDTPU.35.54.E10.1.454.CMB.1.raw
  modified_base (180)..(180): a, c, t, g, unknown or other
  misc_feature (180)..(180): n is a, c, g, or t
  modified_base (190)..(190): a, c, t, g, unknown or other
  misc_feature (190)..(190): n is a, c, g, or t
  modified_base (225)..(225): a, c, t, g, unknown or other
  misc_feature (225)..(225): n is a, c, g, or t
  modified_base (258)..(258): a, c, t, g, unknown or other
  misc_feature (258)..(258): n is a, c, g, or t
  modified_base (280)..(280): a, c, t, g, unknown or other
  misc_feature (280)..(280): n is a, c, g, or t
  modified_base (290)..(290): a, c, t, g, unknown or other
  misc_feature (290)..(290): n is a, c, g, or t
  modified_base (294)..(294): a, c, t, g, unknown or other
  misc_feature (294)..(294): n is a, c, g, or t
  modified_base (302)..(302): a, c, t, g, unknown or other
  misc_feature (302)..(302): n is a, c, g, or t
  modified_base (313)..(313): a, c, t, g, unknown or other
  misc_feature (313)..(313): n is a, c, g, or t
  modified_base (316)..(316): a, c, t, g, unknown or other
  misc_feature (316)..(316): n is a, c, g, or t
  modified_base (318)..(318): a, c, t, g, unknown or other
  misc_feature (318)..(318): n is a, c, g, or t
  modified_base (325)..(325): a, c, t, g, unknown or other
  misc_feature (325)..(325): n is a, c, g, or t
  modified_base (356)..(356): a, c, t, g, unknown or other
  misc_feature (356)..(356): n is a, c, g, or t
  modified_base (371)..(371): a, c, t, g, unknown or other
  misc_feature (371)..(371): n is a, c, g, or t
  modified_base (496)..(496): a, c, t, g, unknown or other
  misc_feature (496)..(496): n is a, c, g, or t
tcagtacagatcgtcacgaccggtgctcgatttagatcgtagcagaacacacaaaggggtctgagagaggagcccagccctgggattttcaggtgttttcatttggtgatcaggactgaacagagagaactcaccatggagtttgggctgagcgtgtgtttctaggtgctatttaaaggngtcagtgtgnggtgcagctgttggagtcgtggggagctggcacgngcgtgggggcctgacgctctctgtgcagtcctntggtattctagtttagcaactntgcatgagcnggcncgcggacncgagggaggcnggngngggtctnaattgtgagtggtagttcgctcaataaccgngttaagtacgggtcnccgaagggccttcccgggtaggaaccgggggttcccgttaccaaacgtactttcccgaccggaaaacgacgttaactaacgtaccgaacgaacgttaccgtattaactcgtacacaagtacgtanaccgtacgctacggacggacggaaccgtacggacctacgtaaccttaaagttacgttacggtaggtaacgtaacggttacggttggtaggttggacggtaggtgggtacgg

SEQ ID NO: 165492 - DNA, 748 bp, Homo sapiens
  misc_feature: GYAE6OF01D8GF4.35.54.E10.1.454.CMB.1.raw
  modified_base (192)..(192): a, c, t, g, unknown or other
  misc_feature (192)..(192): n is a, c, g, or t
  modified_base (536)..(536): a, c, t, g, unknown or other
  misc_feature (536)..(536): n is a, c, g, or t
  modified_base (567)..(567): a, c, t, g, unknown or other
  misc_feature (567)..(567): n is a, c, g, or t
tcagtacagatcgtcacgaccggtgctcgatttagatcgtagcagaacacacaaaggggtctgagagaggagcccagccctgggtatttttcaggttgtttttcattttggtgatcaggactgaacagagagaactcaccatggagtttgggctgagcgtgtcgttttctggtgtcttaagttttaaaggtntccagtgtgaggtgcagtctggttggagtcggtggggagtcttggccacgaggccgttcgggggtccctggacgtaccttcgtccgtgtcgctcgtcctacgtcggtatttacttaggtttttacgactaccgtagttcggactagtcgaggccgttcgggcccgtcccgggtccgggcccgtacgggaacggggaacgggtcgtagggtacggttcgggtactaccgtaattaagtgtagttggtacgtacgtcgtaacaaccgtaagtaccgtagtacggtacacggtacgtaccgtacggtacgtaacgggtccgttaccacttacgccgtacgaacgtanaaccgttaacgtacccgaaagtaaccgtacnctttaatactacgtagaaacgtaacgtaactaaccggactacgtacgtaacggaccgtaaacccgggacgtaaaccgttccggttaacctttaagttacgtttaacgtacgggtaccgttaaaacggaaacgttttgggtaacggtttgggaacccgttgggttacgggtaaacccggggg

SEQ ID NO: 165493 - DNA, 635 bp, Homo sapiens
  misc_feature: GYAE6OF01EHU5R.35.54.E10.1.454.CMB.1.raw
  modified_base (183)..(183): a, c, t, g, unknown or other
  misc_feature (183)..(183): n is a, c, g, or t
  modified_base (231)..(231): a, c, t, g, unknown or other
  misc_feature (231)..(231): n is a, c, g, or t
  modified_base (537)..(537): a, c, t, g, unknown or other
  misc_feature (537)..(537): n is a, c, g, or t
  modified_base (622)..(622): a, c, t, g, unknown or other
  misc_feature (622)..(622): n is a, c, g, or t
tcagtacagatcgtcacgaccggtgctcgatttagatcgtagcagaacacacaaaggggtctgagagaggagcccagccctgggattttcaggtgttttcatttggtgatcaggactgaacagagagaactcaccatggagtttgggctgagcgtgtcgttttctagtgctaatttaaaggtntcagtgtgaggtgcagctgttggagtcggtggggagtcgttggcacgngccgtgggggtccctgacgacgttctcctgtacgcgacgtcctcgtggtacttctagtttacgctaccgtagtgctagtgacgtcgtcggtccgtccgggccggtacgtccgggaaggggacgggtcgtagggtacggtcgggtactaccgtaagttagtggtagtacggtagtgtctaacgtaagtaaccacgtaggttacggacgacgtaacgtaccggtaccgtagggtaccgggttaccgtactaaccgtacgtacctacgaacgtacgactaactacgacgtaacgactactatactcganaacgtaagtacgaacgcgtactggacgacgaccgacgacgtacgttcgtatacgttacgtcgagtaccgtaacgtacgaagtcgnggtcgtagacggg

SEQ ID NO: 165494 - DNA, 797 bp, Homo sapiens
  misc_feature: GYAE6OF01EULWY.35.54.E10.1.454.CMB.1.raw
tcagtacagatcgtcacgaccggtgctcgatttagatcgtagcagaacacacaaaggggtctgagagaggagcccagccctgggattttcaggtgttttcatttggtgatcaggactgaacagagagaactcaccatggagtttgggctgagctggtcttttcttgtggggtcttaagttttaaaggtgtccagtgtgaggtgcagcgtggttggagtcgtggggggtaggtcgttggcacgacggccggtcggggggtccctggacggtacttcgtccgtgtcgcacggccttcgttaggtacttcgtagtttttacgacctaccgttagtcggacctagtcggacgtccggttcggtaccggtcccggtacccggggtcctacccggggaagggggtaacgggggtcgttaggggtaacgggttcgggttaccgttaacgtaaaccgtttagttacgggtaggttacgggttacgtacggtacctaacggtaaactaaccgtaaccgtaggttaccggttaccgacgtaacggtaccgttaccggtaaggggtacccggggttacccgttaccgaacccgttacggttaccctaaccggaacggtaaccgtaaccgttaaaccgttacccggaaacggtaaccctaacggtacttaacgttataccgtacgtaactaaacggtacaactcgggtacctagggaaccgtaggacccggagtacccggagttacgttactagttacggtagtacggtaagttaacggttcggtagttaggtcgtgggtggtaacggg

SEQ ID NO: 165495 - DNA, 626 bp, Homo sapiens
  misc_feature: GYAE6OF02IW5U9.35.54.E10.1.454.CMB.1.raw
tcagtacagatcgtcacgaccggtgctcgatttagatcgtagcagaacacacaaaggggtctgagagaggagcccagccctgggattttcaggtgttttcatttggtgatcaggactgaacagagagaactcaccatggagtttgggctgagctggcttttctgtgctatttaaaggtgtccagtgtgaggtgcagctgttggagtcgtgggggagcgttggcacaggcccgtggggggtccctggacggactcctccgtgtggccaggcctcgtgggattccgagttttagcctacctagtggcatgagctggctccggccggctccgagggagggctgggagtggtctcgaactgttgatggtagtcgctcattaacacagtcggtacgcagactccggtaggaacgggtcccggttcaaccgtagttccgtaccgagaacgaacctaaacgttcccgaaaggtaaaccaccggtactagtacgtacgagtaaccaaacgtagaaaccgacgtacctaggacgtaaccgccggacggaccaccgggtaccttaaagttacgttacgtcggtagaaccggttaacgttccggtaaggtttcggtagggtactgggttaaccgggg

SEQ ID NO: 165496 - DNA, 718 bp, Homo sapiens
  misc_feature: GYAE6OF02J0BHF.35.54.E10.1.454.CMB.1.raw
tcagtacagatcgtcacgaccggtgctcgatttagatcgtagcagaacacacaaagggtctgagagaggagcccagccctgggattttcgaggtgttttcatttggtgatcaggactgaacagagagaactcaccatggagttggctgagctggtcttttctgtgctatttaaagtgtcagtgtgaggtgcagtctgttggagtcgtgggggagtcgttggcacgagtcccgtggggggtaccctggagtacctcgttccctgtcgccaggtccttcgtggtatttccgtagttttagcgtaacctagtggacctagtcggagtccttcggccgttacccggccgggtccgttccggaaggggtacgggcgtagggtggtcggtctacgtaactagttagacgtggtacgtgacctacgaacgtaacacgtataccggtaacgacgtacgtaccgtaccggttaaggaaccgggttacccgggtacctaaccgtaagttacccgaccgtaaacggaaccgtaccgtaaaccgttaccgaaaacggaaccctacgtaaccgttaactacgtaccgtaacgaaccttaaagtacgaaaccggtcgaaccgtagaaccggacgtaaccgaacggtaccgacgttaacccggttaataccgttaacgtacgttaacgaacgttaacggttaacggtcggttagtcggacgttaggtaacggg

SEQ ID NO: 165497 - DNA, 685 bp, Homo sapiens
  misc_feature: GYAE6OF02G3M1N.35.54.E10.1.454.CMB.1.raw
tcagtacagatcgtcacgaccggtgctcgatttagatcgtagcagaacacacaaaggggtctgagagaggagcccagccctgggattttcaggtgttttcatttggtgatcaggactgaacagagagaactcaccatggagtttgggctgagcgtggtcgttttctagtggctatttaaaaggtgtcagtgtgaggtgcagcgtgttggagtcgtgggggaggcttggcacgagccgtcgggggtccctgagactctccgtgtgcacgtcctcgtggacttctacgtttagctaccgtatggcatgagtcgtgccgtccggccggccgtaccggaggggaacgggtcgtaggcggtacgggttctacgtaacgtagttcgagtaggtagtgtaccgtagtaacgtaacgtactacggtacgtaacgtcgtaacgtaccttacgggtacgggaaaccgggtccgttaaccgaacccgtaagtcccgtaaaccgaaggtaccgaaaccgttaccttacccggaaaggtaacccgtaacgttaccgtaacgttaaacttcgtaacgtaacaagttacgaacttgaccgtaaggacgaacgaccggtaacgactaccgggtaacttctaagttccgtagttacggaacggttaagttcggtagtttacggcgggttacgtagggtacgg

SEQ ID NO: 165498 - DNA, 693 bp, Homo sapiens
  misc_feature: GYAE6OF02F3M4T.35.54.E10.1.454.CMB.1.raw
tcagtacagatcgtcacgaccggtgctcgatttagatcgtagcagaacacacaaaggggtctgagagaggagcccagccctgggattttcaggtgttttcatttggtgatcaggactgaacagagagaactcaccatggagtttgggttgagctggctttttcttgtggctattttaaaaggtgtccagtgtgaggtgcagctgttggagtcgtgggggaggcgttggcacacgccgtggggggtccctgagactctcctgtcgcagccctcgtggactttcgtagtttttaacgcctacctatggctagtgagcgtggcctccggccgggctaccggaagggggaacggggtcgtagggacggttcgggtccgtacgtaaccgttattggtagttcgggtagtcggtctaacgaacttaaaccacgtagttacggtaaccgctaacggaccgttccggtaggaaccgggtcccggttaccaacccgtatcccgtaccgacgagtaaccaactttaccgaacggaaccaccgaccgttattacgtacgtacgaactaaatcgtaaccagtccgtagaacggaccgaccggaacggtaccgaccggttacctttaagttaactttacggtcgtacggaacggttaacgttaccggtaggtttcggtacgggtacgttgggaaccggttacgggg

SEQ ID NO: 165499 - DNA, 802 bp, Homo sapiens
  misc_feature: GYAE6OF02F1VBW.35.54.E10.1.454.CMB.1.raw
  modified_base (269)..(269): a, c, t, g, unknown or other
  misc_feature (269)..(269): n is a, c, g, or t
tcagtacagatcgtcacgaccggtgctcgatttagatcgtagcagaacacacaaaggggtctgagagaggagcccagccctgggattttcaggtgttttcatttggtgatcaggactgaacagagagaactcaccatggagtttgggctgagctggtctttttcttgtggctattttaaaaggtgtccagtgtgaggtgcagctgttggagtcgtgggggaggcgttggcacgagccgtcggggggtccctggacgactctcctgtgcngcctctggtacttctagtttacgacctacccttagcggactacgtagaggtcgtcgggacccgtcccgggcccggggcccgtaccgggaacggggggtaacggggtccgtaggggtaacgggttcgggttccgtacggtaaaccgttagtttaacggtacggttagggttacggttacgtaccgtacgtaaacgtaaaccgtaacgtaacgttacgggttaccgacgtaacggtaccgtttacccgggtaacgggtaaccggggtcccggttaccgaccgtaccgtcccgttaaccggaaacggtacgtaacctaacgttaccggaacgtaaacctaaccgggtctaaacgttacgtcgtaaacgaactaaacgttaacgaaacgtaccgtaccgtaacggacgtaaacccggccggaacggtacccggtacccggtaccgtttaaactttaccgtacggttacggttacggaaacggtttaacggttccggtttaaggttcgggtaccggttacgggtacgggttaaccggg

SEQ ID NO: 165500 - DNA, 845 bp, Homo sapiens
  misc_feature: GYAE6OF02GQ0KR.35.54.E10.1.454.CMB.1.raw
tcagtacagatcgtcacgaccggtgctcgatttagatcgtagcagaacacacaaaggggtctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgttggagtcgtgggggaggcttgggcacgacggccgtcggggggtccctggacgtacctcctccgtgtcgacacgccctcgtggtatttacgtaacgttttacggctaacccgttagtcggacagtggtacgcgttcgggtcccggtacccgggcccgggtccgtacccgggaaggggggtaacggggtcgtaggggtacggttcggggtcctaacggtaaacttagttagtaggttgggttaacgtcgacgttacaacgtaacctaacgtaggttcggtaaccggtacgtacggtacccgttaccgggtaggggtaacccgggggttaccccggttaccacccgttaacttacccgtacccgtaaggtaaaccgtaacctaaaccgttaccgtaaaccggaaacctacccggtacctaaatttaacccgttcgttaacgtaaccgtaaaacgtaacggtaaaccgaaccggttaccgttaacggacggaaaccgggtaccgggaaccgggtacccggtaacccgggttaaccttttaaacggttaaccgttaccggtttaaggaccgggttaacggttaaaccgggtttacggtaaggtttacggggtttcggtaccggggttaacgggtttaacccgggg

SEQ ID NO: 165501 - DNA, 661 bp, Homo sapiens
  misc_feature: GYAE6OF02JKDAL.35.54.E10.1.454.CMB.1.raw
  modified_base (547)..(547): a, c, t, g, unknown or other
  misc_feature (547)..(547): n is a, c, g, or t
tcagtacagatcgtcacgaccggtgctcgatttagatcgtagcagaacacacaaaggggtctgagagaggagcccagccctgggattttcaggtgttttcatttggtgatcaggactgaacagagagaactcaccatggagtttgggctgagctggtcttttcttgtggcttattttaaaggtgtccagtgtcaggtgcagttggtggagtcgtgggggagcgtggtccagccgtgggacgtcctggacgactctccgtgtgcagtccttataggtatttccgacctttcgaggtactcttaacgtggacctagttcgcctacggtcgggtcccgccgtagggtcctaccggagggcggtaacgggggcgttagggacgggttcgggtacgtccgtaagttacgtactcgtagtacgttaggacggttaaggaagtaagtgtaaccgttacgagttacgacgtaacggtagttacggaacggtaacgggaccttacttaccgacgttctaccgtacgaacgaactacgtaacgtaccgaagtaaccncgtagtcgttactacgtagaactaagacgtaacgactcgtagacgtcgacgtaggacgtacgcggtacgttgtaccgttattacggtcgtaacggtaacgtagttaccgtacgg

SEQ ID NO: 165502 - DNA, 529 bp, Homo sapiens
  misc_feature: GYAE6OF01AF8GC.26.79.H02.1.454.CMB.1.raw
tcagagactatactcacgaccggtgctcgatttagtgtcacacgaagggaaagggggagtcagtctcagtcaggacacagcatggacatgagggtccccgctcagctcctggggctcctgctactctggctccgaggtgccagatgtgacgtccagatgatccagtctccgccctccctgtctgcatctgtaggagacagagtcaccatcacttgccgggcaagtcagagcattggcacctatttaaatggtatcaacagaaaccagggaaacgcccctaacctcctgatctatgctgcttccaatttgcaaagtgagtcccatcaagattcagtgccagtggatcgtggacagatttcactctcaccatcaacagtctgacaacctgaagtatttgactaacttacttctgtacaacagtaacgttccaaacgtcccgttaggaccgtttcggacccgtaaacggaccgtagggtacggaacgacccgaaaacggactggtcggactgaccaccatctgttcttctac

SEQ ID NO: 165503 - DNA, 564 bp, Homo sapiens
  misc_feature: GYAE6OF01C4UGP.26.79.H02.1.454.CMB.1.raw
  modified_base (267)..(267): a, c, t, g, unknown or other
  misc_feature (267)..(267): n is a, c, g, or t
  modified_base (323)..(323): a, c, t, g, unknown or other
  misc_feature (323)..(323): n is a, c, g, or t
  modified_base (406)..(406): a, c, t, g, unknown or other
  misc_feature (406)..(406): n is a, c, g, or t
tcagagactatactcacgaccggtgctcgatttagtgtcacacgaagggaaagggggagtcagtctcagtcaggacacagcatggacatgagggtccccgctcagctcctggggctcctgctactctggctccgaggtgccagatgtgacgtccagatgatccagtctccgccctccctgtctgcatctgtaggagacagagtcaccatcacttgccggcaagtcagagcattgcactattaatgtatcaacagaaaccaggaaacncccctaactcctagactctatgctgcttcaatttgacaaagtgatcccatcaagtnttcagtgcagtggatcgtaggacagtatttcactctacaccatcagcggctccagtctgacgactctgacctaatttactacncgaaccaaactaagttactagtaatttaacgttttacttcctaccgaaggtcccggtttacgggacccgtaaagggggtaaccctaaaggggttacggaaacggttcccgaaaagggtccgtaaacgtcgggttacggacttcggacctaaccgtacg

SEQ ID NO: 165504 - DNA, 514 bp, Homo sapiens
  misc_feature: GYAE6OF01A84R1.26.79.H02.1.454.CMB.1.raw
  modified_base (494)..(494): a, c, t, g, unknown or other
  misc_feature (494)..(494): n is a, c, g, or t
  modified_base (511)..(511): a, c, t, g, unknown or other
  misc_feature (511)..(511): n is a, c, g, or t
tcagagactatactcacgaccggtgctcgatttagtgtcacacgaagggaaagggggagtcagtctcagtcaggacacagcatggacatgagggtccccgctcagctcctggggctcctgctactctggctccgaggtgccagatgtgacgtccagatgatccagtctccgccctccctgtctgcatctgtaggagacagagtcaccatcacttgccgggcaagtcagagcattggcacctatttaaatggtatcaacagaaaccagggaaacgccccctaacctcctgatctatgctgcttccaatttgcaaagtggagtcccatcaagattcagtgccagtggatctgggacagatttcactctcaccatcaacagtctgacaacctgaagtattttagactaacttacttctgtacaacagtacgttaccaaacgtcccgtaggtacgttcggaccaacggaccgaggtacggaacgaccgaaacgactgnggctgcacatctgtctntac

SEQ ID NO: 165505 - DNA, 576 bp, Homo sapiens
  misc_feature: GYAE6OF01D2B2W.26.79.H02.1.454.CMB.1.raw
  modified_base (273)..(273): a, c, t, g, unknown or other
  misc_feature (273)..(273): n is a, c, g, or t
tcagagactatactcacgaccggtgctcgatttagtgtcacacgaagggaaagggggagtcagtctcagtcaggacacagcatggacatgagggtccccgctcagctcctggggctcctgctactctggctccgaggtgccagatgtgacgtccagatgatccagtctccgccctccctgtctgcatctgtaggagacagagtcaccatcacttgccgggcaagtcagagcattggcacctatttaatggtatcaacagaaaccagggaaacncccctaacctcctgactctatgctgcttccatttgacaaagtggagtcccatcaagattcagtgccagtgatcgtgggacagtatttcactctacacctatacaactagtctgacctaacctgaagtattttcgactaactttacttctacgtacaacagtacgttaccctaaacggttcccgtaggtaccgttaccggacccgtaacgggtacccgaaggggtacggaaacgtacccgaaaacggtactagggtcggccgtaggaccctaaccgtacttccgttacggttcccttctacccg

SEQ ID NO: 165506 - DNA, 533 bp, Homo sapiens
  misc_feature: GYAE6OF01AZ78G.26.79.H02.1.454.CMB.1.raw
  modified_base (281)..(281): a, c, t, g, unknown or other
  misc_feature (281)..(281): n is a, c, g, or t
  modified_base (393)..(393): a, c, t, g, unknown or other
  misc_feature (393)..(393): n is a, c, g, or t
  modified_base (501)..(501): a, c, t, g, unknown or other
  misc_feature (501)..(501): n is a, c, g, or t
  modified_base (510)..(510): a, c, t, g, unknown or other
  misc_feature (510)..(510): n is a, c, g, or t
tcagagactatactcacgaccggtgctcgatttagtgtcacacgaaggggaaagggggagtcagtctcagtcaggacacagcatggacatgagggtcccccgctcagctcctggggctcctgctactctggctccgaggtgccagatgtgacgtccagatgatccagtcctccgccctccctgtctgcatctgtaggagacagagtcaccatcacttgccgggcaagtcagagcattggctacctatttaaattgtatacaacagaaaccaagggaaaccncccctaacctcctagtatctatgctgtcttacatttgactaagtgactccatacaagtatcagtcgcaggtggactcgtaggactagtattcactctcacatacaacagtcncacactagaagttatttcgactacttctctagtacaacgtagtaacgttacgaacgtccgtacggtacgttcgaccgacggacgagggacgaacgaccgtaacggtanacggtgacngaccactactagtctctactccg

SEQ ID NO: 165507 - DNA, 710 bp, Homo sapiens
  misc_feature: GYAE6OF01E0Q69.26.79.H02.1.454.CMB.1.raw
  modified_base (198)..(198): a, c, t, g, unknown or other
  misc_feature (198)..(198): n is a, c, g, or t
  modified_base (285)..(285): a, c, t, g, unknown or other
  misc_feature (285)..(285): n is a, c, g, or t
  modified_base (354)..(354): a, c, t, g, unknown or other
  misc_feature (354)..(354): n is a, c, g, or t
tcagagactatactcacgaccggtgctcgatttagtgtcacacgaagggaaagggggagtcagtctcagtcaggacacagcatggacatgagggtccccgctcagctcctggggctcctgctactctggctccgaggtgccagatgtgacgtccagatgatccagtcgccatcctcactgtctgccttctggtagganacagagtcaccatcacttgcgggcagtcgagggctattagcgtattttttagccttggtttccagtacaagaaaccgagggaaaccncccccaagtccctagactactatggctcgccgtacctacgtttagaggtgacgtccatcaggtcagcgnagtgatcgaggactagacgttcactctacaactactcgaacgtcaacgtcccgtacggacccgaaggtcccgttagggaacgttttacgtttttacgaacccgtttaaaactttacgtttaaccgttacgtacccgtaaggtaaccttaaaggttaacttaaacgttaccggttaaactttaacccccgttaacgttacccgttaacccgggtttacccgggggaaccccgggggtaaaccgtaacccggggtaacgttaaacgggtaaaaaaccccggtttaaaacggtaacggttacgggttaaccggaccttacccgggaccttaacccgtaactttcggtacggtttacccc

SEQ ID NO: 165508 - DNA, 723 bp, Homo sapiens
  misc_feature: GYAE6OF01DXOC0.26.79.H02.1.454.CMB.1.raw
  modified_base (288)..(288): a, c, t, g, unknown or other
  misc_feature (288)..(288): n is a, c, g, or t
tcagagactatactcacgaccggtgctcgatttagtgtcacacgaagggaaagggggagtcagtctcagtcaggacacagcatggacatgagggtccccgctcagctcctggggctcctgctactctggctccgaggtgccagatgtgacgtccagatgatccagtcctccgccctccctgtctgcatctgtaggagacagagtccaccatccacttggcccgggcaagtcagagcagttggcctacttaatttaaagttggtatacaacaagaaaccgagggaaacnccccctaacctcctagactctatcgctgacctttacctaattttgactaaaggtcggaacgtcccatacaagtacttcgagtcgacctaggtacggattcggtgggaactaggttactttaccaccttcctaccaacctataccaacgtacgttcctacgaacctaaacgtagtaacgtttattttacgacctttaaactttcttacgtacgtaaccaaacgttaacggttaaccgtttaacccggaaaccggtttccccgggttaagggttaccccggtttacccgggaaccccggtaaaccggggtaacccggtaaggggggttaaccggaaaaccggtaaccccgtaaaaaccgggtaccgttgggttaaccgggcccttacggaacccctaaccgttaacgttccgtttacgtttcccttcgttaaccccg

SEQ ID NO: 165509 - DNA, 555 bp, Homo sapiens
  misc_feature: GYAE6OF01EVS07.26.79.H02.1.454.CMB.1.raw
  modified_base (270)..(270): a, c, t, g, unknown or other
  misc_feature (270)..(270): n is a, c, g, or t
  modified_base (373)..(373): a, c, t, g, unknown or other
  misc_feature (373)..(373): n is a, c, g, or t
tcagagactatactcacgaccggtgctcgatttagtgtcacacgaagggaaagggggagtcagtctcagtcaggacacagcatggacatgagggtccccgctcagctcctggggctcctgctactctggctccgaggtgccagatgtgacgtccagatgatccagtctccgccctccctgtctgcatctgtaggagacagagtcaccatcacttgccggcaagtcagagcattgcactatttaaatgtatcaacagaaaccagggaaacncccctaacctcctgatctatgctgcttccaatttgcaaagtggacgtcccatacaagattcagtgcagtgactgtgggacagtatttcactctcacatcaacngtctgacaacctgaagtatttcgactaacttacttctagtacaactagtaacgttaccgaaacgttcccggtacggtacgtttaccggacccgtaaaccgggaccgtagggggtacgaaacggacccgaaaacggaactggtacggacttcgacctaacctacgttcttcgttcttcgtacg

SEQ ID NO: 165510 - DNA, 645 bp, Homo sapiens
  misc_feature: GYAE6OF01BI4NT.26.79.H02.1.454.CMB.1.raw
  modified_base (365)..(365): a, c, t, g, unknown or other
  misc_feature (365)..(365): n is a, c, g, or t
  modified_base (422)..(422): a, c, t, g, unknown or other
  misc_feature (422)..(422): n is a, c, g, or t
tcagagactatactcacgaccggtgctcgatttagtgtcacacgaagggaaagggggagtcagtctcagtcaggacacagcatggacatgagggtccccgctcagctcctggggctcctgctactctggctccgaggtgccagatgtgacgtccagatgatccagtcctccgccctccctgtctgcatctgtaggagacagagtcaccatccacttggccgggacaagtcagagctagttagcgttatttttacgccttggttcagcaagaaaccgagggaaccgccccctaagtccctgactctatcgctcgtccgtactacgtttaggaggtcggacgtcccatacgtaacggttcacggcgntaggtggagttcgagggactagtacgttcactctacaactctacgactcacttccgngaccgtacgtccgttaggtaggttactttacgactttaactttactactcgtaccagtactaagttataaccgtacgttaaccctttaccccgttactacccgttacccgggttacccggggaccggggtaaccgtacccgggtacgtaaaaccgggtaaaccgttaaacggtacgttcggtacggtccgtacgtaccctaacgttctccgtttcgttacccg

SEQ ID NO: 165511 - DNA, 679 bp, Homo sapiens
  misc_feature: GYAE6OF01CGW4L.26.79.H02.1.454.CMB.1.raw
  modified_base (101)..(101): a, c, t, g, unknown or other
  misc_feature (101)..(101): n is a, c, g, or t
  modified_base (195)..(195): a, c, t, g, unknown or other
  misc_feature (195)..(195): n is a, c, g, or t
  modified_base (222)..(222): a, c, t, g, unknown or other
  misc_feature (222)..(222): n is a, c, g, or t
  modified_base (232)..(232): a, c, t, g, unknown or other
  misc_feature (232)..(232): n is a, c, g, or t
tcagagactatactcacgaccggtgctcgatttagtgtcacacgaagggaaagggggagtcagtctcagtcaggacacagcatggacatgagggtccccgntcagctcctgggctcctgctactctggctccgaggtgccagatgtgacgtccagatgatccagtcctccgccctcctgtctgcatctgtagganacagagtcaccatcacgttgccggganaagtcagacncagttcgctacttaatttaaatggtactacaaacgaacgaaaccgagggaaacctcccctaaactccgtagacttctatcgcttcgtctttacctatttagactaaaggtgtaactcccatacaagtattcgaagtcgacctaggtggtactgtacggactaagttactttcgaccttactaccaaccgtactaaccgaacgttccgtactacgtaacctaaccgtagtaaacgtttacgttttacgaaccttaaccttttacttacttaccgtaacaactaacggttaggtttaaccccgaaacggtttccccggtaggttaacccggtccggtaacccgaaccgggaaccggtacggggaaccggaagaaccccggtaaacggtaacggtacgggtcggtacctacggaacctaaccgtacgtactttcggttccttcgtacccg

SEQ ID NO: 165512 - DNA, 738 bp, Homo sapiens
  misc_feature: GYAE6OF01ARZ58.26.79.H02.1.454.CMB.1.raw
  modified_base (292)..(292): a, c, t, g, unknown or other
  misc_feature (292)..(292): n is a, c, g, or t
tcagagactatactcacgaccggtgctcgatttagtgtcacacgaagggaaagggggagtcagtctcagtcaggacacagcatggacatgagggtccccgctcagctcctggggctcctgctactctggctccgaggtgccagatgtgacgtccagatgatccagtctccgccctcctgtctgcatctgtaggagacagagtcaccatcacgttggcccgggacaaaggtcaggacgctaagttcggctaactatttaaatggtaatacaacaagaaaccgagggtaaaccnccccttaaactcctagacttaccgtatcggacttgtacctttaccgtaatttcgactaaaaggtcggtaaccgtacccgtaataccgtaaacgtctttaccgagtcggtacccgtaaggttcgggtaacttccggtaaggggtaacctaaggtttaaccttttaccgaccttaccttacccgaacccgtaacttaccaaaacgttcgtaccgtacggtaacctaaaccgttagtaacgttactttacgaccttaaactttcgtttacgtcgtactaacgtacgttaaccggttaccgtaaacggttcccggtacgggtaacccgtttccggaacccgtaacgggtacccggaaggggttacgaaaccggtacccgaaaacggtcgtacgggttcggaccctaggacccgtaaccgtacgttaccgtaccgtttcgttccgtaaccc

SEQ ID NO: 165513 - DNA, 771 bp, Homo sapiens
  misc_feature: GYAE6OF01ESBZT.26.79.H02.1.454.CMB.1.raw
tcagagactatactcacgaccggtgctcgatttagtgtcacacgaagggaaagggggagtcagtctcagtcaggacacagcatggacatgagggtccccgctcagctccgtggggcctcctgctactctggctccggaggtgccagatgtgacgtccagatgactccagtcctccgccctcctgtctgcatcgtggtaggagacagacgtacaccatcacgttcgggccgggacaagtcaggagtcgtagttcggaccttaactttaagtttaaagttcggtacttaacaaaacgaacgtaaaaaccgaggggaaacccctaccccctaaccttcgtagacttacgtagtccgcttacgtacctttaccgtaatttcggaacgtaaggtcggaacctaccgtatacgaagttactacgaacgttcgacgaggttacggtacgttacggaagacgttaagttccttaccgtacctctaccaactaacacgtaacgtacgtcacgtaacctaacgtaagttacgttacgtttactaaacttaccgtttactacgttaacgtaactaaaccgttaacggtaaccgttaaccccggtacgggttacccggtacggggttaaccccgtaacccgggacccgtaaaccggggtaaccggttacggggaaccgggtaaaaccgtaaacccggtaaacggttacgggttcggtaaccgtaccaaccgggacccttaacggtaccgttttacctccggtttaacctcccggttaaccccg

SEQ ID NO: 165514 - DNA, 507 bp, Homo sapiens
  misc_feature: GYAE6OF02G5S27.26.79.H02.1.454.CMB.1.raw
  modified_base (504)..(504): a, c, t, g, unknown or other
  misc_feature (504)..(504): n is a, c, g, or t
tcagagactatactcacgaccggtgctcgatttagtgtcacacgaagggaaaggggagtcagtctcagtcaggacacagcatggacatgagggtccccgctcagctcctggggctcctgctactctggctccgaggtgccagatgtgacgtccagatgatccagtctccgccctccctgtctgcatctgtaggagacagagtcaccatcacttgccgggcaagtcagagcattggcacctatttaaattggtatcaacagaaaccagggaaagcccctaaacctcctgatctatgctgcttccaatttgcaaagtggatcccatcaagattcagtgccagtggatctgggacagatttcactctcaccatcaacagtctgcaacctgaagtattttgactaaactttacttctgtacaacagacttaccaaagtcccgtaggaccgtttcggaccaacggaccagggtgaagaccaaacgaactgtggctgcaccatctgtctntac

SEQ ID NO: 165515 - DNA, 521 bp, Homo sapiens
  misc_feature: GYAE6OF02GZIT0.26.79.H02.1.454.CMB.1.raw
  modified_base (383)..(383): a, c, t, g, unknown or other
  misc_feature (383)..(383): n is a, c, g, or t
tcagagactatactcacgaccggtgctcgatttagtgtcacacgaagggaaaggggagtcagtctcagtcaggacacagcatggacatgagggtccccgctcagctcctggggctcctgctgctctgtttcccaggtgccagatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtgggtccatcaaggttcagtggcgccggatctgggacagaattcactctcaccatcagcggctccagtcngaggactctgcaactttattactgaccaaactaatatagtaattattttaacttctcctaagtccgtttcggaccgtaagggggacccaagggttggaaggtcgaaaggcgaacgtgtgcgtgccaccatcgtgttcc

SEQ ID NO: 165516 - DNA, 565 bp, Homo sapiens
  misc_feature: GYAE6OF02IVSHD.26.79.H02.1.454.CMB.1.raw
  modified_base (275)..(275): a, c, t, g, unknown or other
  misc_feature (275)..(275): n is a, c, g, or t
tcagagactatactcacgaccggtgctcgatttagtgtcacacgaagggaaagggggagtcagtctcagtcaggacacagcatggacatgagggtccccgctcagctcctggggctcctgctactctggctccgaggtgccagatgtgacgtccagatgatccagtctccgccctccctgtctgcatctgtaggagacagagtcaccatcacttgtcgggcagtcagggcattagcgtatttttagccttggtttcagcagaaaccagggaaacncccccaagtccctgatctatgctgctccactttagagtggagtccatcaagtcagcggcaggtgatcgtgggacagtagttcactctacaacatacagcagcctagcagcctggagtatttgactaacttattactgaccagcaagtaattaatcgtaactttaccctattacctacccggtttaccgggaccgggggtaccaccggtacgtaacgggtaaaacctaaaccggaacgttggtacgggtaccttacggaccgtaaccgtagttcccttaggttccttaccg

SEQ ID NO: 165517 - DNA, 545 bp, Homo sapiens
  misc_feature: GYAE6OF02FFJPB.26.79.H02.1.454.CMB.1.raw
  modified_base (274)..(274): a, c, t, g, unknown or other
  misc_feature (274)..(274): n is a, c, g, or t
  modified_base (335)..(335): a, c, t, g, unknown or other
  misc_feature (335)..(335): n is a, c, g, or t
tcagagactatactcacgaccggtgctcgatttagtgtcacacgaagggaaagggggagtcagtctcagtcaggacacagcatggacatgagggtccccgctcagctcctggggctcctgctactctggctccgaggtgccagatgtgacgtccagatgatccagtctccgccctccctgtctgcatctgtaggagacagagtcaccatcacttgccgggcaagtcagagcattggcactatttaaattggtatcaacagaaaccagggaaacncccctaactcctgatctatgctgctttcaatttgacaaagtggatccatcaagattcagtncagtggatcgtgggacagatttcactctcacatcaatacgtctagacctaaccgtgaagttattttgaccttaaactttacttctagtacaaactggacgtttacccaaacgttcccgtagggtaaccgttccgaccgaacgggaccgaggggtcgaacgaccgaaaacggactggtacggctggacctactagtctacgttcctctacg

SEQ ID NO: 165518 - DNA, 543 bp, Homo sapiens
  misc_feature: GYAE6OF02I1FIM.26.79.H02.1.454.CMB.1.raw
  modified_base (351)..(351): a, c, t, g, unknown or other
  misc_feature (351)..(351): n is a, c, g, or t
  modified_base (383)..(383): a, c, t, g, unknown or other
  misc_feature (383)..(383): n is a, c, g, or t
tcagagactatactcacgaccggtgctcgatttagtgtcacacgaagggaaagggggagtcagtctcagtcaggacacagcatggacatgagggtccccgctcagctcctgggctcctgctgctctgtttcccaggtgccagatgtgacatccagatgacccagtctccttccaggctgtctgcatctgtcggagacagagtcaccatcacttcgccgggccagtcagagtattggtaggtggtgcctggtatcagcagaaaccaggaacaatccctaagactacctaatctctcaggcgtctggtttaggaagtgggtcccatcaaggttcagtggcgcgatcgtagganagaatcactctcacatcgagcggctccagtcngacgtactcgtgtactaacttattacctagaccctaaactaatatgtaattattttactcttaccacgttccgttacggacgtacgggaccgtaagggtggaaacgtcgaaacgcggtaaacgtggtacggcgttcggaccaccgtattccgtgttaccc

SEQ ID NO: 165519 - DNA, 620 bp, Homo sapiens
  misc_feature: GYAE6OF02ID2LU.26.79.H02.1.454.CMB.1.raw
  modified_base (321)..(321): a, c, t, g, unknown or other
  misc_feature (321)..(321): n is a, c, g, or t
tcagagactatactcacgaccggtgctcgatttagtgtcacacgaagggaaagggggagtcagtctcagtcaggacacagcatggacatgagggtccccgctcagctcctggggctcctgctactctggctccgaggtgccagatgtgacgtccagatgatccagtctccgccctccctgtctgcatctgtaggagacagagtcaccatcacttgccggcaagtcagagcattggcacctatttaaatgtatcaacagaaacaggaacgccctaacctctgatctatgctgcttcaatttgacaagtgagtcccatacaanttcagtgccagtgatcgtggacagtatttcactctacacatacaacatctcacaacctgtaatatttcgactaactttacttctgtacctaaacgacgtaacgttacccgtaaacgttccccggttagggtaacccggtttacccgggacccgtaaaacccgggtaacccgtaaggggggttacggaaaacccgggtaaccccgaaaacggtaaacccggttacgggttaccgggtacccgttacggacccttaacccgtacctttacccgtacggttttcccctttacgttaaccccg

SEQ ID NO: 165520 - DNA, 595 bp, Homo sapiens
  misc_feature: GYAE6OF02HLKD3.26.79.H02.1.454.CMB.1.raw
  modified_base (278)..(278): a, c, t, g, unknown or other
  misc_feature (278)..(278): n is a, c, g, or t
  modified_base (348)..(348): a, c, t, g, unknown or other
  misc_feature (348)..(348): n is a, c, g, or t
tcagagactatactcacgaccggtgctcgatttagtgtcacacgaagggaaagggggagtcagtctcagtcaggacacagcatggacatgagggtccccgctcagctcctggggctcctgctactctggctccgaggtgccagatgtgacgtccagatgatccagtcctccgccctccctgtctgcatctgtaggagacagagtcaccatcacttggccgggcaagtcagagcattggcaccttatttaaattggtatacaacagaaaccagggaacncccctaacctcctagactctatgctgtaccttcctaatttgactaaaggtcggacgtacccatacaagtnttcgagtgacctaggtggactcgtagggactagtactttcctacctcctacctaaccgtataccaactacgttacctcgaaccctaaccgtagtaaacgttacttttacgaccctttaacttaccttactacgtactaacgacgtaacgttaccgtaaacgtccggtagtaccgtcgaccgaacgtacgaggtacgaacgacgaacgacgtggacgtcgtagcctacgtcttccgtgttactctacc

SEQ ID NO: 165521 - DNA, 515 bp, Homo sapiens
  misc_feature: GYAE6OF02I7CY3.26.79.H02.1.454.CMB.1.raw
  modified_base (196)..(196): a, c, t, g, unknown or other
  misc_feature (196)..(196): n is a, c, g, or t
  modified_base (412)..(412): a, c, t, g, unknown or other
  misc_feature (412)..(412): n is a, c, g, or t
tcagagactatactcacgaccggtgctcgatttagtgtcacacgaagggaaagggggagtcagtctcagtcaggacacagcatggacatgagggtccccgctcagctcctggggctcctgctactctggctccgaggtgccagatgtgacgtccagatgatccagtctccgccctccctgtctgcatctgtagganacagagtcaaccatcacttgtcgggcagtcagggcattagcgtatttttagcctggtttcagcagaaaccagggaacgaccccaagtccctagatctatgctgctactactttagaaggtgagtccatcaaggttcagcgcagtgatcgtgggacagtagttcacgtctacaactatcagcagtcctgcagctagagtatttgactacttattacngaccagactaagtataatcgacttaccgtataccgtaccgtcgggaccgggtacacgcgtaacgaaactaacgatggtacgctagacgacactctcgtcttac

SEQ ID NO: 165522 - DNA, 707 bp, Homo sapiens
  misc_feature: GYAE6OF02I7DLB.26.79.H02.1.454.CMB.1.raw
  modified_base (661)..(661): a, c, t, g, unknown or other
  misc_feature (661)..(661): n is a, c, g, or t
  modified_base (701)..(701): a, c, t, g, unknown or other
  misc_feature (701)..(701): n is a, c, g, or t
tcagagactatactcacgaccggtgctcgatttagtgtcacacgaagggaaagggggagtcagtctcagtcaggacacagcatggacatgacgggtccccgctcagctcctgggctcctgctactctggctccgaggtgccagatgtgacgtccagatgatccagtctccgccctcctgtctgctatcgtgtaggagacagtacgtcacctatcacgttggccgggacaagtcagacgtcagttggacctaaccttaagtttaaagtggtaactactaaacacgaaaaccgtagggaaaacctccccctaaacgtcctagtactcgtaactggtcctgcttaccgtaagtttcggaacctaaagttccgggaaacttaccccgtagtacgaaactacttaccagttcgacccgtaaggtcggtaactcggtaggggaacctacggttacgttttaccaccgttcgtaacccgacctaacttaccgaaccgtacgttaccgtaccgaacccttaaccggtagtaaccgtttagttttacggtaaccttaaccgtttaccttacgttacgttaaccaagttaaaccgtacgttaaccgtacgttacccggttacggtaccttacgggtacgaacggacgtagggtaacgaccgacgtaaacgngtacgtcgtacgcgtacaccgtagttacctaggttacctntacccg

SEQ ID NO: 165523 - DNA, 603 bp, Homo sapiens
  misc_feature: GYAE6OF02FWL9Y.26.79.H02.1.454.CMB.1.raw
  modified_base (272)..(272): a, c, t, g, unknown or other
  misc_feature (272)..(272): n is a, c, g, or t
tcagagactatactcacgaccggtgctcgatttagtgtcacacgaagggaaagggggagtcagtctcagtcaggacacagcatggacatgagggtccccgctcagctcctggggctcctgctactctggctccgaggtgccagatgtgacgtcagatgatccagtctccgccctccctgtctgcatctgtaggagacagagtcaccatcacttgccgggcaagtcagagcattggcactatttaaatggtatcaacagaaaccagggaaacnccccctaactcctagatctatgctgcttacaatttgactaaagtgactccatcaagtattcagtgaccagtgatcgtaggacagtactttcactctcactatacaactgtctacgactaacctagaagtattttacgacttaacgtttacttactacgtactaaacgtagtaacgttacccgaaacggttcccggttagggtaaccgtttccggaacccgtaacgggtacccgtaaggggtacgggaaacgtacccgaaaacggtaaccgttacgggtacggtaccgtacggacctaccgtaacgttccgttacgttcccgttactacccg

SEQ ID NO: 165524 - DNA, 705 bp, Homo sapiens
  misc_feature: GYAE6OF02I58SL.26.79.H02.1.454.CMB.1.raw
tcagagactatactcacgaccggtgctcgatttagtgtcacacgaagggaaaggggggagtcagtctcagtcaggacacagcatggacatgagggtccccgctcagctcctggggctcctgctactctggctccgaggtgccagatgtgacgtccagatgatccagtcctcccgccctcctgtctgcatcgtagtaggagacagagtcaccatctacttcggccgggtacaagtcagagctagttcggactacttaatttaagtggtaatacaacaagaaaccgagggaaacctaccccctaactccgtagaatccgtagtcgtctacgtaccttactaattgaactaaggtacggtacctccaataactaaggtactacgtagtcgaccgtagtacggtagttacgtagggacctaaggtacttactaccctactaccgaacctactaacctaacgtacgtactcgtaaccgtaaccgtagtaattacgttacgtaaccgttaactttaaccgttacgttaactacctaaacgtaaccgttaacgttaacccgtaaaccggttcccggttaacggttacccgggttaacggtacccggaaacccgggtaaccggtaagggaccggtaaacgtaaccggaaacgtacgtacggtacggtacctacgggacctaacggtacttacgttacgttacgttccttaccg

SEQ ID NO: 165525 - DNA, 697 bp, Homo sapiens
  misc_feature: GYAE6OF01DK6MW.14.61.F06.1.454.CMB.1.raw
  modified_base (359)..(359): a, c, t, g, unknown or other
  misc_feature (359)..(359): n is a, c, g, or t
  modified_base (367)..(367): a, c, t, g, unknown or other
  misc_feature (367)..(367): n is a, c, g, or t
  modified_base (371)..(371): a, c, t, g, unknown or other
  misc_feature (371)..(371): n is a, c, g, or t
  modified_base (680)..(680): a, c, t, g, unknown or other
  misc_feature (680)..(680): n is a, c, g, or t
  modified_base (687)..(688): a, c, t, g, unknown or other
  misc_feature (687)..(688): n is a, c, g, or t
  modified_base (690)..(690): a, c, t, g, unknown or other
  misc_feature (690)..(690): n is a, c, g, or t
  modified_base (692)..(697): a, c, t, g, unknown or other
  misc_feature (692)..(697): n is a, c, g, or t
tcagcgtctagtaccacgaccggtgctcgatttagctacgctctaagggaaagggttgagaacctatgaacattctgtaggggccactgtcttctccacggtgctccctccgcgtccgggtctcctggacagtcagtcaccatctcctgcactggaaccagcagtgacgttggcacttatgactattatttcctggtaccaacaacacccaggcaaagcccccaaagtcgtgatttatgaggtccgtaagcggccctcgacggggtccctgatcgcttctctggttccaagtctggcaacacggcctaccctgaccgtctcgtgggctccaggctggaggatggaggctcaatattacngcgccttnatanagagaccaaataacctaatttcgtcgtttttcgggacggtaacgggaccaaaggtccgtacggtacccgttaccgttaacgggttccaacccggtacccgaaacgggtcccttaccgggcccccccctttacggggttaccctaacccgtttccccgttacccgggttttaccccccctaaaccccgttttcccccgttacccggttaacctttcccggtttacccgtttacccgggtcccgttacggtaaccgggtcccggggtaccggtaccgggaccgtaaacgggccgtaccgaacgttaacggntagctcnncncnnnnnn

SEQ ID NO: 165526 - DNA, 523 bp, Homo sapiens
  misc_feature: GYAE6OF01EZLYO.14.61.F06.1.454.CMB.1.raw
  modified_base (508)..(508): a, c, t, g, unknown or other
  misc_feature (508)..(508): n is a, c, g, or t
  modified_base (511)..(514): a, c, t, g, unknown or other
  misc_feature (511)..(514): n is a, c, g, or t
  modified_base (516)..(523): a, c, t, g, unknown or other
  misc_feature (516)..(523): n is a, c, g, or t
tcagcgtctagtaccacgaccggtgctcgatttagctacgctctaagggaaggggcttcagggacctctgggctgatccttggtctcctgctcctcaggctcaccggggcccaacactgactcactggcatgtgtttctccctctttccagggtcctgggcccagtctgccctgactcaacctgcctccatgtctgggtctcctggacagtcgatcaccatctcctgcactggatccagcagtgacattggtgattataagtgtgtctcctgataataccgacacccaggacaaacgtccccaaagtcatgatttcgtggggtcagttaatcggccctcgaggggtttctgccggcactctcagagagtgttcggcgacgagggaccaaggtcgaccgtcacgaggtcacgcccaaggcctcggcccccctcggtccactcgtcgttccccgccctccctcgtactagaccgcgtggacggcgggctcgggacgaacggcgcagtagngcnnnngnnnnnnnn

SEQ ID NO: 165527 - DNA, 681 bp, Homo sapiens
  misc_feature: GYAE6OF01AIKVW.14.61.F06.1.454.CMB.1.raw
  modified_base (667)..(667): a, c, t, g, unknown or other
  misc_feature (667)..(667): n is a, c, g, or t
  modified_base (670)..(681): a, c, t, g, unknown or other
  misc_feature (670)..(681): n is a, c, g, or t
tcagcgtctagtaccacgaccggtgctcgatttagctacgctctaagggaaagggttgagaacctatgaacattctgtaggggccactgtcttctccacggtgctccctccgcgtccgggtctcctggacagtcagtcaccatctcctgcactggaaccagcagtgacgttggcacttatgactatatttcctggtaccaacaacacccaggcaaaacgcccccaaagtcgtgatttatgaggtccgtaagccggccctgacggggtccctgatcgcttctctggttccaagtctggcaacacggcctccctgacccgtctcgtgggcctccgaggctggacggatggaggtctacaaatacttacgtgccgcccttcaattagtacgaaacgaccctaaattaaaccttaattttcggttccgtttttacggggaccggggtaacgggaccctaaacggccgttacggacccggttaccgtacggtaccgacggaccccgtaacgggcccgtccggcccccccgttcgggttacccacccgtttccgtccccgtttacccccctaccccgtttcccgttaccggttaacccgttaaccggtacccgtccgttacgggaccgggtccggggaccgttcgggaaccgtacggggcgtaccgagtacgncgnnnnnnnnnnnn

SEQ ID NO: 165528 - DNA, 543 bp, Homo sapiens
  misc_feature: GYAE6OF01AEM19.14.61.F06.1.454.CMB.1.raw
  modified_base (336)..(336): a, c, t, g, unknown or other
  misc_feature (336)..(336): n is a, c, g, or t
  modified_base (531)..(532): a, c, t, g, unknown or other
  misc_feature (531)..(532): n is a, c, g, or t
  modified_base (534)..(543): a, c, t, g, unknown or other
  misc_feature (534)..(543): n is a, c, g, or t
tcagcgtctagtaccacgaccggtgctcgatttagctacgctctaagggaaagggttgagaacctatgaacattctgtaggggccactgtcttctccacggtgctccctccgcgtccgggtctcctggacagtcagtcaccatctcctgcactggaaccagcagtgacgttggcacttatgactatatttcctggtaccaacaacacccaggcaaagcccccaaagtcgtgatttatgaggtccgtaagcggccctcgaggggtccctgatcgcttctctggttccaagtctggcaacacggcctccctgaccgtctctgggctccaggctgaggntgaggctcaatattactgcgcctcatatgaagccaataactaatttgcttttcggcggagggaccaagcgtcgaccgtccgtaggtcacgcccgacggcctcgccccccgttcggtccaccgttctcccgttcccgccccttccctccgttactacggaccgcgtcgacggcgggcgtggcgaggccgcagtagnngnnnnnnnnnn

SEQ ID NO: 165529 - DNA, 556 bp, Homo sapiens
  misc_feature: GYAE6OF01DT6KQ.14.61.F06.1.454.CMB.1.raw
  modified_base (369)..(369): a, c, t, g, unknown or other
  misc_feature (369)..(369): n is a, c, g, or t
  modified_base (544)..(556): a, c, t, g, unknown or other
  misc_feature (544)..(556): n is a, c, g, or t
tcagcgtctagtaccacgaccggtgctcgatttagctacgctctaagggaaagggttgagaacctatgaacattctgtaggggccactgtcttctccacggtgctccctccgcgtccgggtctcctggacagtcagtcaccatctcctgcactggaaccagcagtgacgttggcacttatgactatatttcctggtaccaacaacacccaggcaaacgcccccaaagtcgtgatttatgaggtccgtaagcggccctcgaggggtccctgatcgctttctctggttccaagtctggcaacacggcctcctgaccgttctctgggctccgaggctggaggatggaggctacaattactactcgccgcctnatatgaagacctaaataactaatttcgtcgtttcggacggtaggaccagctcgaccgtcgtaggtcacgccaacggcctccgcccccgtcggtcctacgtcctccgttccccgccccttccgtcgtacgtacgaccgtcgtgacggcggtcgtcggacgacggccgacgatagcnnnnnnnnnnnnn

SEQ ID NO: 165530 - DNA, 532 bp, Homo sapiens
  misc_feature: GYAE6OF01BJ87A.14.61.F06.1.454.CMB.1.raw
  modified_base (337)..(337): a, c, t, g, unknown or other
  misc_feature (337)..(337): n is a, c, g, or t
  modified_base (513)..(513): a, c, t, g, unknown or other
  misc_feature (513)..(513): n is a, c, g, or t
  modified_base (520)..(532): a, c, t, g, unknown or other
  misc_feature (520)..(532): n is a, c, g, or t
tcagcgtctagtaccacgaccggtgctcgatttagctacgctctaagggaaagggttgagaacctatgaacattctgtaggggccactgtcttctccacggtgctccctccgcgtccgggtctcctggacagtcagtcaccatctcctgcactggaaccagcagtgacgttggcacttatgactatatttcctggtaccaacaacacccaggcaaagcccccaaagtcgtgatttatgaggtccgtaagcggccctcaggggtccctgatcgcttctctggttccaagtctggcaacacggcctccctgaccgtctcgtgggctccgaggctgaggntgaggctcaatattactgcgacctcatatagaagaccaaataactaatttgtcgttttcggcggaggaccaagctcgaccgtcgtaggtcacgccaacggctccgcccctcggtcactctcgttccccgccctcctcgtactacgcgcgtgacggcgggactcggacgaacggcgnagtagcnnnnnnnnnnnnn

SEQ ID NO: 165531 - DNA, 622 bp, Homo sapiens
  misc_feature: GYAE6OF01B3HCJ.14.61.F06.1.454.CMB.1.raw
  modified_base (606)..(606): a, c, t, g, unknown or other
  misc_feature (606)..(606): n is a, c, g, or t
  modified_base (610)..(610): a, c, t, g, unknown or other
  misc_feature (610)..(610): n is a, c, g, or t
  modified_base (615)..(615): a, c, t, g, unknown or other
  misc_feature (615)..(615): n is a, c, g, or t
  modified_base (617)..(622): a, c, t, g, unknown or other
  misc_feature (617)..(622): n is a, c, g, or t
tcagcgtctagtaccacgaccggtgctcgatttagctacgctctaagggaaagggttgagaacctatgaacattctgtaggggccactgtcttctccacggtgctccctccgcgtccgggtctcctggacagtcagtcaccatctcctgcactggaaccagcagtgacgttggcacttatgactatatttcctggtaccaacaacacccaggcaaagcccccaaagtcgtgatttatgaggtccgtaagcggccctcgacggggtccctgactcgcttctctggttccaagtctgcaacacggcctcctgccgtctctgggctccaggctggagagtgaggctactaatattactgccgctcaatagtagaacacctaaataactaatttcgtccgttttacggcggtaacgggaccaacgcgtacggacccgttcctacggtactacgaacccgtaacgggcccgtcccgcccccgttccggttacctaccgttcccgttacccgttcccctaccccgtttcccgtaccgttaccgtaaccggtaccgcgttcgggacggtcggggaccgtcggaccgtaacgggccgacgtaagtacgtgacgntcgntagcncnnnnnn

SEQ ID NO: 165532 - DNA, 685 bp, Homo sapiens
  misc_feature: GYAE6OF01DBS9S.14.61.F06.1.454.CMB.1.raw
  modified_base (672)..(672): a, c, t, g, unknown or other
  misc_feature (672)..(672): n is a, c, g, or t
  modified_base (674)..(685): a, c, t, g, unknown or other
  misc_feature (674)..(685): n is a, c, g, or t
tcagcgtctagtaccacgaccggtgctcgatttagctacgctctaagggaaagggttgagaacctatgaacattctgtaggggccactgtcttctccacggtgctccctccgcgtccgggtctcctggacagtcagtcaccatctcctgcactggaaccagcagtgacgttggcacttatgactatattttcctggtaaccaacaaccacccaggacaaaacggcccccaaagtcgtagattttatgaggtccgtaagccggccctcgacggggtccctggactcgcttctcgtcggttccaagtcgtggacaacgaccggcctcctgacccgtctcgtcgggctccgaggctaggacggatggaggtcctaacaattaacttacctgaccgtcctactaagttataacggaacgaaccctaaattaaacctaagttttcgttacggttttccggggacgggtaacgggaacccgtaaggtaccgttaccggtaacccggttaccgttacgggtacccgaacggtacccgtaacgggtcccgtcccgtaccccccgtcggtaccctaccgttcccgttccccgtttacccccaccccgtttcccttacgtaccttccttaccgtcgaccgttcggacggtcgggtcgtacggtacgaacggcgtacagtagngnnnnnnnnnnnn

SEQ ID NO: 165533 - DNA, 757 bp, Homo sapiens
  misc_feature: GYAE6OF01CV9MS.14.61.F06.1.454.CMB.1.raw
  modified_base (147)..(147): a, c, t, g, unknown or other
  misc_feature (147)..(147): n is a, c, g, or t
  modified_base (316)..(316): a, c, t, g, unknown or other
  misc_feature (316)..(316): n is a, c, g, or t
  modified_base (334)..(334): a, c, t, g, unknown or other
  misc_feature (334)..(334): n is a, c, g, or t
  modified_base (732)..(732): a, c, t, g, unknown or other
  misc_feature (732)..(732): n is a, c, g, or t
  modified_base (738)..(738): a, c, t, g, unknown or other
  misc_feature (738)..(738): n is a, c, g, or t
  modified_base (743)..(743): a, c, t, g, unknown or other
  misc_feature (743)..(743): n is a, c, g, or t
  modified_base (745)..(745): a, c, t, g, unknown or other
  misc_feature (745)..(745): n is a, c, g, or t
  modified_base (748)..(748): a, c, t, g, unknown or other
  misc_feature (748)..(748): n is a, c, g, or t
  modified_base (751)..(751): a, c, t, g, unknown or other
  misc_feature (751)..(751): n is a, c, g, or t
  modified_base (753)..(753): a, c, t, g, unknown or other
  misc_feature (753)..(753): n is a, c, g, or t
  modified_base (755)..(755): a, c, t, g, unknown or other
  misc_feature (755)..(755): n is a, c, g, or t
  modified_base (757)..(757): a, c, t, g, unknown or other
  misc_feature (757)..(757): n is a, c, g, or t
tcagcgtctagtaccacgaccggtgctcgatttagctacgctctaagggaaagggttgagaacctatgaacattctgtaggggccactgtcttctccacggtgcctccctccgcgtccgggtctctggacagtcagtcacatctccngcactggaaccagcagtgacgttggctacttatgacttatactttcctaggtaccaacaacacccaggacaaacgccccgaaagtcgtgatttacgtgacggtccgtaagccggccctacgcggggtcctagctcgctttctctggtccatcgtggcaacgcgcctccncggtcctctcgtcggtcnccgtaggcgtggacggtagtcgacggtcttacgtaacttacttaccgtgccggtcctagtaacgttaagtacggtaaacgtaaacctaaacttaaaacgtttaacgtttcgggttttaccggttttaccggggaacgggtaaccggggtaacctaggttccgtaacggttaccccggtccggtttaacgggaccgtaaacccgtcccggaacgggccctttacccccgggcccccgtttaccgggtaccctaccccggttccggtttccccgtttacccccggtcccccgttacctttaccgggtacctttcccggttacccgttccgggtctttacggggaccgggtcccgggtcggtaccggtaccgggtaaccgggaccgtcgtaaagtccggtntacggngacgntntcncgnangngn

SEQ ID NO: 165534 - DNA, 766 bp, Homo sapiens
  misc_feature: GYAE6OF01DMME5.14.61.F06.1.454.CMB.1.raw
  modified_base (750)..(750): a, c, t, g, unknown or other
  misc_feature (750)..(750): n is a, c, g, or t
  modified_base (756)..(766): a, c, t, g, unknown or other
  misc_feature (756)..(766): n is a, c, g, or t
tcagcgtctagtaccacgaccggtgctcgatttagctacgctctaagggaaagggttgagaacctatgaacattctgtaggggccactgtcttctccacggtgctccctccgcgtccgggtctcctggacagtcagtcaccatcctcctgcactggaaccagcagtgacgttggctacttatgactatatttcctggtaccaaacacacccaggacaaacgacccccaaagtcgtagtatttatgacggtccgtaaggccgccctcgacggggtccctaggtactcgctttctcgttcggttaccaagtccgtaggaccaaccgaccggtccccttcccgtacgtaccccggttctccggtcggggtcctaccggaggtctagggaggtacgtggacgtactaacaacgttaacttccgtcgccgtaccttacaagtttaacgacggtaaaaccgtaacctaaaacgtttaaaccgttaacgttttcggtttaaccggtttttcggggaacggggtaaacggaaccgtaacggtccgttaccgtacccggtaccgttacggtaccgaacggtacccgaacgggttcctacccccggtccccgttacgggttaccctacccgttacccgtttaccccgttacccccttaaccccgttcccgtttaaccggtaaccgtaaccggtacccggtaaccgttcgggaccggggtaccggtaccgtaggaccgggtaaaccgcggttacaggtagnaggtcnnnnnnnnnnn

SEQ ID NO: 165535 - DNA, 505 bp, Homo sapiens
  misc_feature: GYAE6OF02GXZ0M.14.61.F06.1.454.CMB.1.raw
  modified_base (496)..(505): a, c, t, g, unknown or other
  misc_feature (496)..(505): n is a, c, g, or t
tcagcgtctagtaccacgaccggtgctcgatttagctacgctctaagggaaagggttgagaacctatgaacattctgtaggggccactgtcttctccacggtgctccctccgcgtccgggtctcctggacagtcagtcaccatctcctgcactggaaccagcagtgacgttggcacttatgactatatttcctggtaccaacaacacccaggcaaagcccccaaagtcgtgatttatgaggtccgtaagcggccctcaggggtatctaatcgcttctctggctccaagtctggcaacacggcctccctgaccgtctctggcctccagactgaggacgaggctgattattactgccactcatatagaagtagtactactctgtgtttcggcggagggacagctgaccgtctaggtcagcccaaggctcgcccctcggtcactctcgttcccacctcctcgtactacgacgctgacgcgggctggcaaggcgcatagnnnnnnnnnn

SEQ ID NO: 165536 - DNA, 502 bp, Homo sapiens
  misc_feature: GYAE6OF02INSM9.14.61.F06.1.454.CMB.1.raw
  modified_base (493)..(502): a, c, t, g, unknown or other
  misc_feature (493)..(502): n is a, c, g, or t
tcagcgtctagtaccacgaccggtgctcgatttagctacgctctaagggaaagggttgagaacctatgaacattctgtaggggccactgtcttctccacggtgctccctccgcgtccgggtctcctggacagtcagtcaccatctcctgcactggaaccagcagtgacgttggcacttatgactatatttcctggtaccaacaacacccaggcaaagcccccaaagtcgtgatttatgaggtccgtaagcggccctcaggggtccctgatcgcttctctggttccaagtctggcaacacggctccctgaccgtctctgggctccaggctgaggatgaggctcaatattactgcgcctcatatgaagccaataacaatttgcttttcggcggagggccaagctgaccgtcctaggtcagcccaaggctgcccctcggtcactctgttcccaccctcctcgtactagacgctgagcgggctggcaggcgcatagnnnnnnnnnn

SEQ ID NO: 165537 - DNA, 505 bp, Homo sapiens
  misc_feature: GYAE6OF02ICFRN.14.61.F06.1.454.CMB.1.raw
  modified_base (259)..(259): a, c, t, g, unknown or other
  misc_feature (259)..(259): n is a, c, g, or t
  modified_base (488)..(488): a, c, t, g, unknown or other
  misc_feature (488)..(488): n is a, c, g, or t
  modified_base (495)..(505): a, c, t, g, unknown or other
  misc_feature (495)..(505): n is a, c, g, or t
tcagcgtctagtaccacgaccggtgctcgatttagctacgctctaagggaaagggttgagaacctatgaacattctgtaggggccactgtcttctccacggtgctccctccgcgtccgggtctcctggacagtcagtcaccatctcctgcactggaaccagcagtgacgttggcacttatgactatatttcctggtaccaacaacacccaggcaaaagcccccaaaagtcgtgatttatgaggtccgtaagcggccctnaggggtccctgatcgcttctctggttccaagtctggcaacacggcctccctgaccgtctctgggctccaggctgaggatgaggctcaatattactgcgcctcatatgaagcaataacaatttgcttttcggcggtagggaccaagctgaccgtcctaggtcagccaaggctgcccctcggtcactctgttcccaccctcctcgtactctctcgctgagcggctgcagcncagtcgnnnnnnnnnnn

SEQ ID NO: 165538 - DNA, 511 bp, Homo sapiens
  misc_feature: GYAE6OF02FUN2J.14.61.F06.1.454.CMB.1.raw
  modified_base (499)..(511): a, c, t, g, unknown or other
  misc_feature (499)..(511): n is a, c, g, or t
tcagcgtctagtaccacgaccggtgctcgatttagctacgctctaagggaaagggttgagaacctatgaacattctgtaggggccactgtcttctccacggtgctccctccgcgtccgggtctcctggacagtcagtcaccatctcctgcactggaaccagcagtgacgttggcacttatgactatatttcctggtaccaacaacacccaggcaaagcccccaaagtcgtgatttatgaggtccgtaagcggccctcaggggtccctgatcgcttctctggttccaagtctggcaacacggcctccctgaccgtctctgggctccaggctgaggatgaggctcaatattactgcgcctcatatgaagccaataacaatttgcttttcggcggagggaccaagctgaccgtcctaggtcagcccaaggctcgcccctcggtcactctcgttcccgccctcctcgtacctagaccgctgagcgggctggcaaggcgcatgnnnnnnnnnnnnn

SEQ ID NO: 165539 - DNA, 625 bp, Homo sapiens
  misc_feature: GYAE6OF02H033D.14.61.F06.1.454.CMB.1.raw
  modified_base (613)..(613): a, c, t, g, unknown or other
  misc_feature (613)..(613): n is a, c, g, or t
  modified_base (615)..(625): a, c, t, g, unknown or other
  misc_feature (615)..(625): n is a, c, g, or t
tcagcgtctagtaccacgaccggtgctcgatttagctacgctctaagggaaagggttgagaacctatgaacattctgtaggggccactgtcttctccacggtgctccctccgcgtccgggtctcctggacagtcagtcaccatctcctgcactggaaccagcagtgacgttggcacttatgactatatttcctggtaccaacaacacccaggcaaagcccccaaagtcgtgatttatgaggtccgtaagcggccctcgaggggtccctgactcgcttctctggttccaagtctggcaacacggcctcctgaccgtctctggctcccaggctgaggatgaggctcaactatactgcgcctcatatagaagtacccaaaataaacctattttacgtacgtttttcgggacggtaacgggggaacccaaggtacctacggtacccgggttcccgttaacgggttacgaacggaccccgaaacgggtccgtacgtccccccctacgggttcccgtaaccttcgttcgtttccccggtccctcccgttccgtacgttcccttcccgtcgtcgtcggtacgccggggcttcggggccgaacggcgggactacgaagcgngnnnnnnnnnnn

SEQ ID NO: 165540 - DNA, 653 bp, Homo sapiens
  misc_feature: GYAE6OF02IHWHU.14.61.F06.1.454.CMB.1.raw
  modified_base (243)..(243): a, c, t, g, unknown or other
  misc_feature (243)..(243): n is a, c, g, or t
  modified_base (306)..(306): a, c, t, g, unknown or other
  misc_feature (306)..(306): n is a, c, g, or t
  modified_base (343)..(343): a, c, t, g, unknown or other
  misc_feature (343)..(343): n is a, c, g, or t
  modified_base (348)..(348): a, c, t, g, unknown or other
  misc_feature (348)..(348): n is a, c, g, or t
  modified_base (642)..(645): a, c, t, g, unknown or other
  misc_feature (642)..(645): n is a, c, g, or t
  modified_base (647)..(652): a, c, t, g, unknown or other
  misc_feature (647)..(652): n is a, c, g, or t
tcagcgtctagtaccacgaccggtgctcgatttagctacgctctaagggaaagggttgagaacctatgaacattctgtaggggccactgtcttctccacggtgctccctccgcgtccgggtctcctggacagtcagtcaccatctcctgcactggaaccagcagtgacgttggcacttatgactattatttcctggtaccaacaacacccaggacaaacgacccccaaagtcgtgtattttanggacggtccgtaagccggccctgacggggtccctgatcgtcttctctgttccagtctgacacncgcctcctgcctctcgtggcctaccgaggctaggagntacgngctactaattacttacgtcgcgtcctatatagtagaacgactaaaataacttaagtttcgttacgttttacgggaccggaacgggtaccctaagtccgtacgtacccggttaccgttacggtaccgaaccggtacccgaacggtcccgttacccggtcccccgttaccggtaccctacccgttccgttaccccgtttccccctccccgtacccgttaccgttaccgttccgttccgtccgtaccggtacggacggtccgggtcgtccggtacggacggcgacgtagtagctgcnnnncnnnnnnc

SEQ ID NO: 165541 - DNA, 597 bp, Homo sapiens
  misc_feature: GYAE6OF02F63IE.14.61.F06.1.454.CMB.1.raw
  modified_base (282)..(282): a, c, t, g, unknown or other
  misc_feature (282)..(282): n is a, c, g, or t
  modified_base (301)..(301): a, c, t, g, unknown or other
  misc_feature (301)..(301): n is a, c, g, or t
  modified_base (335)..(335): a, c, t, g, unknown or other
  misc_feature (335)..(335): n is a, c, g, or t
  modified_base (347)..(347): a, c, t, g, unknown or other
  misc_feature (347)..(347): n is a, c, g, or t
  modified_base (359)..(359): a, c, t, g, unknown or other
  misc_feature (359)..(359): n is a, c, g, or t
  modified_base (369)..(369): a, c, t, g, unknown or other
  misc_feature (369)..(369): n is a, c, g, or t
  modified_base (566)..(566): a, c, t, g, unknown or other
  misc_feature (566)..(566): n is a, c, g, or t
  modified_base (586)..(586): a, c, t, g, unknown or other
  misc_feature (586)..(586): n is a, c, g, or t
  modified_base (590)..(590): a, c, t, g, unknown or other
  misc_feature (590)..(590): n is a, c, g, or t
  modified_base (592)..(597): a, c, t, g, unknown or other
  misc_feature (592)..(597): n is a, c, g, or t
tcagcgtctagtaccacgaccggtgctcgatttagctacgctctaagggaaagggttgagaacctatgaacattctgtaggggccactgtcttctccacggtgctccctccgcgtccgggtctcctggacagtcagtcaccatctcctgcactggaaccagcagtgacgttggcacttatgactatattttcctgtaccaacaacacccaggacaaacgcccccaaagtcgtgaatttatggaggtccgtaagcggccctcgaggggtccctgatcgcttcnctggtccaagtctggcaanacgcctcctcgaccgttctcgtcggctcgagtcngagatgagctanatattactgccncctcagttanacgtaacgctaaaactaaagtattttcggtcttttacggggacggacggtaacacgtacgtacgaccgttccgtaggtaccgacgtacccgaacggtcctcccggtcccccgttggtaccctaccttcgttcccgtttaccccgccctttcctaccgttacgtacgaccgtcgtacgacgcgggtctggacgacggngaccgataggcatcgatcgntacncnnnnnn

SEQ ID NO: 165542 - DNA, 784 bp, Homo sapiens
  misc_feature: GYAE6OF02JDCTV.14.61.F06.1.454.CMB.1.raw
tcagcgtctagtaccacgaccggtgctcgatttagctacgctctaagggaaagggttgagaacctatgaacattctgtaggggccactgtcttctccacggtgctccctccgcgtccgggtctcctggacagtcagtcaccatctcctgcactggaaccagcagtgacgttggcacttatgactatatttcctggtaccaacaacacccaggcaaacgcccccaaagtccgtgatttatcgaggtccgtaagtcggaccctcgacggggtccctggatcgcttctctcggttccaagtctggcaacgcgcctcctcgacctctcgtcggcttccaggtcctgaggactggacggcttacgaattactttacgtgaccggtcctaccgttaattacgtacggtaaaccggaccctaaaagttaaaaccgttaacgttttcggtacccggtttttccggggaccgggtaacggggtaccctaaacggtccgttacggtaaccccgggttaccgttaacgggttcccgtaacggtacccgtaacggggtaccccttacccggaccccccgttaccgggttacctaacctttcccgttcccggtttaccccctacccgttaccccgtttacggttaacccgttaaccggtaccggtaccgtttacgggacccgggttacccggggtccgtttacggggaacccgtaaccggggttacccggtacgtaaaccggttcggaacccgttgaccgttaccggagttcgactcggaacgcgtagtaccgcacg

SEQ ID NO: 165543 - DNA, 754 bp, Homo sapiens
  misc_feature: GYAE6OF02IM54U.14.61.F06.1.454.CMB.1.raw
  modified_base (279)..(279): a, c, t, g, unknown or other
  misc_feature (279)..(279): n is a, c, g, or t
  modified_base (741)..(741): a, c, t, g, unknown or other
  misc_feature (741)..(741): n is a, c, g, or t
  modified_base (746)..(747): a, c, t, g, unknown or other
  misc_feature (746)..(747): n is a, c, g, or t
  modified_base (749)..(754): a, c, t, g, unknown or other
  misc_feature (749)..(754): n is a, c, g, or t
tcagcgtctagtaccacgaccggtgctcgatttagctacgctctaagggaaagggttgagaacctatgaacattctgtaggggccactgtcttctccacggtgctccctccgcgtccgggtctcctggacagtcagtcaccatctcctgcactggaaccagcagtgacgttggcacttatgactatatttcctggtaccaacaacacccaggcaaagcccccaaagtcgtgatttatgaggtccgtaagcggccctcgaggggtccctgactcgcttcnctggttccaagtctggcaacacggcctccctgaccgtctctgggctccaggctgaggatgaggctacgtaatactttacgcgcgtcccgtcaattactacggaacgtaccctaaaacgttaaacctaaagtttttagtaacgtttttttaccgggggcggggtaaacgggggtaacccgtaaacgggtccgttaccggggtaacccccggtttacccggtttaaacggggttaccccggtaaacgggtaaccccccggtaaaacgggggttccccgttacccgggtacccccccccggtttacggggttaccccgtaccctttacccggtttcccggttttaccccccgtacccccgttaccccgtttaccggttaacccttaacggtacccgtcccgttacgggacggaccggggtcccgttacgggaccgaacgggtccgacgtaaggttacgcagtcgntcgcnngnnnnnn

SEQ ID NO: 165544 - DNA, 539 bp, Homo sapiens
  misc_feature: GYAE6OF01C4I69.17.29.C07.1.454.CMB.1.raw
  modified_base (273)..(273): a, c, t, g, unknown or other
  misc_feature (273)..(273): n is a, c, g, or t
  modified_base (444)..(444): a, c, t, g, unknown or other
  misc_feature (444)..(444): n is a, c, g, or t
tcagcgtagactagcacgaccggtgctcgatttagagtgctacgaagggaaagggggctggggtctcggggggaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttgtagttatattatgtctctgtaccanagtaccaggacaaacgccccaaactcatgtatttatgagtcaagtaatcggcctgtagggtttctaagtcgtcttctcgtggtctcctaagtcgtggacctaacgaccggtccctcccgtacgacctacttcctcgtcgggcctccgaggtctggaggtacggtagggtanatttatacgtgactagctacagtagtagaagtgacagctacgtctacgtagtcggcggtaggacagctcgaccgtcgtagcacgcccgaggtccc

SEQ ID NO: 165545 - DNA, 504 bp, Homo sapiens
  misc_feature: GYAE6OF01ETGWK.17.29.C07.1.454.CMB.1.raw
  modified_base (364)..(364): a, c, t, g, unknown or other
  misc_feature (364)..(364): n is a, c, g, or t
  modified_base (429)..(429): a, c, t, g, unknown or other
  misc_feature (429)..(429): n is a, c, g, or t
tcagcgtagactagcacgaccggtgctcgatttagagtgctacgaagggaaagggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgagtcagtaatcggcctcaggggtttctaatcgcttctctgctcaagtctggcaacncgcctcctgacctatctctgggctccgaggtctgaggacgagggtgatttattacgtgcagctanatatagaagtgcagcactctcgtagttcggcggtggaccagctcgaccgtctacggtacacggcccaaggtcccg

SEQ ID NO: 165546 - DNA, 564 bp, Homo sapiens
  misc_feature: GYAE6OF01BAF7F.17.29.C07.1.454.CMB.1.raw
  modified_base (441)..(441): a, c, t, g, unknown or other
  misc_feature (441)..(441): n is a, c, g, or t
tcagcgtagactagcacgaccggtgctcgatttagagtgctacgaagggaaagggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaacgcccccaaactcatgatttatgagtcagtaatccggccctcgtaggggtttactaagtcgtcttctcgtggctccaagtctggcaacgaccggtccctcccgtcgaccctattcctcgtgggccctccgaggctaggacgggacggtaggggtntaagtttacgttactgacagtctactatagtaggaagtggacagctctcgtcgtagttccgggtcgggtgggaaccgtagccgtacggtacccgtcgtacggtaccacgtcccgaaggtcccg

SEQ ID NO: 165547 - DNA, 561 bp, Homo sapiens
  misc_feature: GYAE6OF01DN15P.17.29.C07.1.454.CMB.1.raw
  modified_base (364)..(364): a, c, t, g, unknown or other
  misc_feature (364)..(364): n is a, c, g, or t
  modified_base (380)..(380): a, c, t, g, unknown or other
  misc_feature (380)..(380): n is a, c, g, or t
  modified_base (429)..(429): a, c, t, g, unknown or other
  misc_feature (429)..(429): n is a, c, g, or t
  modified_base (534)..(534): a, c, t, g, unknown or other
  misc_feature (534)..(534): n is a, c, g, or t
tcagcgtagactagcacgaccggtgctcgatttagagtgctacgaagggaaagggggctggggtctcaggaggcagcgctctcaggacatctccaccatggcctgggctctgctgctcctcaccctctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacacgtaccaggacaaacgcccccaaaactcatgaatttatgaggtcagtaactcggcctgtagggtttcaagtcgtcttctctggctcaagtcnggacacacggcctccngaccatctcgtggctccgagtctagaggacgaggtgtattatactgacngtctatagtataggaagttgcagccacttcgtacgtagtttcggggacggttacgggaacctaacgggtccctaggttaccccgggttaccgtacgggttaaccncccgggtaaccccgaaggggttccccc

SEQ ID NO: 165548 - DNA, 657 bp, Homo sapiens
  misc_feature: GYAE6OF01DK2A5.17.29.C07.1.454.CMB.1.raw
  modified_base (153)..(153): a, c, t, g, unknown or other
  misc_feature (153)..(153): n is a, c, g, or t
  modified_base (168)..(168): a, c, t, g, unknown or other
  misc_feature (168)..(168): n is a, c, g, or t
  modified_base (220)..(220): a, c, t, g, unknown or other
  misc_feature (220)..(220): n is a, c, g, or t
  modified_base (272)..(272): a, c, t, g, unknown or other
  misc_feature (272)..(272): n is a, c, g, or t
  modified_base (483)..(483): a, c, t, g, unknown or other
  misc_feature (483)..(483): n is a, c, g, or t
  modified_base (521)..(521): a, c, t, g, unknown or other
  misc_feature (521)..(521): n is a, c, g, or t
  modified_base (548)..(548): a, c, t, g, unknown or other
  misc_feature (548)..(548): n is a, c, g, or t
  modified_base (585)..(585): a, c, t, g, unknown or other
  misc_feature (585)..(585): n is a, c, g, or t
tcagcgtagactagcacgaccggtgctcgatttagagtgctacgaagggaaaggggctggggtctcaggaggcagcgctctcaggacatctccaccatggcctgggctctgctgctcctcaccctctcactcagggcacaggtcctgggcccngtctcgccctgactnagcctgcctccgtgtctcgggtctccgtggactagtcgatcatcattcttcngctacgtggactccagacctaggtacgtacggtttaggtaatttattaattntcgttcctaccgtaggtaacccaagtaccgtaacccgacggaaccaaacccgtaccccctaaagtctagtacgttaatttaggagtacgtactaagtaccgtccggtaccgtaggtacggtttacacttccgtcttctcgtgtcctacgagttcgacgacctaacgaccgtccctacgtacgacctacgtctcggtacggtccctaacggngttacgaggaggtaacgggtgtatattacgttgcgtanacgtctataagtacggtaagccggttnaacgacctagtaccgttgttacggtacggtaccgggnggtacccgaacgtccggtccgtaccgtaccccgtttaggaacccggactacccgtaacccgtggtcccccgg

SEQ ID NO: 165549 - DNA, 493 bp, Homo sapiens
  misc_feature: GYAE6OF01A3U61.17.29.C07.1.454.CMB.1.raw
  modified_base (404)..(404): a, c, t, g, unknown or other
  misc_feature (404)..(404): n is a, c, g, or t
  modified_base (413)..(413): a, c, t, g, unknown or other
  misc_feature (413)..(413): n is a, c, g, or t
tcagcgtagactagcacgaccggtgctcgatttagagtgctacgaagggaaagggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtaccaggcaaacgccccaaactcatgatttatgagtcagtaatcgccctcaggggttactaatcgcttctctggctcaagtctgcaacacggcctccctgaccatctctggctccaggctgagacgaggngatattacngcagctacatatagaagtggacagcactctcgtattcgggcggtagggaccagctgaccgtctaggccagccaaggcccg

SEQ ID NO: 165550 - DNA, 666 bp, Homo sapiens
  misc_feature: GYAE6OF01BDYMG.17.29.C07.1.454.CMB.1.raw
  modified_base (307)..(307): a, c, t, g, unknown or other
  misc_feature (307)..(307): n is a, c, g, or t
tcagcgtagactagcacgaccggtgctcgatttagagtgctacgaagggaaagggggctggggtctcaggaggcagcgctctcaggacatctccaccatggcctgggctctgctgctcctcaccctcctcactcagggcacagggtcctgggcccagtctgccctgactcagcctgcctccgtgtctgggtcctcctggacagtcgatcatcatcttctgcactggatccagcagtgacgttggtattataattatgtctctaggtaccaacgacgtaccacggaccaaacgacccccaaactcatntatttatgtagtactagtaactccggtcccttcgtacggggttactaactcgtcttcgtcgtgtcctctaacgtcgtacggacctaaccgaccgtccctacccgtacgacctactccgttcggtcggtccctaccggaggtacgtaggaacgggtaccgggtagggttacggttaatttaaccgtttacgtcggaccgtacgtacctacgtaaagtaacgttaaggtaacggtcggtaccgaacggtcccttaaccggttccggtttacccggtaacgggtttccggggacgggttacgggaaccctacggtccgtacggtaccccgttacgtacggtaccgacgtcccgacgtcccgg

SEQ ID NO: 165551 - DNA, 500 bp, Homo sapiens
  misc_feature: GYAE6OF01A7K14.17.29.C07.1.454.CMB.1.raw
  modified_base (307)..(307): a, c, t, g, unknown or other
  misc_feature (307)..(307): n is a, c, g, or t
  modified_base (420)..(420): a, c, t, g, unknown or other
  misc_feature (420)..(420): n is a, c, g, or t
  modified_base (465)..(465): a, c, t, g, unknown or other
  misc_feature (465)..(465): n is a, c, g, or t
tcagcgtagactagcacgaccggtgctcgatttagagtgctacgaagggaaagggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtaccaggcaaacgcccccaaactcatgatttangaggtcagtaatcggccctctaggggtttctaatcgcttctctggctaccaagtctggacaacgacggccctccctgaccatctctgggctccgaggctggaggacgagggtnattatactgcagctacatatagaagtgcagcatctcgtagtcggnggtggaccagctgacctcgtagcagccgagtcccg

SEQ ID NO: 165552 - DNA, 600 bp, Homo sapiens
  misc_feature: GYAE6OF01D4PWC.17.29.C07.1.454.CMB.1.raw
  modified_base (434)..(434): a, c, t, g, unknown or other
  misc_feature (434)..(434): n is a, c, g, or t
tcagcgtagactagcacgaccggtgctcgatttagagtgctacgaagggaaagggggctggggtctcaggaggcagcgctctcaggacatctccaccatggcctgggctctgctgctcctcaccctcctcactcagggcacgagggtcctgggcccagtctgccctgactcagcctgcctccgtgtcgtggtcctccgtggacagtcgatcatcatcttctgctactggactccagctagtgtacggttggttaagttataattatgtctcctagtaccaacgacgtacccaggaccaaccgaccccaaactcaatgtatttagagagtacagtacgtcggccgtagtagggtttcaatcgtcttcgtcgtcgtcctactaacgtcgtggaccaaccgaccgtccctacctcgacctactctcgtcggcctcgngacgtggacggacggtagggtataattacgttcagctacgtctactagtaagtagaagtcgacgacgtacctacgtcgttacgttacgggtccgggtacgggttagggaacctaggtccgtacggtacccggttccgtaacggtccaccggtaccgacggtccccg

SEQ ID NO: 165553 - DNA, 774 bp, Homo sapiens
  misc_feature: GYAE6OF01D7Z9D.17.29.C07.1.454.CMB.1.raw
tcagcgtagactagcacgaccggtgctcgatttagagtgctacgaagggaaagggggctgggggtctcaggaggcagcgctctcaggacatctccaccatggcctgggctctgctgctcctcaccctctcactcgagggcacgagggtcctgggccctagtctcgccctgactcgacgcctcgcctcgtgtcgtgggtctcgtgactagtcgatcatctattcttctcgctacgtcggactccgagtacgtaggttcggtaggtttaggttaatttaagttaaatttgtcgttccttaccgtacggtaaccaaacgtccgtaaccgaacggaaccaaaccgacccccctaaagtacctagttagtaattttagacggtagtacgtaacggttaccgtcccggtccgtttagggttacggtttactacgttcgttacttcgtcgtcggaccttacgacgtcgacgaaccgtaccgtacccggtccctaccgtacgtcctacgtccgttcgggtaccgtaccgaccggacgggtcgtaacggggacgggtaacggtttagggtaattttaacgttagttaccgacggtaacgaccgtttacgtaacgttaaggttaagtacgggtaacggtcgaacgtaaccgtccttaccgttacggttacggttaaccgggtcgggtacccggggtaagtaacccggacggttccggtaacccggttacccggtaccgttaaccgggacccggttaacccgtccgggtaacccggtccccccgg

SEQ ID NO: 165554 - DNA, 656 bp, Homo sapiens
  misc_feature: GYAE6OF01AKILV.17.29.C07.1.454.CMB.1.raw
tcagcgtagactagcacgaccggtgctcgatttagagtgctacgaagggaaagggggctgggggtctcaggaggcagcgctctcaggacatctccaccatggcctgggctctgctgctcctcaccctctcactcagggcacagggtcctgggcccagtctgccctgactcagcctgcctcgtgtctgggtctcgtggacagtcgatcatcattcttctgcacgtggtatccgagctagtaggtacgttggtaattataattatgtcctccgtagtaccaacacgtaccaggaccaaaccgccccaatctagtgtaattagaggtacgtacaacggttaacgtcccggaccgttacggttacgggtttactaacgttccgtactttctccggttacggtacctcgtaacggttccgtaacggtaccaaacccgtcccggtcccgttaccctcgtaacctaccgttcgtaccggttcgggtcccttacggaggttaccgagggtaacgggcggtagggtactagttactacggtgactacgtactagtattaggtaagtcgacgtacagtccgtacgttcgtaccggttacgtcgggtacggacgtaccgtgtccggtacggtaccgtcggttacgaccgtaccgccggacgtccccg

SEQ ID NO: 165555 - DNA, 593 bp, Homo sapiens
  misc_feature: GYAE6OF01BMCEJ.17.29.C07.1.454.CMB.1.raw
  modified_base (301)..(301): a, c, t, g, unknown or other
  misc_feature (301)..(301): n is a, c, g, or t
  modified_base (306)..(306): a, c, t, g, unknown or other
  misc_feature (306)..(306): n is a, c, g, or t
tcagcgtagactagcacgaccggtgctcgatttagagtgctacgaagggaaagggggctggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcatcatcttctgcacgtggatccagcagtgtacgttgtagttatatatgtctctgtaccacacgtaccagacaacgccccaatcatgtatttagngagtnagtactcgccgtagtgggttactagtcgtcttctcgtcgctcgaagtcgtggacaaccgccggtcccttacccgtagaccctacgtccgtacgtcgggtcctaccgacgggtctagggacggacggtagggttacgtaatttacttacgtgacacggtctataatacgtaagtacgtcgacgacgtcctacgttccgttacggtaccggttcgggacggtacggaccgtacggccgttacggtacccgttaccggtacggtaccaccggtacccgtcggtaccccgg

SEQ ID NO: 165556 - DNA, 607 bp, Homo sapiens
  misc_feature: GYAE6OF01EY6LF.17.29.C07.1.454.CMB.1.raw
  modified_base (311)..(311): a, c, t, g, unknown or other
  misc_feature (311)..(311): n is a, c, g, or t
  modified_base (375)..(375): a, c, t, g, unknown or other
  misc_feature (375)..(375): n is a, c, g, or t
tcagcgtagactagcacgaccggtgctcgatttagagtgctacgaagggaaagggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggactccagcagtgcgttgtagttataattatgtctcctggtaccaacacgtaccaggacaaacgcccccaaaactcatgaattttangaggtacagtaatccggccctcgaggggtttactaatcgcttctctggctcaatctggtacacnccggcctcctgaccatcctcgtcgggtctccgacggctacggacgggacggagggttagatttacgttacgtcgcgacgcttacaacgttataaacggtaagtcggacaacgtcaaccttcttccggttaacgttccgggtccggggtacgggaaccccggtaaaggtcccgtaaccggtaccccggttaccgtacggggtacccaccgggtaaccccgacgggtaccccgg

SEQ ID NO: 165557 - DNA, 696 bp, Homo sapiens
  misc_feature: GYAE6OF01BJ7AR.17.29.C07.1.454.CMB.1.raw
  modified_base (217)..(217): a, c, t, g, unknown or other
  misc_feature (217)..(217): n is a, c, g, or t
  modified_base (301)..(301): a, c, t, g, unknown or other
  misc_feature (301)..(301): n is a, c, g, or t
  modified_base (319)..(319): a, c, t, g, unknown or other
  misc_feature (319)..(319): n is a, c, g, or t
  modified_base (386)..(386): a, c, t, g, unknown or other
  misc_feature (386)..(386): n is a, c, g, or t
tcagcgtagactagcacgaccggtgctcgatttagagtgctacgaagggaaagggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttngcactggatccagcagtgacgttggtagttataattatgtctctgtacaacagtaccagacaaacgccccaaatcatgatttangagtcagtaatcggcctntacggggtttctaagtcgtactctcgtggctacgtaagtctaggacaaacgtaccggcccttacccngaacctactcgtaccgtgggcccttaccgaagggtcctaggaacgggacgggtaaggggttactaagtttaactttaacgtacgggacctaggtacccttaacgtaagttaaacggttaaaggtaaacggttcgggaacccgtaaggtaccctaaccgtttaccggttaccggtttaaacgtttccccggggggaacgggtttaacccggggggaaccctaaaacggggtccttaaccgggggaaacccccgtttaccggttaaccgggttaacccgaacccggaaccccggtaaacggggttacccccg

SEQ ID NO: 165558 - DNA, 615 bp, Homo sapiens
  misc_feature: GYAE6OF01AV1GU.17.29.C07.1.454.CMB.1.raw
  modified_base (303)..(303): a, c, t, g, unknown or other
  misc_feature (303)..(303): n is a, c, g, or t
tcagcgtagactagcacgaccggtgctcgatttagagtgctacgaagggaaagggggctgggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggactccagcagtgtacgttggtagttataattatgtctctgtaccaacacgtaccaggacaacgaccccaaactcatntattagtgagtcagtactccggcctcgtaggggtttactaagtcgtcttctcgtcggtcctaccgtaagtcgtggaccaaccgccggtccctccgtacgacctacttccgtcgtcgggcctccgacggtctagggacggtacggtagggtagttagttacttacgtcgacgtagtcttacgaataagtaaggtaaggtacgcgacgtacgtccgtacgttcgttacggttccgggtacgggtacgggaaccgtacggtacgttacgtacccggtacggttacggtaccgaccgacccggtaacggtccccgg

SEQ ID NO: 165559 - DNA, 705 bp, Homo sapiens
  misc_feature: GYAE6OF01AR5JO.17.29.C07.1.454.CMB.1.raw
  modified_base (255)..(255): a, c, t, g, unknown or other
  misc_feature (255)..(255): n is a, c, g, or t
tcagcgtagactagcacgaccggtgctcgatttagagtgctacgaaggggaaagggggctggggtctcaggaggcagcgctctcaggacatctccaccatggcctgggctctgctgctcctcaccctctcactcagggcacagggtcctgggcccagtctgccctgactcagcctgcctccgtgtctgggtctcctggacagtcgatcatcatcttctgcactggatccagcagtgacgttggtattaataattntcgtctcctggtaccaactacgtaccaggaccaaaccgccccaatcatgtattatggaggtcaagttacgtccggtcctacggtagggtttactagtcctcttctcttcggtcctaccgtaacgttcgacggtacctaaccgtacgggtcccctccgtacgaccctacgtttccgtcggtaccgggtcctaccggtaggtcgtacgggaacgggtaacgggttaacggggttcttaaacgtttaccgtttaccgtaggtaccgtaacggttaccttaacgtaacgttaacggtaaacgggtaagttacgggacctacggtacctaaccggttccgttacggtttaacgggttcccgggaacggggttaccgtaacggtaccgtacggttacccggacccggtttaaccgtacgggttcccgaaacccggtcccggtaaagggtcccccgg

SEQ ID NO: 165560 - DNA, 495 bp, Homo sapiens
  misc_feature: GYAE6OF02JWP4W.17.29.C07.1.454.CMB.1.raw
  modified_base (488)..(488): a, c, t, g, unknown or other
  misc_feature (488)..(488): n is a, c, g, or t
  modified_base (494)..(495): a, c, t, g, unknown or other
  misc_feature (494)..(495): n is a, c, g, or t
tcagcgtagactagcacgaccggtgctcgatttagagtgctacgaagggaaagggggggtctcaggaggcagcgctctcaggacatctccaccatggcctgggctctactgctcctcaccctcctcactcagggcacagggtcctgggtcctccactggaaccagcagtgacgttggtggttataactttgtctcctgataccaacagcacccaggcaaagcaccaaattcatgattatgagtcataatcggcctcaggggtttctaatcgcttctctggctccaagtctggcaacacggcctccctgaccatctctgggctccaggctgaggacgaggctgattattattgcatctcatatacaaccaacagcactctcgatggtattcggcggagggacaagctgaccgtctagtcagcccaaggctgcccctcggtcactctcgttcccgcctcctcctagtctacgctgacgcggctgcaggcncatcgnn

SEQ ID NO: 165561 - DNA, 496 bp, Homo sapiens
  misc_feature: GYAE6OF02GVL3T.17.29.C07.1.454.CMB.1.raw
  modified_base (306)..(306): a, c, t, g, unknown or other
  misc_feature (306)..(306): n is a, c, g, or t
  modified_base (373)..(373): a, c, t, g, unknown or other
  misc_feature (373)..(373): n is a, c, g, or t
  modified_base (409)..(409): a, c, t, g, unknown or other
  misc_feature (409)..(409): n is a, c, g, or t
tcagcgtagactagcacgaccggtgctcgatttagagtgctacgaagggaaagggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaatcatgatttangaggtcagtaatcggcctcaggggtttctaatcgcttctctggctcaagtctgcaacacggcctccngaccatctctgggctccaggctggaggacgagggtnattatactgcagctcatatagaagtgacagctactctcgtagttcggcggtggaccagtctgaccgtcgtaggtcagcccaggtccc

SEQ ID NO: 165562 - DNA, 493 bp, Homo sapiens
  misc_feature: GYAE6OF02IH2O0.17.29.C07.1.454.CMB.1.raw
  modified_base (307)..(307): a, c, t, g, unknown or other
  misc_feature (307)..(307): n is a, c, g, or t
  modified_base (425)..(425): a, c, t, g, unknown or other
  misc_feature (425)..(425): n is a, c, g, or t
tcagcgtagactagcacgaccggtgctcgatttagagtgctacgaagggaaagggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttangagtcagtaatcggcctcaggggtttctaatcgcttctctgctcagtctggcacacgcctcctgaccatctctcgggctccgaggctggaggacgagggtgattattactgcagctanatatagagtgcagcactctcgtagttcggcggtggaccaagctagccgtcgtagtcacgcccaggtcc

SEQ ID NO: 165563 - DNA, 519 bp, Homo sapiens
  misc_feature: GYAE6OF02JF2AS.17.29.C07.1.454.CMB.1.raw
  modified_base (378)..(378): a, c, t, g, unknown or other
  misc_feature (378)..(378): n is a, c, g, or t
  modified_base (518)..(519): a, c, t, g, unknown or other
  misc_feature (518)..(519): n is a, c, g, or t
tcagcgtagactagcacgaccggtgctcgatttagagtgctacgaagggaaaggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattatttgcatctcatatacaaccaanagcactctcgactggtattcggcggtagggaccaagctgacccgtctaggtcacgcccaaggcctgccccctggtccactcttcgttccccaccctcctccctagtcctacgcctgacgccgggctggcacggcgcatgnn

SEQ ID NO: 165564 - DNA, 617 bp, Homo sapiens
  misc_feature: GYAE6OF02HHTFT.17.29.C07.1.454.CMB.1.raw
  modified_base (201)..(201): a, c, t, g, unknown or other
  misc_feature (201)..(201): n is a, c, g, or t
  modified_base (306)..(306): a, c, t, g, unknown or other
  misc_feature (306)..(306): n is a, c, g, or t
tcagcgtagactagcacgaccggtgctcgatttagagtgctacgaagggaaagggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacngtcgatcatcatcttctgcactggatccagcagtgacgttggtagttataattatgtctctggtaccaacagtacccaggcaaacgcccccaaatcatgatttangagtcagtaatcggcctgtagggtttactaatcgcttctcgtggtctaccgtaagtcctaggaccaacgaccggccctcctacgacctatccgtcgtcgggtcctaccgaggtctaggacggacggtagggttgtaatttacgttaacgtcgactacgtcttactaagttaagtaaggtaaacgttgggaactaacgtcctacgttccgttacggtttacgttccggggtaccgggttacgggaaccctaaggtccgttacggtacccggttaccgtaacgggttccaaccggtacccgaacgggtccccg

SEQ ID NO: 165565 - DNA, 515 bp, Homo sapiens
  misc_feature: GYAE6OF02HB58I.17.29.C07.1.454.CMB.1.raw
  modified_base (380)..(380): a, c, t, g, unknown or other
  misc_feature (380)..(380): n is a, c, g, or t
  modified_base (437)..(437): a, c, t, g, unknown or other
  misc_feature (437)..(437): n is a, c, g, or t
  modified_base (441)..(441): a, c, t, g, unknown or other
  misc_feature (441)..(441): n is a, c, g, or t
tcagcgtagactagcacgaccggtgctcgatttagagtgctacgaagggaaagggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaatcatgatttatgaggtcagtaatccggccctgaggggtttctaagtcgtcttctctggctccaagtctggcaacacggcctcccngaccatctcgtcgggctccgaggctgacggacgagggtgtatttatactgcagctanatanaggaagtgcagcactctcgtagtcggcggtggaccaagccgtgaccgtccgtaggtccacggcccgaaggtccg

SEQ ID NO: 165566 - DNA, 625 bp, Homo sapiens
  misc_feature: GYAE6OF02GTGUO.17.29.C07.1.454.CMB.1.raw
  modified_base (370)..(370): a, c, t, g, unknown or other
  misc_feature (370)..(370): n is a, c, g, or t
tcagcgtagactagcacgaccggtgctcgatttagagtgctacgaagggaaagggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacacgtacccaggcaaacgcccccaaactcatgatttatgaggtcagtaatcggccctcgtaggggtttctaatcgcttctctggctcagtctggcaacnccggcctccctgacccatcctcgtcgggctccgagggctaggagggacggtagggtgtaagtttattaccgtggtaccacggccttactaacgttagtaaaggtaacgggttcgggactaacggaccttaaccgttccgttcggttaacgtttccggggacgggttacggggaacccgtaaacggtccgttaccggaaccccggtttacccggttaacgggtacccgtaacggtacccccgtaaagggtccccgg

SEQ ID NO: 165567 - DNA, 576 bp, Homo sapiens
  misc_feature: GYAE6OF02HLRVQ.17.29.C07.1.454.CMB.1.raw
  modified_base (430)..(430): a, c, t, g, unknown or other
  misc_feature (430)..(430): n is a, c, g, or t
tcagcgtagactagcacgaccggtgctcgatttagagtgctacgaagggaaagggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctctgtaccaacagtacccaggacaaacgcccccaaactcatgatttatgagtcagtaatccggcctcgtagggtttacaagtcgtcttctcgtgctcagtctggcaacgacggccctcctagaccctatcctcgtcgggcctccgaggtctggaacgggacggtaggggtnactttatacgtgctagctacaatagtaagaagttggactagacctacttcgtacgttacgttccggggcgggttacggaaccctaaggtcccgttacgggacccggtttaccgtaacgggtacccacggtaccccgaaggtcccgg

SEQ ID NO: 165568 - DNA, 519 bp, Homo sapiens
  misc_feature: GYAE6OF02G8P1O.17.29.C07.1.454.CMB.1.raw
  modified_base (308)..(308): a, c, t, g, unknown or other
  misc_feature (308)..(308): n is a, c, g, or t
  modified_base (372)..(372): a, c, t, g, unknown or other
  misc_feature (372)..(372): n is a, c, g, or t
  modified_base (383)..(383): a, c, t, g, unknown or other
  misc_feature (383)..(383): n is a, c, g, or t
  modified_base (467)..(467): a, c, t, g, unknown or other
  misc_feature (467)..(467): n is a, c, g, or t
tcagcgtagactagcacgaccggtgctcgatttagagtgctacgaagggaaagggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaacgcccccaaactcatgatttangagtcagtaatcggcctgaggggtttctaatcgcttctctgctcaagtctggcacacgcctccngaccatctcgngggctccgaggctggaggacgtagggtgtattattactgcagctacatagtagaagtggcagcctactcgtcgttagttcgggnggtacggaccaagtcgtcggaccgttcgtacggtcaacgcccgtaaggcccg

SEQ ID NO: 165569 - DNA, 544 bp, Homo sapiens
  misc_feature: GYAE6OF02HF21W.17.29.C07.1.454.CMB.1.raw
  modified_base (309)..(309): a, c, t, g, unknown or other
  misc_feature (309)..(309): n is a, c, g, or t
tcagcgtagactagcacgaccggtgctcgatttagagtgctacgaagggaaagggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggacaaacgcccccaaactcatgatttangagtcagtatcgcctcgtagggttctatcgtcttctctggctcaagtctggcaacgcggccctcccgtgacctatcctcgtcgggcctccgaggctggacggacggagggtatagtttacttacgtgacgagtcctacaattaagtaggtaagtggacacgcacttcgtcgttacgttcgggcgggtcggaccagccgtacggaccgttcgtaggtccacggacccgaggtcccg

SEQ ID NO: 165570 - DNA, 559 bp, Homo sapiens
  misc_feature: GYAE6OF02H8GRL.17.29.C07.1.454.CMB.1.raw
  modified_base (368)..(368): a, c, t, g, unknown or other
  misc_feature (368)..(368): n is a, c, g, or t
  modified_base (379)..(379): a, c, t, g, unknown or other
  misc_feature (379)..(379): n is a, c, g, or t
tcagcgtagactagcacgaccggtgctcgatttagagtgctacgaagggaaagggggctggggtctcaggaggcagcgctctcaggacatctccaccatggcctgggctatgctgctcctcaccctctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtaacccaggcaaacgcccccaaaactcgatgatttatgaggtacagtatcggccctgagggtttcaatcgtcttctctggctccagtctgcaacnccggcctccgngaccatcgtctcgggctccgaggtctaggacggacggaggggttatagtttaacttctgacctagccttcaatacgtaaggaaggttcgggcacgacgtacttcttacgttacgttcgggcggtcggaacgaacgtccgtaggacccgttccgtaggtaccgaccgtaccgaaggtcccg

SEQ ID NO: 165571 - DNA, 728 bp, Homo sapiens
  misc_feature: GYAE6OF02G2SHS.17.29.C07.1.454.CMB.1.raw
  modified_base (210)..(210): a, c, t, g, unknown or other
  misc_feature (210)..(210): n is a, c, g, or t
  modified_base (242)..(242): a, c, t, g, unknown or other
  misc_feature (242)..(242): n is a, c, g, or t
tcagcgtagactagcacgaccggtgctcgatttagagtgctacgaagggaaaggggggggtcgtcgaggaggcagcgctctcaggacatctccaccatggcctgggctctgctgctcctcaccctcctcactcagggcacaggtcctgggtcctccactcggaaccagcagtgacgttggtggttataactttgtctcctgactaccaangcaccagcaaagcacccaaattcatgatttangagtcactaatccgcctcagggtttctaagtcgtcttctctggcctccaagtctggcaacacggccctccctcgacctactcctcgtcgggccttccgaggtcgtacgagggacggacggtcgtacggtatttacttaatttggactaacttcctactaattaacttaaaccaaacccaaacacgacctaaccttacgtccgttaacgtagggttaccgtttcggacgggggttaaccgggaaaccgaacggtaccgttacgggtaacccgttacccgtaaacgggttccgaaccggacccgaaacggttccgtacccggtccccccgttacggttacccaaccgtttccttcccggtttacccctacccccttacccgttccctttacggtttcccctaaccggttccctaagggtaccgggtacccggggtccggttaccgggaccggtaaccgggtaccggaaccgtaccggttagggcaccg

SEQ ID NO: 165572 - DNA, 511 bp, Homo sapiens
  misc_feature: GYAE6OF02IRBOY.17.29.C07.1.454.CMB.1.raw
  modified_base (271)..(271): a, c, t, g, unknown or other
  misc_feature (271)..(271): n is a, c, g, or t
  modified_base (325)..(325): a, c, t, g, unknown or other
  misc_feature (325)..(325): n is a, c, g, or t
  modified_base (356)..(356): a, c, t, g, unknown or other
  misc_feature (356)..(356): n is a, c, g, or t
  modified_base (405)..(405): a, c, t, g, unknown or other
  misc_feature (405)..(405): n is a, c, g, or t
  modified_base (460)..(460): a, c, t, g, unknown or other
  misc_feature (460)..(460): n is a, c, g, or t
tcagcgtagactagcacgaccggtgctcgatttagagtgctacgaagggaaagggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctctggtaccaanacgtacccaggcaaacgccccaaactcatgatttatgagtcagtaatcggcctnaggggtttctaatcgtcttctctgctcatcngcacacgcctcctgaccatctcgtggctcgaggctggaggacgagggtnattatactgcagctacatataggaagtggacagacacgttctacgtagttcgggnggtacggacgaagtcgtacgaccgtccgtacggtcacgacccgaggtcccg

SEQ ID NO: 165573 - DNA, 784 bp, Homo sapiens
  misc_feature: GYAE6OF02JTNX2.17.29.C07.1.454.CMB.1.raw
tcagcgtagactagcacgaccggtgctcgatttagagtgctacgaagggaaaggggactggggtctcaggaaggcacgcgctctcaggacatctccaccatggcctgggctctgctgtctcctcaccctctcactcagggcacacgggtcctcgggcccaggtctgccctgactcgacgcctgcctccgtgtcctacgggtccttccgtggactacggtccgtactcaactcacttcttacgtgacctactggactccaagtcagtgacgttgtacgttatattatcgtctcgtacggtaccaactacgtacccaggtacaaaccggtcccctaaaactcatacgtacttttagacgtacgtactaagttaacgtccggtacctacgtacggggtttacctagtccgtactttctaccgtggtacctaccgtaaagtccgttacggacctaaaccgtaccgggtaccttacccgtaccgaaccctaacgtttcccgtacgtaccggggtcctaccgttacggtaccggtacggtaaccgggtacgggaacgggtttacgtaacgtttttaccgtaaacgttcggtaacctagttaccgtaacggttaacgtaacggtttaaccggaaacggttggtacccgtaaacggttactacccggttaaccgttccggttaacggttttccgggggaaccgggtttacgggaaccgtaaaccgggtttccgaaccggttacccggtaccggttaccgggtaccgtacccgggtaccgtaacggtccccgg

SEQ ID NO: 165574 - DNA, 749 bp, Homo sapiens
  misc_feature: GYAE6OF02HJWZN.17.29.C07.1.454.CMB.1.raw
tcagcgtagactagcacgaccggtgctcgatttagagtgctacgaagggaaagggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctctggtaccaactagtacccaggacaaacgccccaaaactcatgatttatgagtcaagttaacgtcggccctagtacgggtttactaacgtccgtcttactcgtggtcctacgtaagtcgttcggacaaccgaccgggtcccttacccgtacgaccctacgttccgttccgtcgggtcctccggtacggtccttagggaacgggtaccgggtaaggggttcttaacgttttaacgttaaccgtcggaccgttaacggtacccttacgtaacgttaaacgttaaacgggttaaacgggtcgggttaacccgaacggtccctaaccgtttcccgttaccgggttttaacgggttttccccggggggtaacggggttaacccgggtaaaccccggtaaacgggttcccgttaacccgggttacccggtttacccgggttaaccgggttaacccggtaacccggtacccccgggtaaacgggtttccccccggg

SEQ ID NO: 165575 - DNA, 805 bp, Homo sapiens
  misc_feature: GYAE6OF02IE9WT.17.29.C07.1.454.CMB.1.raw
  modified_base (314)..(314): a, c, t, g, unknown or other
  misc_feature (314)..(314): n is a, c, g, or t
tcagcgtagactagcacgaccggtgctcgatttagagtgctacgaagggaaagggggctgggtctcaggaggcagcgctctcaggacatcctccaccatggcctgggctctgctgctcctcaccctcctcactcagggcacagggtcctgggcccagtcctgccctgactcagcctgcctccgtgtctgggtctcctggacagtcgatcatcattcttctgcactggatccagtcaggtgacgttggtagttataattatgtctctggtaaccaacagtacccaggacaaacgccccaaactcaatgactttangtaggtcagttaactccggccttcgtaggggtttctaagtcgtcttcctcgttcggtcctacctaacggttcttacgggactaaacccgtaccgggtccccttacccgtacggtaacccttacgtcccttccggtcggggcctttacccggacgggtccgttacgggaagggtaaacccggtaaggggtttcgttaaacggtttaaccttttaacggtcgggtttccgacgggttaaaccccgggtttgggggaaacgttagggacccgttaacgtttccccggttaaagggttaaacggtttccggggggtttaacccgggtttcggggtttacccggggggaacccggggttaacgggggaaccccggttaacggggtcccggttacgggttaaaacccccgggtttccgtaaaccgggtttaccccggaaaccgggtaccccccggtaacgggggttcccccttaccccgggttaaccccccccgggg

SEQ ID NO: 165576 - DNA, 591 bp, Homo sapiens
  misc_feature: GYAE6OF02F4WN1.17.29.C07.1.454.CMB.1.raw
  modified_base (305)..(305): a, c, t, g, unknown or other
  misc_feature (305)..(305): n is a, c, g, or t
  modified_base (310)..(310): a, c, t, g, unknown or other
  misc_feature (310)..(310): n is a, c, g, or t
  modified_base (445)..(445): a, c, t, g, unknown or other
  misc_feature (445)..(445): n is a, c, g, or t
tcagcgtagactagcacgaccggtgctcgatttagagtgctacgaagggaaagggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgttctctggtaccaacacgtaccaggcaaacgccccaaatcatgattangagtnagtatcggcctcgtagggtttctaatcgtcttctctcggtctacgaagtctaggaccaacgaccggtccctcccgtacgaaccctacttcctccggtcgggcctccgagggtcttaggacgggtacggtagggtnttaacgttattacgtgacgtacgtcctactagttaagtaaggtaaggtcggactacgtctacgtccgttacgttacgtcgggtcgggtacggaacgaacgtcgtaccggaccgttcggtacggtacaccggacccgtaggtccccg

SEQ ID NO: 165577 - DNA, 733 bp, Homo sapiens
  misc_feature: GYAE6OF02H7GGD.17.29.C07.1.454.CMB.1.raw
  modified_base (272)..(272): a, c, t, g, unknown or other
  misc_feature (272)..(272): n is a, c, g, or t
tcagcgtagactagcacgaccggtgctcgatttagagtgctacgaagggaaagggggctggggtctcaggaggcagcgctctcaggacatctccacatggcctgggctctgctgctcctcaccctctcactcagggcacagggtcctgggcccagtctgccctgactcagcctgcctccgtgtctgggtctcctggacagtcgatcatcattcttctgcactggatccagcagtgtacgttgttagttaatattatgtctcgtgtaccaacncgtaaccaggccaaaacgcccctaaaactcattcgtaatttagaggtaggttacaagttaacgtccggtcccgtacgttacggggttttaccagttccgttacttcgtccgtcggtaccttaccgtacgttcgtacggacctaaacccggtaccggtaccccttaccccgtagaacccgtaacgtttccgttaccggtcgggtacccttacgaacggggtccgttaaggggtaaacgggtaccgggtaacgggggttattaaacttttaaccgttacgtccggaacgtacgttccctaacttaagttaaacggtaaggtaacgggttacggactaacggtaccctaacttccggttaccgttacgggtttccgggcggggttaacggaccgtaacgttaccgacgggttaaccccgtacggttaaccggaccctaaacgggcccccgttaaggtccccccg

SEQ ID NO: 165578 - DNA, 501 bp, Homo sapiens
  misc_feature: GYAE6OF02IZYYX.17.29.C07.1.454.CMB.1.raw
  modified_base (241)..(241): a, c, t, g, unknown or other
  misc_feature (241)..(241): n is a, c, g, or t
  modified_base (259)..(259): a, c, t, g, unknown or other
  misc_feature (259)..(259): n is a, c, g, or t
  modified_base (277)..(277): a, c, t, g, unknown or other
  misc_feature (277)..(277): n is a, c, g, or t
  modified_base (316)..(316): a, c, t, g, unknown or other
  misc_feature (316)..(316): n is a, c, g, or t
  modified_base (351)..(351): a, c, t, g, unknown or other
  misc_feature (351)..(351): n is a, c, g, or t
  modified_base (374)..(374): a, c, t, g, unknown or other
  misc_feature (374)..(374): n is a, c, g, or t
  modified_base (459)..(459): a, c, t, g, unknown or other
  misc_feature (459)..(459): n is a, c, g, or t
  modified_base (464)..(464): a, c, t, g, unknown or other
  misc_feature (464)..(464): n is a, c, g, or t
  modified_base (482)..(482): a, c, t, g, unknown or other
  misc_feature (482)..(482): n is a, c, g, or t
  modified_base (493)..(493): a, c, t, g, unknown or other
  misc_feature (493)..(493): n is a, c, g, or t
  modified_base (501)..(501): a, c, t, g, unknown or other
  misc_feature (501)..(501): n is a, c, g, or t
tcagcgtagactagcacgaccggtgctcgatttagagtgctacgaagggaaagggggggggtctcaggaggcagcgctctcaggacatctccaccatggcctgggctctgctgctcctcaccctcctcactcagggcacagtgtcctgggtcctccactggaaccagcagtgacgttggtggttataactttgctcctgataccaacagcaccaggcaaagcaacccaaattcatgattangagtcactaatcggcctnagggtttcaatcgcttcntggctcaagtctggcaacacggcctcctgacctatcctntcgggctcgaggctgaggtacaggctagacttatntggcatctcatactacaacctanagactactctacgactggtaattcggacggaggaccaagctgaccgtctaggtcacgcaagctcgacccgtgcactctcgtcccncctcnctagtctacgctgcgcgntcggcgagtcncgtagagn

SEQ ID NO: 165579 - DNA, 760 bp, Homo sapiens
  misc_feature: GYAE6OF02J20A7.17.29.C07.1.454.CMB.1.raw
  modified_base (244)..(244): a, c, t, g, unknown or other
  misc_feature (244)..(244): n is a, c, g, or t
  modified_base (389)..(389): a, c, t, g, unknown or other
  misc_feature (389)..(389): n is a, c, g, or t
  modified_base (521)..(521): a, c, t, g, unknown or other
  misc_feature (521)..(521): n is a, c, g, or t
  modified_base (637)..(637): a, c, t, g, unknown or other
  misc_feature (637)..(637): n is a, c, g, or t
  modified_base (654)..(654): a, c, t, g, unknown or other
  misc_feature (654)..(654): n is a, c, g, or t
  modified_base (664)..(664): a, c, t, g, unknown or other
  misc_feature (664)..(664): n is a, c, g, or t
tcagcgtagactagcacgaccggtgctcgatttagagtgctacgaagggaaagggggctggggtctcaggaggcagcgctctcaggacatctccaccatcggcctgggctctgctgcctccctcaccctcctacacgtcgaggccacgtacgggtcctgggacccctagtcctcgtaccctgtacctcgtacgcctcgtccgttccgttgtccgttcggtcctacgaggactagtcctactacnttaccgtctcgttacgctcacgtgctgacgtagtaggttacggttagttttagtaattaattcgtgttccgtaccgtaccggttaaaccaacctaaccgtaaccggtacccgaaccggaacctaacccctaaaccctattacgtnttaggtttaaagtacggtacgtaacggtttaacaccgggttcccggttaccggttacggttaggttttacccggaaccttcggtaccttctcggtcgcgttaaccgagttcggacccgactaaccggtcccncccgtcctacaccgtctccgtaccgtcgtcggttacgaccgtaggttcggaaaacgggtcgttaacggtcttaaaccggtttataccgttaccgtacgacctttaacgagttaacnccgtaaggtaccgtacncgtaaccgtntaacccgttgtacggtacgtacggttcggaaccggtacgaattccccggacttagggtaccctacggctaccgaccgtaccggttcccgtccccgg

SEQ ID NO: 165580 - DNA, 759 bp, Homo sapiens
  misc_feature: GYAE6OF02IDF7E.17.29.C07.1.454.CMB.1.raw
  modified_base (213)..(213): a, c, t, g, unknown or other
  misc_feature (213)..(213): n is a, c, g, or t
  modified_base (251)..(251): a, c, t, g, unknown or other
  misc_feature (251)..(251): n is a, c, g, or t
tcagcgtagactagcacgaccggtgctcgatttagagtgctacgaagggaaaggggggggggtctcaggaggcagcgctctcaggacatctccaccatggcctgggctctgctgctcctccaccctcctcactcagggcacgagggtcctgggtccctccacgtggaaccagcagtgacgttggtgttatactttgtctcctgactaccaacngccaccgaggacaaagccaacctaattcatgtatttangacgtactactaacgtccgtcctcgtaggggtttactaagtccgtcttcctacgtcggtcctacgaagttcgtggacccaaccgaccggtacccctcccgtacgaccctacttccgttcgtacggggtccctaccgacgggtcgtacgggaacgggaccggtaacggccgtttagttaactttaacgtttaacgtttcgacctacgttacttactaacttaaccgtaaacccgaaaccctaaacgaccgtaccctaaccttaccggttaaccggtaccggttagggttaccggttaccggggacgggtaaccgggaaccgtacgtccgttaaccggtacccgttaccggtacggtcccgaccgaaccgaccggtccgtacccggtcccccgtacggtaccctccgttcccgttacccggttcccgtacccttcccgtcccttacccgttacgttaccgtcgtaccggtcgggcggtccggcgtacggcggaccggcgtactacgtgtc

SEQ ID NO: 165581 - DNA, 589 bp, Homo sapiens
  misc_feature: GYAE6OF02IUDK7.17.29.C07.1.454.CMB.1.raw
  modified_base (324)..(324): a, c, t, g, unknown or other
  misc_feature (324)..(324): n is a, c, g, or t
  modified_base (479)..(479): a, c, t, g, unknown or other
  misc_feature (479)..(479): n is a, c, g, or t
  modified_base (489)..(489): a, c, t, g, unknown or other
  misc_feature (489)..(489): n is a, c, g, or t
  modified_base (530)..(530): a, c, t, g, unknown or other
  misc_feature (530)..(530): n is a, c, g, or t
tcagcgtagactagcacgaccggtgctcgatttagagtgctacgaagggaaagggggctggggtctcaggaggcagcgctctcaggacatctccaccatggcctgggctctgctgctcctcaccctcctcactcagggcacagggtcctgggcccagtctgccctgactcagcctgccctccgtgtctgggtctcctggacagtcgatcatcattcttctgcactggactccagcagtcgtacggttggtagttaataattatgtcctccgtggtaacccaacacgtacccaggaccaaacgacccccaaatcatagtatttangtaggtacagtaactcggacctgtagggtttactaatcgtcttcgtcgtcgcctacgaagtcgtaggaccaacgaccggtccctccgtacgacccacttccgtcgtcggcctaccgacggtcgtaggagggtacggtagggtgtaatttataacngactatctanagtacaaggtagtcgctagctactcgtacgtagttccgggnggtaccggacgagtcgtaccggtaccgtaccgttaggacctaccggtacccgagtcccg

SEQ ID NO: 165582 - DNA, 800 bp, Homo sapiens
  misc_feature: GYAE6OF02GSV6E.17.29.C07.1.454.CMB.1.raw
tcagcgtagactagcacgaccggtgctcgatttagagtgctacgaagggaaagggggctggggtctcaggaggcagcgctctcaggacatctccaccatggcctgggctctgctgctcctcaccctcctcactcagggcacagggtcctgggcccagtctcgccctgactcagcctgcctccgtgtctggtctcctggacagtcgatcatctatcttctgcacgtggactccgagcagtggtaacggttaggtaagttaattaatttatcgttccttccgtacggtaaccaacgtaccggtaacccgacggaaccgaaacccgaccccctaaaactcaacttagttaactttagtggtaaggtactaagttaacgtccggtacccttaggtaacggggttttactaacgtccgttaccttcttacgttcggtaccttaccggtaacgttcgtacgaacccgtaaccggtcccgggtccccttacccgacgtaaccccttattacccgtcgggtaccgggtcccttacgggaccggtacgttacggggaacgggtaacgggttaggggttacgtttaaactttacgttaaccggtcggtaacctacgtcctaacgttaagttaaagtaacgggtagttacgggaactacggtaacctaccggtttaccgttacggtttccgggtaaccggggtccggggttaaaccgggaaccgttaacggttacccgtaacccggggttacccgttaacccgggtaccgggttacccgaaccgggttaccccggaaccgggttccccccg

SEQ ID NO: 165583 - DNA, 662 bp, Homo sapiens
  misc_feature: GYAE6OF02GE9WI.17.29.C07.1.454.CMB.1.raw
  modified_base (406)..(406): a, c, t, g, unknown or other
  misc_feature (406)..(406): n is a, c, g, or t
tcagcgtagactagcacgaccggtgctcgatttagagtgctacgaagggaaagggggctggggtctcaggaggcagcgctctcaggacatctccaccatggcctgggctctgctgctcctcaccctctcactcagggcacgagggtcctgggcccagtctgccctgactcagcctgcctcgtgtcgtgggtcctccgtggacagtcgatcatcattcttctgctagtgactccagcagtgtacgttggtattataattatgtctctgtaacacacgtaccagacaacgaccccaaactcatgtatttagtgagtactagtactccggacctcgtagggtttacaagttcgtcttctcgtcggactaccgtaagtcgtcgtaccgaacgccgtcctcctacgacctnttaccgtcgtacgggtcctaccgaggtcgtacgggacggtaccgggtaggtacgttaacgtttaacgttctcggtaccgtacgtacgttaactaagtacgtaaaggtacgggtacggacctacggaccttacggtacctttacggtacggtttaccgggggtggttaacccggggaaccttaaccgggtccgttaacccggtacccggttcggtaacccggttaccgacccggttacccgtacgggttacccccgg

SEQ ID NO: 165584 - DNA, 614 bp, Homo sapiens
  misc_feature: GYAE6OF02JWXUA.17.29.C07.1.454.CMB.1.raw
  modified_base (304)..(304): a, c, t, g, unknown or other
  misc_feature (304)..(304): n is a, c, g, or t
  modified_base (310)..(310): a, c, t, g, unknown or other
  misc_feature (310)..(310): n is a, c, g, or t
tcagcgtagactagcacgaccggtgctcgatttagagtgctacgaagggaaagggggctggggtctcaggaggcagcgctctcaggacatctccaccatggcctgggctctgctgctcctcaccctcctcactcaggcacagggtcctgggcccagtctgccctgactcagcctgcctccgtgtctgggtcctcctggacagtcgatcatcattcttctgcactggatccagcagtgtacgttgtagttatattatgtctctgtacacactaccaggacaacgccccaaactcatagtattagngtagtnaacgtagtccgtccctagtagggtttactacgtccgtcttcgtactcggacctacgtagtccgtggccaaacgtccgtccctaccgcgtactactcttcgtcgggtccttaccgaggtaccgtggacgggtaaccgggtaggtttacgtaagtttacgtacgtacggactcgtacttacgtaaatcggtaacgtacgtacggactacgtaaccgtctcgttacgttcggtccgggtacgggttcggaacctaacgtcgtaaccggtccgtacggtaccggtccgaaccgaccgtaccggtcccg

SEQ ID NO: 165585 - DNA, 509 bp, Homo sapiens
  misc_feature: GYAE6OF02JE1SV.17.29.C07.1.454.CMB.1.raw
  modified_base (261)..(261): a, c, t, g, unknown or other
  misc_feature (261)..(261): n is a, c, g, or t
  modified_base (294)..(294): a, c, t, g, unknown or other
  misc_feature (294)..(294): n is a, c, g, or t
  modified_base (302)..(302): a, c, t, g, unknown or other
  misc_feature (302)..(302): n is a, c, g, or t
  modified_base (311)..(311): a, c, t, g, unknown or other
  misc_feature (311)..(311): n is a, c, g, or t
  modified_base (384)..(384): a, c, t, g, unknown or other
  misc_feature (384)..(384): n is a, c, g, or t
  modified_base (489)..(489): a, c, t, g, unknown or other
  misc_feature (489)..(489): n is a, c, g, or t
  modified_base (501)..(501): a, c, t, g, unknown or other
  misc_feature (501)..(501): n is a, c, g, or t
  modified_base (507)..(507): a, c, t, g, unknown or other
  misc_feature (507)..(507): n is a, c, g, or t
  modified_base (509)..(509): a, c, t, g, unknown or other
  misc_feature (509)..(509): n is a, c, g, or t
tcagcgtagactagcacgaccggtgctcgatttagagtgctacgaagggaaagggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcaccaggcaaagcacccaaattcatgatttatgaggtcataatcggccctnaggggtttctaatcgcttctctggctccaagtntggcaacncggcctccngaccatctctgggctccaggctggaggacgagctgtattattattgctatctcatatacaacaacagcactcncgtactggtaatcggacggaggaccagtctcgaccgtctagggtcagccgaaggctccgcccctggcactctcgtcccacctctcctagtcctacgctgcgcggntcggacagggcnactagntn

SEQ ID NO: 165586 - DNA, 629 bp, Homo sapiens
  misc_feature: GYAE6OF02FXT4R.17.29.C07.1.454.CMB.1.raw
  modified_base (279)..(279): a, c, t, g, unknown or other
  misc_feature (279)..(279): n is a, c, g, or t
  modified_base (307)..(307): a, c, t, g, unknown or other
  misc_feature (307)..(307): n is a, c, g, or t
  modified_base (417)..(417): a, c, t, g, unknown or other
  misc_feature (417)..(417): n is a, c, g, or t
tcagcgtagactagcacgaccggtgctcgatttagagtgctacgaagggaaagggggctggggtctcaggaggcagcgctctcaggacatctccaccatggcctgggctctgctgctcctcacccctcctcactcagggcacagggtcctgggcccagtctgccctgactcagcctgcctccgtgtctgggtctccgtggacagtcgatcatcatcttctgcactggactccagcagtcgtacgttgtagttataattatgtctctcgtacacataccnggacaacgccccaaactcattgatttangagtacagtactcggcctcgttagggttctaagtcgtcttcttcgtgcctaccgagttcgtcgaccaacggtacccgtccctccgtcgactactcctcgtcggtcaccgngccgtagacgggacggtaggtaggtattacgtacttcgactagtccctagtactaacgttaagtaacgggtgtactacgaacgttacctacgtttaccgggttacgttaccgggtacccgggtaagggtaacccgtaacggtccgttaacggaccccggttttacggtaacccgggttcctaacccgggaccccgttaagggttccccccgg

SEQ ID NO: 165587 - DNA, 648 bp, Homo sapiens
  misc_feature: GYAE6OF02IX1DV.17.29.C07.1.454.CMB.1.raw
  modified_base (236)..(236): a, c, t, g, unknown or other
  misc_feature (236)..(236): n is a, c, g, or t
  modified_base (339)..(339): a, c, t, g, unknown or other
  misc_feature (339)..(339): n is a, c, g, or t
  modified_base (527)..(527): a, c, t, g, unknown or other
  misc_feature (527)..(527): n is a, c, g, or t
  modified_base (545)..(545): a, c, t, g, unknown or other
  misc_feature (545)..(545): n is a, c, g, or t
tcagcgtagactagcacgaccggtgctcgatttagagtgctacgaagggaaagggggctggggtctcaggaggcagcgctctcaggacatctccacatggcctgggctctgctgctcctcaccctctcacgtcgagggcacgagggtccctgggcccagtctggccctagacctcagcctcgcctccgtggtacgttcggtcctccgtaggacagtcgaactcagtcacttcttgngcctagtggtacctccagctaaggtctacggttaggtattaacttaagtatcgtactcgtacggtaccaataccgtacgaacgacaacgcctaacctaacgtnaagtactaagttacaggtagtacgtaacgtacgttccggacccgtaggttacggttactacgtcgtccgttagttcgacgttcgtacttaaggctacggtacaacgtccgctccgtacgctacgtcaacgttgcctacgacgtgtacggaagggtcgacgtattacgtaacgtctagtctacgtactntaacgaggtacgttaacngggtactccgagttacctcgtaaccgttcgggacggtaccggagttaaaccggcgttccggtaactccgggttacccctaggtaccgaccggtaacgtcccgg

SEQ ID NO: 165588 - DNA, 800 bp, Homo sapiens
  misc_feature: GYAE6OF02FN0R8.17.29.C07.1.454.CMB.1.raw
  modified_base (205)..(205): a, c, t, g, unknown or other
  misc_feature (205)..(205): n is a, c, g, or t
  modified_base (237)..(237): a, c, t, g, unknown or other
  misc_feature (237)..(237): n is a, c, g, or t
tcagcgtagactagcacgaccggtgctcgatttagagtgctacgaagggaaagggggggggtctcaggaggcagcgctctcaggacatctccaccatggcctgggctctgctgctcctcaccctctcactcagggcacagggtcctgggtcctccactggaaccagcagtgacgttggtggttatacttgtctctgactaccaanagccaccagacaagcaccaattcatgatttangagtcactagccgcctcgtagggtttctaactcgcttctcgtggctacgtacgtctcggacaaccgtaccggtcccgttcccgacgacccgtacttccgtccgtgggtccctacccgacggtcgtacggacgggaacgacggtcttaggtatttaacgttaagttcgacttactcgttactaacttaacctaaccctaaaacccaaaccgtacgacccctaccttaccgtaccgtaacgtttacgggttaccggttacccggggacggggttaaccgggggaaacccgtacggtcccggttaaaccggtacccccgggtttacccggttacgggttaacccgacccgggtaaccccggtaacgggttaccccgggaccccggttaccccccggtttacggttaccccgttacccggtttaccgttcccccggtttaacccccttaccccgttttacccctttaacccgttccgttacccggttaccgggttcgtaccgggtacggggtaccgggacccggtttcggaccgggtaaggtccccggtaacaggttaccgactcgg

SEQ ID NO: 165589 - DNA, 589 bp, Homo sapiens
  misc_feature: GYAE6OF02IO38P.17.29.C07.1.454.CMB.1.raw
  modified_base (313)..(313): a, c, t, g, unknown or other
  misc_feature (313)..(313): n is a, c, g, or t
  modified_base (482)..(482): a, c, t, g, unknown or other
  misc_feature (482)..(482): n is a, c, g, or t
  modified_base (489)..(489): a, c, t, g, unknown or other
  misc_feature (489)..(489): n is a, c, g, or t
tcagcgtagactagcacgaccggtgctcgatttagagtgctacgaagggaaaggggggctggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcatcatcttctgcactggactcagcagtgacgttgtagttatatatgtctctgacaactagacccgagaccaacaccccaaatcatagtactttaagtgtaggtanaagttaacgtccggtcctacgtaggggtttctaagtccgtacttctcgtaggtcctacgtacgtactcggaacctaaccgaccggtccctaccctagacctattaccgtacgtccggactccgaggtactagggaacgggtaggacgggttagtacgtttaattacgtnaaccgtncctatataagtaaggtagtcggacagcctaactcgtacgtaggtcggcggtaaccgggcaaggcctagtacgtcgtacgtacacggaccgacgtacccgg

SEQ ID NO: 165590 - DNA, 649 bp, Homo sapiens
  misc_feature: GYAE6OF02GQSHP.17.29.C07.1.454.CMB.1.raw
  modified_base (228)..(228): a, c, t, g, unknown or other
  misc_feature (228)..(228): n is a, c, g, or t
  modified_base (273)..(273): a, c, t, g, unknown or other
  misc_feature (273)..(273): n is a, c, g, or t
  modified_base (319)..(319): a, c, t, g, unknown or other
  misc_feature (319)..(319): n is a, c, g, or t
  modified_base (334)..(334): a, c, t, g, unknown or other
  misc_feature (334)..(334): n is a, c, g, or t
  modified_base (351)..(351): a, c, t, g, unknown or other
  misc_feature (351)..(351): n is a, c, g, or t
  modified_base (515)..(515): a, c, t, g, unknown or other
  misc_feature (515)..(515): n is a, c, g, or t
tcagcgtagactagcacgaccggtgctcgatttagagtgctacgaagggaaagggggctggggtctcaggagcagcgctctcaggacatctccaccatggcctgggctcgtgctgctcctcaccctctcactcgagggcacgaggggtcctacgggccctagtctcgtcctggactcgagcctgcctcgtgtcgtggtcctcgtggactgtcgatcatcattcgttcngctacgtgactccgagcaggttgtacgttaggtacttaattattntcgtactcgtagtaaccacacgtaccagactaaaccgcccctaaancaattcgtattacgngtacgtctaagtaaccnccggtacctggttacggtttaccacgtcgttcttcgtcggtcggtacctaccggtaagtcgtacgaccgtacgacccgtcctaccgtagacccgttatccggtaaccgtcgggtaccctcgacgcgtacgggaggtcggtaggactttattaaccgtgcgacgngtacctataacgtagtacgacggttgaccgagttaccctgttcttacggttaggttccggaagggttaccggaacttaccggcggttaaccgtacgttcggtaacgaccctaacgggtacccgtagtcccccgg

SEQ ID NO: 165591 - DNA, 563 bp, Homo sapiens
  misc_feature: GYAE6OF01ATCX8.15.23.C01.1.454.CMB.1.raw
  modified_base (495)..(495): a, c, t, g, unknown or other
  misc_feature (495)..(495): n is a, c, g, or t
tcagtctacgtagccacgaccggtgctcgatttagtacacgtgattagggattggggaggtctcagagaggagccttagccctggactccaaggcctttccacttggtgatcagcactgagcacagaggactcaccatggagttggggctgagctgggtttccttgttgctatttagaggtgtccagtgtgaggtgcaactggtggagtcgtgggggaggcctcgtccgaggccggggggtccctgagactctcctgtgaagcctctggattcaccttgagcacttattggatgtacgttgggtcccgccgaggcctccgaggggaaggggcgtgggaggtgggtggccaccgataacgaaaaagataggaagtgaacacaacctatgtagaactcgtgtgagtcgggaccgtattcaccgtctaccgagacgacgacgaccaagactcactacatctagacaaatgaacaacgtgagacgaccgagacgacggntgtgtattactggtgtgagagagtgttcgtggtcggttcggggcctacgggaccctgggtcctacccg

SEQ ID NO: 165592 - DNA, 605 bp, Homo sapiens
  misc_feature: GYAE6OF01B30KH.15.23.C01.1.454.CMB.1.raw
  modified_base (487)..(487): a, c, t, g, unknown or other
  misc_feature (487)..(487): n is a, c, g, or t
tcagtctacgtagccacgaccggtgctcgatttagtacacgtgattagggattggggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagcctggtccaggccgggggggtccctgagactctccgtgtcgccgcctctggactcacctttagagctattggatgagcgtgggtccgccgaggctccgaggggagggctgggagtgggtgaccaaacgagtaaaaggagagtaggaagtcaagaaacactagtgtggactcgtggtaggaacgggcctattccacctattcctaccgaagacgaacaaccgaccaaagtaacttcagttagtactcgtagaacaaagtcgaaacncgacctaggaacggtacgaccggaaggaccgaccgggccgttagttacttacgtgttaggtagaggagactagtacggaacgtaacgggtagaaacggtaaccggggtgggttgtagg

SEQ ID NO: 165593 - DNA, 628 bp, Homo sapiens
  misc_feature: GYAE6OF01CQVUK.15.23.C01.1.454.CMB.1.raw
  modified_base (621)..(621): a, c, t, g, unknown or other
  misc_feature (621)..(621): n is a, c, g, or t
tcagtctacgtagccacgaccggtgctcgatttagtacacgtgattagggattggggaggtctcagagaggagccttagccctggactccaaggcctttccacttggtgatcagcactgagcacagaggactcaccatggagttgggctgagctgggttttcctgttgctattttagaaggtgtccagtgcgaggagcagcgtggtggagtcgtgggggagccgtggtccgaggccggggggtccctggagactctcctgtcgccgctctggactcactttagagctatgatgagcgtggtccgcaggctccgagggagggctggaggtgggtcgccaagagtaaaaggagagtggaagtcgaaagaaacactaagtggtaggaacttcgtggtacggaacgggcctagttacaacctattccgtaccaaggaacgacgaaaccgacaaaggtaattaccgaggttataactctacgaactaaatcgaaaccgtagcccgtggaaacgacggacccggaaacggaccgaccgggtccgtagttacttacgtggtacgtaggaagaggaacctagtacggtaacgtaaacgggtaggtaaacggtaaccggggtaggggttntaacggg

SEQ ID NO: 165594 - DNA, 740 bp, Homo sapiens
  misc_feature: GYAE6OF01EM6JC.15.23.C01.1.454.CMB.1.raw
tcagtctacgtagccacgaccggtgctcgatttagtacacgtgattagggattggggaggtctcagagaggagccttagccctggactccaaggcctttccacttggtgatcagcactgagcacagaggactcaccatggagttgggctgagcttgggttttccttgttgcttattttagaaggtgtccagtgcgaggagcagcgtggtggaggtcgtgggggaggccgtgggtccgagggcccgggggggttccctggacgacctccgttccgtggtcgcccgtcctcgtggtacctcctaaccttttagtagtcttagttggatgagtcgtcgggtccgccgaggcgtccggaggggacgggcgtgggagtgggtcgacaaacgaagtaaaaggaagagtaggaagtacgaagaaactacgtagtggtacggtaccttcgtagggttaacggaacggggtcccgtaagtttacccaacccgttaagttccccttaccgaaaggtaaacgaaaccccgaaaaccgtaacccgtaaaagtaacctttaccgaagttacggttaacttaccgtaagtaaccaaaagttcggaaacccaggtacccgtaaggacggacggacccgggaacggacccgaccgggttccgttagttaacgttcgtagggtacgtaggaaggacgaacgtagtaccggaacggtaacggtaagtaaccgggtaaacggggtgggtttagtacggg

SEQ ID NO: 165595 - DNA, 694 bp, Homo sapiens
  misc_feature: GYAE6OF01A1V40.15.23.C01.1.454.CMB.1.raw
tcagtctacgtagccacgaccggtgctcgatttagtacacgtgattagggattggggaggtctcagagaggagccttagccctggactccaaggcctttccacttggtgatcagcaatgagcacagaggactcaccatggagttggggctgagctgggttttccttgttgctattttagaaggtgtccagtgcgaggagcagctggtggagtcgtgggggaggccgtgggtccgagggcccgggggggtccctggacgacctctccgtgtcgccgcctctggacctctacctttagtagtctattggatgagtcgtgggtccgccgaggcctccggaggggacgggcgtgggaggttggggttggtacgtttaacgaaaaaggttaaaatggtaagtggtagaaagtaaagtagacgtacggtgaccgaaccgtaggaaagagtacttaccactatactagaagagtaataacgttaaacgaaaaacggtggtatttaagtttagaactaaatcgaacacgtacctaacggaaaaccgaggaaccaacgtacggaccgttaactactttaaccgtacgtaacccaacgtacggtaacgttacgggtaacgttcgaaccgtaggtaaccggtaaacgggtaaaacgggtgtaaccttagttacggttacttttacggaagttacggttaccgggg

SEQ ID NO: 165596 - DNA, 629 bp, Homo sapiens
  misc_feature: GYAE6OF01ANOA9.15.23.C01.1.454.CMB.1.raw
  modified_base (502)..(502): a, c, t, g, unknown or other
  misc_feature (502)..(502): n is a, c, g, or t
  modified_base (524)..(524): a, c, t, g, unknown or other
  misc_feature (524)..(524): n is a, c, g, or t
tcagtctacgtagccacgaccggtgctcgatttagtacacgtgattagggattggggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtgggggagccgtggtccgaggccggggggtccctgacgactcgtcctgtcgccgcctcgtggacctctaccttttagtagtcttagttggatgagtcgtcgggtccgccgaggcctccgaggggagggctgggagtgggtcggaccaaagaagtaaaaggaagtagtaggaagtacgaaagaaaccgtacgttagtggtacggaactcgtaggtacggaacgggcccgtacttaccgaacctatccgtaccgaagacgaaccgaacgaccaaagtaacttcgaaggtntactctagactaaatcgaaacncgacctaggaacgacgaccggagaccgacggtcgtagttattacgtgtagtagagtaagctagtaggaacgtaacgggctaaaggtaaccgggtgggttgtacgg

SEQ ID NO: 165597 - DNA, 579 bp, Homo sapiens
  misc_feature: GYAE6OF01BGXAA.15.23.C01.1.454.CMB.1.raw
  modified_base (331)..(331): a, c, t, g, unknown or other
  misc_feature (331)..(331): n is a, c, g, or t
  modified_base (464)..(464): a, c, t, g, unknown or other
  misc_feature (464)..(464): n is a, c, g, or t
  modified_base (468)..(468): a, c, t, g, unknown or other
  misc_feature (468)..(468): n is a, c, g, or t
  modified_base (482)..(482): a, c, t, g, unknown or other
  misc_feature (482)..(482): n is a, c, g, or t
  modified_base (489)..(489): a, c, t, g, unknown or other
  misc_feature (489)..(489): n is a, c, g, or t
  modified_base (509)..(509): a, c, t, g, unknown or other
  misc_feature (509)..(509): n is a, c, g, or t
  modified_base (536)..(536): a, c, t, g, unknown or other
  misc_feature (536)..(536): n is a, c, g, or t
  modified_base (556)..(556): a, c, t, g, unknown or other
  misc_feature (556)..(556): n is a, c, g, or t
tcagtctacgtagccacgaccggtgctcgatttagtacacgtgattagggattggggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtggaggggaggcctgggtccgacgggcccgggggggtcccctggacgactcctccgtgtcgcccgcctcgtggacctccaccttttagtacgcttattggatggagcgtgggtcccnccgaggcctccgaggggaggggctgggagtgggtgaccaagagtaaaaggagagtaggaatcgaagaaacacgtagtgtgactcgtggtgaacgggcctattcacatccacagacaacaacgacaaagtactnagtntactctagacaaancgaaacncgctagagagccgaggaccncggtccgtagtattacgtgtgtagagngaactagcgacgaagggtanaacggtaacgggtaggggttacg

SEQ ID NO: 165598 - DNA, 746 bp, Homo sapiens
  misc_feature: GYAE6OF01BXRXN.15.23.C01.1.454.CMB.1.raw
  modified_base (222)..(222): a, c, t, g, unknown or other
  misc_feature (222)..(222): n is a, c, g, or t
tcagtctacgtagccacgaccggtgctcgatttagtacacgtgattagggattggggaggtctcagagaggagccttagccctggactccaaggcctttccacttggtgatcagcactgagcacagaggactcaccatggagttggggctgagcgttggttttccttgttgctattttagaggtgtccagtgcggaggagcagctggtggagtcgtgggggngcctggccgaggccggggggtccctgagactctctgtcgccgcctctcggacctctaccgtttagtacgtcttagttggatggacgtcggtcggggtcccgccgacgggccgtaccggagggggaacggggtcgtggggagggttggggtacggacccgaaacgtaagtaaaagggaagtaagtaggaaagtacaaagaaacctaacgtaagtggtacggacttacgtaggtacggaacgggtcctacgtttaccaaccgtaacttaccgaacctaaggaacgaacccaaaccggacctaaaacgtaacgtttacgaggtttacgtattccgtagaacctaaagtcgaacgtagtccctaaggacgaccggaccggtaacgggaccgacccggggttattacggttaacgtttaccgtaggggttacgtaggtagggaacgttaacgtaacggttaacggaaaccggttaaacggggtaaggtaaaccgggttaaacccggggggtaagggggtttctaagggg

SEQ ID NO: 165599 - DNA, 828 bp, Homo sapiens
  misc_feature: GYAE6OF01DZ5JJ.15.23.C01.1.454.CMB.1.raw
tcagtctacgtagccacgaccggtgctcgatttagtacacgtgattagggattggggaggtctcagagaggagccttagccctggactccaagcctttccacttggtgatcagcactgagcacagaggactcaccatggagttgggctgagcttggttttccttgttgcttatttagaaggtgtccagtgcgaggagcagctggtggagtcgtgggggagccgtggtccgaggcccggggggtccctggagcctctcctgtcgccgcctctggacctctacctttagtacgtcttagtggatgagtcgttcgggtcccgccgaggtccgtaccgggagggggtaacggggccgtaggggtaggttcgggggtacggaacccgaaaacgtaaaggtaaaaagggaaacgtaaggtacgggaaacggttaccgaaaagtaaaaccctacgtttaagtcgggttacggtacttccggtaggtaacggaaccgggtaccgtaacttaccgaacctacgttcccgtaaccgaggtaaacgaaccgtaaaccgaaccgtaaaagtaaccgttactaacggttagttaacgtccgtagtaacgtaaagttaacgaaccgtaacgtaccgtacgggaaacgggaccggtaacccgggaacggggtaacccgtaaccgggggttcccgtttaaacgggtttaaactttacccgggttgggttacggtaagggtaaccgggtaacggtaaacccgtaacggtaaacgtaaaaccgggttaaacgggtaaccgggtaaaacgggttaaaccgggggttaggggttacggttaaccgggg

SEQ ID NO: 165600 - DNA, 770 bp, Homo sapiens
  misc_feature: GYAE6OF01BKB3P.15.23.C01.1.454.CMB.1.raw
  modified_base (738)..(738): a, c, t, g, unknown or other
  misc_feature (738)..(738): n is a, c, g, or t
tcagtctacgtagccacgaccggtgctcgatttagtacacgtgattagggattggggaggtctcagagaggagccttagccctggactccaaggcctttccacttggtgatcagcactgagcacagaggactcaccatggagttggggctgagcttgggttttccttgttgcttattttagaaggtgtccagtgcgaggagcagcgtggtggagtcgtgggggacgccgtggtccgagggcccggggggtccctggacgactctccgtgtcgccgccttcgtcggacctctaacccttttaggtacgtccttagttggaatggacgtcgttcgggtcccgccgacgggtcctaccggaagggggaacgggtcgttaggggaggttcggggtacggaccaaacgtaagtaaaagggaagtaagtaggaaacgtacgaaagaaaacctacgtaagttacggtacggacttcggtagggtacggaaaccgggtccgtaactttacccgaaacctagttccccgtaaccgaaaggaaaccgaaaccccgaaaccgaacccctaaaaaggttaacctttaccgaaggtttacgttaaactcgttaacggaacttaaagtaccgaaacgtccgtaccggtagaacgggacccggaccgtaacgggaaccgaccggttccgttaagttaaccttcggtaggtacggtaggaagtacgtaactaggtacgaaaccggtacgggtanaaaccgggttaccgggggttaggttagacggg

SEQ ID NO: 165601 - DNA, 909 bp, Homo sapiens
  misc_feature: GYAE6OF01DWC1C.15.23.C01.1.454.CMB.1.raw
tcagtctacgtagccacgaccggtgctcgatttagtacacgtgattagggattggggaggtctcagagaggagccttagccctggactccaaggccctttccacttggtgatcagcactgacgcacagaggactcaccagtggagttgggctgagtcgtttgggtttttccttggttgtactttagtttttaggaaggtcgtccgtaggtcggcggaggagcgacgcgttgggtcggagtccgggtaggggggacgtcccgtcgggtcccgacggggcccgggggtccctggacgtcctcgtcgtgtcgccgtcctcgtcgtaccttaccttacgtttagtctacttagttcggatggacggtccggttcccggggtccgaccggacgggtccgtaccggggaaggggggtaacggggtccggttagggggtagggtacggggtaacccggaaaccctaaaggtaaaagggttaaaaacggaaggttaggtaacggtaaacgtaaacgaaaaacgaaacgttaaccgttaggttaccgggttaggtacccggtttcggtaagggttaaccggggaaacggttaaccccgttacttaaccgaacccttaaccgttacccgaaaccgaaggaaacccaaacccggaaacccgtaaacgtaaaccgtttacgttaccgtaagtttaaccggttcttaacgtaacgtaaaccgtaaagtaccccggtaagaccggttacggtaacggaccggaacggtaacccggggaacgaacccgggttacccgggtacgtttacgttaacggttcgtttaggggtaccggacggtaaaggtaccgtaaggtacgtaacggggtaaaccggttaagggaacggttaaacccggggtaaggggtttaagggcgtttaagggg

SEQ ID NO: 165602 - DNA, 632 bp, Homo sapiens
  misc_feature: GYAE6OF02IA3SF.15.23.C01.1.454.CMB.1.raw
  modified_base (318)..(318): a, c, t, g, unknown or other
  misc_feature (318)..(318): n is a, c, g, or t
  modified_base (443)..(443): a, c, t, g, unknown or other
  misc_feature (443)..(443): n is a, c, g, or t
  modified_base (598)..(598): a, c, t, g, unknown or other
  misc_feature (598)..(598): n is a, c, g, or t
tcagtctacgtagccacgaccggtgctcgatttagtacacgtgattagggattggggaggtctcagagaggagccttagccctggactccaaggcctttccacttggtgatcagcactgagcacagaggactcaccatggagttggggctgagctgggttttccttgttgcttattttagaaggtgtccagtgcgaggagcagctggtggagtcgtgggggagcctgggtccaggccgggggggtcctggacgactcctcctgtcgcccgcctcgtcggacctctacctttagtgcttattggatgagctgggtcccnccgaggctccgaggggaggggctgggagtgggtgaccaacagtaaaaggagataggaagtcaagaaacactatagtggacttctggtaggaacgggccgaattccgaaccaatccctacgagaanacaaacgccgaaagtaacttcgagttacgtatccttagaactaaagcggaacacggcctagaacgacggaccggaacggtaccacgggcccgttagttaacgttacgtggttagtaggaagtaggtaaccaagttcggaacgtaaccggggttanaaacgggtaaaccggggttgggggtacttaacgg

SEQ ID NO: 165603 - DNA, 543 bp, Homo sapiens
  misc_feature: GYAE6OF02HYCI6.15.23.C01.1.454.CMB.1.raw
  modified_base (305)..(305): a, c, t, g, unknown or other
  misc_feature (305)..(305): n is a, c, g, or t
  modified_base (431)..(431): a, c, t, g, unknown or other
  misc_feature (431)..(431): n is a, c, g, or t
tcagtctacgtagccacgaccggtgctcgatttagtacacgtgattagggattggggaggtctcagagaggagccttagccctggactccaaggcctttccacttggtgatcagcactgagcacagaggactcaccatggagttggggctgagctgggtttccttgttgctattttagaaggtgtccagtgcgaggagcagctggtggagtctgagggaggcctggtccagccgggggggtccctgagactctcctgtgccgcctctggactcaccttttagagctattggatgagctgggtccncgaggctccgagggaggggctgggagtgggtgccaacataaaggagatggaagtcaagaaacactatgtggactctgtagagggccgattcaccatctcagagacaacgccaagaattcagtgtanctagacaaatgaaacacgcctagagacgaccggaagaccgacgggccgtagtacttacgtaggtggtcgaggaagaccgatagacgaacggtgaacgtacgggagggttacg

SEQ ID NO: 165604 - DNA, 713 bp, Homo sapiens
  misc_feature: GYAE6OF02JGRTZ.15.23.C01.1.454.CMB.1.raw
  modified_base (709)..(709): a, c, t, g, unknown or other
  misc_feature (709)..(709): n is a, c, g, or t
tcagtctacgtagccacgaccggtgctcgatttagtacacgtgattagggattggggaggtctcagagaggagccttagccctggactccaaggcctttccacttggtgatcagcactgagcacagaggactcaccatggagttggggctgagcttgggttttccttgttgctattttagaaggtgtccagtgcgaggagcagctggtggagtcgtggggggagccgtggtccgagggcccgggggggtccctggacgcctctcctggtcgcccgcctcgtggcctctaccgttttagtacgctattggatgagcgtcgggtcccgccgaggcctccggaagggggaacggggcgtgggaggttcggggtcggacccgaaagtaagtaaaagggaagagtaggaacgtacaaagaaactacgtagtaggtaggtaacctcgtaggtagggaaaccgggtaccgtactttaccgaaccctacgtaccctaccgaaaggaacgaacccaaaccggacccgaaaagtaacttaccgtaaggttatacgtcgtagaaccttaaagtcgaaacgcggtaccgtagtacggaccgggtacccggaaagggaccccgtacgggtaccgttagtttaccgttagtggttaggtacggaagaacgactagtaacggaaccgtaacgggtgtaaacgggtaaaccgggggtgggtttanaggg

SEQ ID NO: 165605 - DNA, 561 bp, Homo sapiens
  misc_feature: GYAE6OF02FSMKI.15.23.C01.1.454.CMB.1.raw
  modified_base (527)..(527): a, c, t, g, unknown or other
  misc_feature (527)..(527): n is a, c, g, or t
  modified_base (557)..(557): a, c, t, g, unknown or other
  misc_feature (557)..(557): n is a, c, g, or t
tcagtctacgtagccacgaccggtgctcgatttagtacacgtgattagggattggggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtcgtggggggagcctggtccaggcccggggggtccctgagactctcctgtgccgcctctggacctcaccttttagagctattggatgagcgtgggtccgccgaggctccgaggggaaggggctgggagtgggtggccaacgagtaaaggaagatggaagtcaagaaacactagtgtggaactcgtagtggaagggccattcgacctatcctcgaagacaaccaacgaccaagaattcagttgtatctagactaatcgaacagcctagagacgaccggagaccgacgggccgtagtattacgtgtggtagagagacngtagacccgaggtgaagtacgggtagggtntagg

SEQ ID NO: 165606 - DNA, 761 bp, Homo sapiens
  misc_feature: GYAE6OF02HCCG6.15.23.C01.1.454.CMB.1.raw
tcagtctacgtagccacgaccggtgctcgatttagtacacgtgattagggattgggggaggtctcagagaggagccttagccctggactccaaggcctttccacttggtgatcagcactgagcacagaggactcaccatggagttggggctgagctgggttttccttgttgctattttagaaggtgtccagtgcgaggagcagctggtggagtctgagggaggcctggtccaggccgggggggtccctggacgactctccgtgtcgccgcctctggactcacctttagtagctattggatgagcgtgggtccgcaggcctccgaggggaagggcgtggaggtcggggtggccaacgagtaaaggaagacgtggaagtcagaaaacactatggtacggacctacgtggttaggaacgggggcccgtagtttcccgaaccctaagttcccttacccgaaggtaaccgaaaccgtaaacccggaccctaaaaggaacttttacccgaagggtttcggttaattccgtaggaacctaaaattcggaaaaccaacggtcccgtaaggtaacggaccggtaccccgggaaacggggaaacctaacccgggggccccggtttaggttaacttttaacggttcggggtttacgggttacggaaagggtaaccggtaacgttaaaggttcccgggaaaaccggttaaacccgggggttaagggtaaaacccgggtttaaaccggggggggttagggggttttaaccgggg

SEQ ID NO: 165607 - DNA, 990 bp, Homo sapiens
  misc_feature: GYAE6OF02F1Z6G.15.23.C01.1.454.CMB.1.raw
  modified_base (133)..(133): a, c, t, g, unknown or other
  misc_feature (133)..(133): n is a, c, g, or t
tcagtctacgtagccacgaccggtgctcgatttagtacacgtgattagggattggggaggtctcagagaggagccttagccctggactccaaggcctttccacttggtgatcagcactgagcacagaggactnaccatggagttggggctgagcgtgggttttccttgttgtctattttagaaggtgtcagtgtgaggtgcaacgtggtggagttcgtggggggacggtccgtccgtccgacgggtcccggggggggtcccctaggacgaccggttctcccgtaggtacgaacggtcccttcggttcggtaacttccgtaaccgttcggtaacggtaccttaaccgtttaaagttcgggtaagtcggtaccggttacggggttccccggtaccgtacggaccgttccggaacgggggtaaacgggggtcgtggggtaagggttcggggtacggtccccgaaccgtaacgtaaacgtaaaaaacggacgttaaggggtaaaacggttacgaaaccggtaacctaaacccggtagttaccgggtaactaaacggttcccgttaaggttaccgggaaagggttccggggtaccgttaaccgttacccgtaaaccccggtttacctaccccgggtaaaggtaaccggtaacccgggtaacccggttaacccgaaaaccgggtaacccttaaacccggtaaacccttaaccgtacgttaaccggttaccctaaacgtaaaaccgtaccgaaaacgtaaaccccggttagaaaacccgggttcgggaaacccgggacggggtaaaacccggtacccgggttaaggttaccggtaacgtttaaccgggtttaccgttcggtttaacgggtaacggtaacggggtaagttaccgggttacggtttaccggttacggggttacccgggggtttacccgggtaacccgggttaaaccgggggttacccccggttaacggtacccccgggttaaccccggg

SEQ ID NO: 165608 - DNA, 1007 bp, Homo sapiens
  misc_feature: GYAE6OF02H4MBG.15.23.C01.1.454.CMB.1.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
tcagtctacgtagccacgaccggtgctcgatttagtacacgtgattagggattggggaggtctcagagaggagccttagccctggactccaaggcctttccacttggtgatcagcactgagcacagaggactcaccatggagttgggctgagcgttgggttttccttgttgcttagttttagaaggtgtccagtgcgaggngcagcgtggtggagtcgtggagggnggccgtcggtccgacgggtcccggggggttccctggacgaccttctccgtagtccgccgtccttcgtacggtaccttcctaaccgttttaggtacggtacttagtttcggtaagtcggaacgggtccgttccggggggtaccccgacccggtaggggtccccgttaaccccgggaaagggggggtaacgggggggccgttaggggggaacggggtttcgggggggtaccgggtaaccccgtaaaaccggtaaaaggttaaaaaacggggaaaccgggtaaggttaaaccggggtaaaaggtttaaacccgaaaggtaaaaaaccccgtaacggttttaaaccgttaggggttacgggtaacccgtttaaccggttgggttaaaccgggggaaaccgggggttcccgtaaccgtttttacccaaacccccgtaacgttcccgtttaaaccccgaaaggtaacccgggaaacctaacccgggtaaacccgtaaacgtaaacgttaccggtaaggtttacggtacccttacgtaaccggaacttaaaacgtaccggaaacgttaaccgggccgttaacggggaacgtaaccgggaaccggtaaaccgggtacccggaaccccggggtttacgtttaacgggttacgttttaaacccggttcgggtttaacggtacggggttaaaccggtaagttaaccgtaagttaacccggggtaaaccggtaaccgggtttaaggggtaaaaacccggggtttacccggggtttaggggggtttaacccggg

SEQ ID NO: 165609 - DNA, 758 bp, Homo sapiens
  misc_feature: GYAE6OF02F1LSI.15.23.C01.1.454.CMB.1.raw
tcagtctacgtagccacgaccggtgctcgatttagtacacgtgattagggattggggaggtctcagagaggagccttagccctggactccaaggccctttccacttggtgatcagcactgagcacagagactcaccatggagttgggctggagcttgggttttccttgttcgactattttagaaggttgtccagtagcgaggagcgagcgtgggtggaggttcgtgggggacggtcccgtggtccgacgggtcccgggggggtccctggacgtactccgtccgtgtcgcccgtcctcgtggacctctaccgtttagtagtcttagttggagtggagtcgttcgggtcccgccgacggccgtccggaaggggacgggcgtagggcggtgggtacggacccaaaggtaagaaaggtaagtagtaggtaagtacgaaacgaaaacgtactaaggtcggtacggtacttcggtagtacgggaacgggtcccgtaagttaccgaccgtaagtccctaccgaacggaacgaacccaacggacctaaagtaacgttacgtaggttgtaccttacgtacgtaaccgtaaatacggaacgtaccgtaccgtaagggtacgggaaccggaccgggtaacgggaaacccgtacgggttaccggttaccggttacgttttacgtcggtaggttaacggaaggtacgaacgtacgtaacggaacgtaaccggtaggtaaccgggtaacgggggttacggggtttatacggg

SEQ ID NO: 165610 - DNA, 867 bp, Homo sapiens
  misc_feature: GYAE6OF02GY7JU.15.23.C01.1.454.CMB.1.raw
  modified_base (201)..(201): a, c, t, g, unknown or other
  misc_feature (201)..(201): n is a, c, g, or t
tcagtctacgtagccacgaccggtgctcgatttagtacacgtgattagggattgggggaggtctcagagaggagccttagccctggactccaaggcctttccacttggtgatcagcactgagcacagaggactcaccatgggagttggggctgagcgttgggttttccttgttgcttatttagaggtgtcagtgagaggancagcgtgggtgaggtcggtgggggagccgtcggtccgacggggtcccggggggtcctagggacgtaccgtcctccgttcggtccggccccgtcccttcgtacggtaccttacctaccgttttaggtacgtcgtttacgttggagttacggacgtaccggttccggggtccccgacgacgggtcccgtaccgggaaggggggtacgggtcggtaggggacgggttggggtccgaactaacggtaaaaggtaaaggaaaggacggtaggaaacgtacgaaacgaaacctagttaggttaacgggcggtaaccttacggttaggtaacggggtaaccgggtaccttaacgttacccgaaccttaccgttaccgaccccggaaaagaaccggaacccgttaaaacccgggccttaaaaacgggttaccttacggttaaggttaccttaacgtcgttaaccgggaaacttaaatacccgggaaccttagggacccttaaagggaacccgacggggaacccgttaccgggaaccgttccgggttaaccgttacgtttaaccgggttaccggtcggaagtaaccgggaaccgttacggtaacggtaaccggtaaacggttacggggaacgttaccgggtaaaaccggggggtttggttacgaacggtttacgg

SEQ ID NO: 165611 - DNA, 421 bp, Homo sapiens
  misc_feature: GYAE6OF01CDO96.12.69.G03.1.454.CMB.1.raw
  modified_base (420)..(421): a, c, t, g, unknown or other
  misc_feature (420)..(421): n is a, c, g, or t
tcagatacgacgtacacgaccggtgctcgatttagtcgctgcgtaaaggagaagggctggagtgggtggccaacataaaggaggatggaactaagaaatattatgtggactctgtgagggcccgattcaccgtctccagagacaacgccaagaactctctgtttctgacaatgaacagcctgagagccgaggacacggctgtatattactgtgcgcgagagcggcgtagcggttaccaaccaactactttgacttctggggccaggaaccctggtcaccgtctcctcagcctccaccaaggcccatcggtctcccctggcaccctcctccaagagcacctctgggggcacagcggccctgggctgcctggtcaaggctacttcctacgtcgtatctgagcgggctggcaaggcgcatagnn

SEQ ID NO: 165612 - DNA, 425 bp, Homo sapiens
  misc_feature: GYAE6OF01DNB85.12.69.G03.1.454.CMB.1.raw
  modified_base (337)..(337): a, c, t, g, unknown or other
  misc_feature (337)..(337): n is a, c, g, or t
  modified_base (417)..(417): a, c, t, g, unknown or other
  misc_feature (417)..(417): n is a, c, g, or t
  modified_base (423)..(425): a, c, t, g, unknown or other
  misc_feature (423)..(425): n is a, c, g, or t
tcagatacgacgtacacgaccggtgctcgatttagtcgctgcgtaaaggagaaggggctggagtgggtggccaacataaaggaggatggaactaagaaatattatgtggactctgtgagggccccgattcaccgtctccagagacaacgccaagaactctctgtttctgacaatgaacagcctgagagccgaggacacggctgtatattactgtgcgcgagagcggcgtagcggttaccaacccaactactttgacttctggggccaggaaccctggtcaccgtctcctcagcctcaccaaggcccatcggtctccccctggcaccctcctccaagngcacctctgggggcacagtggccctggctgcctggtcaaggactacttcctacgtcgtatctgagcgggctggcaaggcncatagnnn

SEQ ID NO: 165613 - DNA, 426 bp, Homo sapiens
  misc_feature: GYAE6OF01E3W30.12.69.G03.1.454.CMB.1.raw
  modified_base (425)..(426): a, c, t, g, unknown or other
  misc_feature (425)..(426): n is a, c, g, or t
tcagatacgacgtacacgaccggtgctcgatttagtcgctgcgtaaaggagaaggggctggagtgggtggccaacataaaggaggatggaactaagaaatattatgtggactctgtgagggcccgattcaccgtctccagagacaacgccaagaactctctgtttctgacaatgaacagcctgagagccgaggacacggctgtatattactgtgcgcgagagcggcgtagcggttaccaacccaactactttgacttctggggccagggaaccctggtcaccgtctcctcagcctccaccaagggcccatcggtcttccccctgcaccctcctccaagagcacctctggggcacagcggccctgggctgcctggtcaaggactacttcctacgtcgtatctgagcgggctggcaaggcgcatagnn

SEQ ID NO: 165614 - DNA, 506 bp, Homo sapiens
  misc_feature: GYAE6OF01CXTZK.12.69.G03.1.454.CMB.1.raw
  modified_base (475)..(506): a, c, t, g, unknown or other
  misc_feature (475)..(506): n is a, c, g, or t
tcagatacgacgtacacgaccggtgctcgatttagtcgctgcgtaaaggagaaggggctggagtgggtggccaacataaaggaggatggaactaagaaatattatgtggactctgtgagggcccgattcaccgtctccagagacaacgccaagaactctctgtttctgacaatgaacagcctgagagccgaggacacggctgtatattactgtgcgcgagagtcggcgtagccggttaaccaaacccaactacttttgacttcgtgggggcccaggaaccctggtccaccgtctcctcagccctccaccaacgggccccagttccggtcctttacccccctcggtacccctcctacccgaacgacgcaccctcgtcggggcacgagccggccgtcggctcgcctggtcaacggactacctttcctaacgtcgtatccgtgtacgcgggtcgtacggcgtaacgggcgacactagnnnnnnnnnnnnnnnnnnnnnnnnnnnnnnnn

SEQ ID NO: 165615 - DNA, 431 bp, Homo sapiens
  misc_feature: GYAE6OF02JBOAE.12.69.G03.1.454.CMB.1.raw
  modified_base (426)..(431): a, c, t, g, unknown or other
  misc_feature (426)..(431): n is a, c, g, or t
tcagatacgacgtacacgaccggtgctcgatttagtcgctgcgtaaaggagaaggggctggagtgggtggccaacataaaggaggatggaactaagaaatattatgtggactctgtgagggcccgattcaccgtctccagagacaacgccaagaactctctgtttctgacaatgaacagcctgagagccgaggacacggctgtatattactgtgcgcgagagcggcgtagcggttaccaacccaactactttgacttctggggccagggaaccctggtcaccgtctcctcagcctccaccaagggcccatcggtcttccccctggcaccctcctccaagagcacctctgggggcacagcggccctggctgcctggtcaaggactacttcctacgtcgtatctgagcgggctggcaaggcgcatagnnnnnn

SEQ ID NO: 165616 - DNA, 432 bp, Homo sapiens
  misc_feature: GYAE6OF02FETV2.12.69.G03.1.454.CMB.1.raw
  modified_base (428)..(432): a, c, t, g, unknown or other
  misc_feature (428)..(432): n is a, c, g, or t
tcagatacgacgtacacgaccggtgctcgatttagtcgctgcgtaaaggagaaggggctggagtgggtggccaacataaaggaggatggaactaagaaatattatgtggactctgtgagggcccgattcaccgtctccagagacaacgccaagaactctctgtttctgacaatgaacagcctgagagccgaggacacggctgtatattactgtgcgcgagagcggcgtagcggttaccaacccaactactttgacttctggggccagggaacccctggtcaccgtctcctcagcctccaccaagggccccatcggtcttccccctggcaccctcctccaagagcacctctgggggcacagcggccctggctgcctggtcaaggactacttcctacgtcgtatctgagcgggctggcaaggcgcatagnnnnn

SEQ ID NO: 165617 - DNA, 441 bp, Homo sapiens
  misc_feature: GYAE6OF02I6RZ2.12.69.G03.1.454.CMB.1.raw
  modified_base (361)..(361): a, c, t, g, unknown or other
  misc_feature (361)..(361): n is a, c, g, or t
  modified_base (416)..(416): a, c, t, g, unknown or other
  misc_feature (416)..(416): n is a, c, g, or t
  modified_base (422)..(441): a, c, t, g, unknown or other
  misc_feature (422)..(441): n is a, c, g, or t
tcagatacgacgtacacgaccggtgctcgatttagtcgctgcgtaaaggagaaggggctggagtgggtggccaacataaaggaggatggaactaagaaatattatgtggactctgtgagggcccgattcaccgtctccagagacaacgccaagaactctctgtttctgacaatgaacagcctgagagccgaggacacggctgtatattactgtgcgcgagagcggcgtagcggttaccaacccaactactttgacttcgtggggccaggaaccctggtcacgtctctcagcctccaccaggcccatcggtcttccccctggtaccctcctccagacgcaccctctcggggcacagcggccnggctgcctgtcaggactacttcctacgtcgtatctgaggcggctggacaagggcncatagnnnnnnnnnnnnnnnnnnnn

SEQ ID NO: 165618 - DNA, 509 bp, Homo sapiens
  misc_feature: GYAE6OF01BUHSB.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagtatttcacttctcaccatcagcagcctgcagcctgaagatttcgctaacttattactgtactacaagtattacaattaccctggacgttcggaccgagggacccgaaggtacggaaatacaaacgtaactcgtaggctcgcgacctacg

SEQ ID NO: 165619 - DNA, 506 bp, Homo sapiens
  misc_feature: GYAE6OF01BYQ5M.15.67.G01.1.454.CMB.1.raw
tcagtctacgtagccacgaccggtgctcgatttagagtatacatattgggtttgggggcaggagtcagacccactcagtacacagcatggacatgagggtcccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaagtggggtcccatcaaggttcagcggcagtggatctggcacagatttcactctcaccatcagcagcctgcagcctgaagtatttcgactaactttattactgtctaacaagtattacaattaccctcggtacgttcggaccgaggggaccaagggtaggaaactacgaaacgactgtaggctgcacctacg

SEQ ID NO: 165620 - DNA, 532 bp, Homo sapiens
  misc_feature: GYAE6OF01BQTIW.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccggaaagcccctaagctcctgatctgtgctgcatccactttacaagtcgggtccatcaggttcagcggcagtggatctggacacagatttcactctcaccatcagcagcctgcacgcctaggaacgtactttacgactaatttacttactcgtactaactaagtactttaacaacttacccgtcggtaccgttccggaccgacggggaaccgtaagggtacggaaactacgaaacgacgtcggtacggactgccacgtacg

SEQ ID NO: 165621 - DNA, 518 bp, Homo sapiens
  misc_feature: GYAE6OF01B2WZ0.15.67.G01.1.454.CMB.1.raw
  modified_base (424)..(424): a, c, t, g, unknown or other
  misc_feature (424)..(424): n is a, c, g, or t
  modified_base (513)..(513): a, c, t, g, unknown or other
  misc_feature (513)..(513): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctcctgtctgcatctgtaggagacagagtcaccatcacttgccgggcaagtcaggacattagaactgacttaggttggtatcagcagaaatccgggaaagcccctaagctcctgatctgtgctgcatccactttacaaagtcggggtccatcaaggttcagcggcagtgatctggcacagtatttcactctcacatcagcagcctgcagcctagaagtatttcgactaactttattactgtactanaagtattaacaacttacccgtacggtacgttccggaccgaacggggacctaagggtacggaaactcgaaaacgacgtgtcggactcgcncgtac

SEQ ID NO: 165622 - DNA, 514 bp, Homo sapiens
  misc_feature: GYAE6OF01BMVHF.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagtatttcactctcaccatcagcagcctgcagcctagaagtattttcgactaacttattactgtactaacaagtattaacaattaccctcggtacgttcggaccgaggggaccaaggtaggaaactacgaaacgtaacgtgtaggctcgcaccgta

SEQ ID NO: 165623 - DNA, 493 bp, Homo sapiens
  misc_feature: GYAE6OF01EDKIU.15.67.G01.1.454.CMB.1.raw
tcagtctacgtagccacgaccggtgctcgatttagagtatacatattgggtttgggggcaggagtcagacccactcagtacacagcatggacatgagggtcccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagccctgaagatttcgcaacttattactgtctacaagattacaacttacctcgacgttcggccaggggaccaaggtggaaatacaaacgaactgtagactgcactac

SEQ ID NO: 165624 - DNA, 483 bp, Homo sapiens
  misc_feature: GYAE6OF01ASHJX.15.67.G01.1.454.CMB.1.raw
tcagtctacgtagccacgaccggtgctcgatttagagtatacatattgggtttggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccggaaagcccctaagctcctgatctgtgctgcatccactttacaaagtggggtcccatcaaggttcagcggcagtggatctggcacagatttcactctcaccatcagcagcctgcagcctgaagatttcgcaacttattactgtctacagattacaattacctcgacgttcgcagggaccaaggtggaaatcgaaagaactgtgatgcactac

SEQ ID NO: 165625 - DNA, 524 bp, Homo sapiens
  misc_feature: GYAE6OF01C91FW.15.67.G01.1.454.CMB.1.raw
  modified_base (399)..(399): a, c, t, g, unknown or other
  misc_feature (399)..(399): n is a, c, g, or t
tcagtctacgtagccacgaccggtgctcgatttagagtatacatattgggtttgggggcaggagtcagacccactcagtacacagcatggacatgagggtcccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcaagaaatccgggaaacgcccctaagctcctgattcgtgtgctgcatcctaactttacaaaggtcgggtcccaagtcaaaggttcacgcggcagtgatcgtggcacagtactttcactctcacatcagcagcctgcngcctagatactttcgactaattctactgtactaacaagtaattacaactttacccgtggtacgttccggacgacggggacctaagggacggaaataccgaaagactgtacggctacggcacgtac

SEQ ID NO: 165626 - DNA, 586 bp, Homo sapiens
  misc_feature: GYAE6OF01BZHGJ.15.67.G01.1.454.CMB.1.raw
  modified_base (225)..(225): a, c, t, g, unknown or other
  misc_feature (225)..(225): n is a, c, g, or t
tcagtctacgtagccacgaccggtgctcgatttagagtatacatattgggtttgggggcaggagtcagacccactcagtacacagcatggacatgagggtcccgctcagctcctggggctcctgctgctctggctcccaggtgccagatgtgccatccagatgacccagtctccatcctccctgtctgcatctgtaggagacagagtcaccatcacttgccgggnaagtcaggacattagaactgacttaggttggtatcagcagaaatccgggaaacgcccctaagctcctgatctgtgctgcatcctaactttaacaaaggttcggggtacccagtaccgtaaagggttcacggtcggactaggtgggactcgtggacacgtagtactttccacttctacaccatcagcacgcctcgcagcctagaacgtatttcgactaacttattactcgtactaacaagtacttaactaacttacccgtacggtaccgttaccggaccgtaacgggggtaaccctaaaggggtacggtaaaacgtaccgtaaaacggtaacctaggttacgggactacggccaccgtaacg

SEQ ID NO: 165627 - DNA, 503 bp, Homo sapiens
  misc_feature: GYAE6OF01AM6I3.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaagtggggtcccatcaaggttcagcggcagtggatctggcacagatttcactctcaccatcagcagcctgcagcctgaagtatttcgactaacttattactgtctacaagtattaacacttacccgtggaccgttcggccgaggggaccaagggtggaaatacgaaacgacgtgtaggctgcacctac

SEQ ID NO: 165628 - DNA, 557 bp, Homo sapiens
  misc_feature: GYAE6OF01D86CH.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagtatttcgactaacttatttactgttactaactaacgtatttaaccaactttaccccgtacgggtaccgtttccgggaccctaacgggggaaccctaaagggtacgggtaaaacttaccgaaaaccgtaaccgtaggtacggacgtcgccgtaaccctaacg

SEQ ID NO: 165629 - DNA, 493 bp, Homo sapiens
  misc_feature: GYAE6OF01CSN73.15.67.G01.1.454.CMB.1.raw
tcagtctacgtagccacgaccggtgctcgatttagagtatacatattgggtttgggggcaggagtcagacccactcagtacacagcatggacatgagggtcccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaaagctcctgatctgtgctgcatcactttacaaagtggggtccatcaaggttcagcggcagtggatctggcacagatttcactctcaccatcagcagcctgcagcctgaagatttcgcaacttattactgtactacaagtattacattaccctcggacgttcggccaggggaccaaggtggaaatcaaacgaactgtaggctgcactacg

SEQ ID NO: 165630 - DNA, 561 bp, Homo sapiens
  misc_feature: GYAE6OF01ENH9N.15.67.G01.1.454.CMB.1.raw
  modified_base (226)..(226): a, c, t, g, unknown or other
  misc_feature (226)..(226): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggnaagtcaggacattagaactgacttaggttggtatcagcagaaatccgggaaagcccctaagctcctgatctgtgctgcatccactttaacaaagtggggtacccatcaaggttcagcggcagtggatctggcacagatttcacttctcaccatcagcagcctgcagcctgaagtatttcgactaactttaattactgttactaactaaagtacttaacctaactttacccctcgggtaaccgtttccgggacccgtaacgggggaacccgtaaagggtagggtaaaactaccgaaaacggaaaccgttggtacgggacttcggactaccctaacg

SEQ ID NO: 165631 - DNA, 650 bp, Homo sapiens
  misc_feature: GYAE6OF01BO7J6.15.67.G01.1.454.CMB.1.raw
  modified_base (281)..(281): a, c, t, g, unknown or other
  misc_feature (281)..(281): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctcctgtctgcatctgtaggagacagagtcaccatcacttgccgggcaagtcaggacattagaactgacttaggttgtatcagcaagaaacgtccgggaaacncccctaagcctcctgatctgtgctgctatcctaactttaacgaaaggttcgggtaccctagtacgtaaaggttcaaggcggactaggtacggtactcgtggacaacagtactttcacttctaccaacctatccgagccgacgtccgtcgacacgtccgtagaacgttactttaccgaacttaactttacttaccgttacgttacctaacgtaaacgtactttaaacccgaacgtttaccccggtacggtaaccggttcccggaacccgggtaaacgggggtaaccctaaaggggttaacggtaaaaacttaacccggaaaaacggtaaccgtttaggacgggtaacctacggtacccgaaccgttaacg

SEQ ID NO: 165632 - DNA, 498 bp, Homo sapiens
  misc_feature: GYAE6OF01B8XBK.15.67.G01.1.454.CMB.1.raw
  modified_base (491)..(491): a, c, t, g, unknown or other
  misc_feature (491)..(491): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctagaagtatttcgctaacttattactgtctacaagattacaattaccctcggacgttcggacctaggggaccaaggtacggaaatcaaacgactgtaggntgcacta

SEQ ID NO: 165633 - DNA, 576 bp, Homo sapiens
  misc_feature: GYAE6OF01BMXWL.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccggcaagtcaggacattagaactgacttaggttggtatcagcagaaatccgggaaagcccctaagctcctgatctgtgctgcatccactttaacaagtcggggtccatcgaaggttcagcggcaggtggatctggcacgagtatttcactctacacctatcagcagcctgcacgcctagaagtatttccgactaacgtttattacgtagttacctaactaagtaacttaacctaacttaccccgtacggtaccgtttccgggacccgtaacgggggaaccctaaagggtaacggtaaaactaacccgtaaaacggaaaccgttcggtacggacttacggaccgaacccgttaacg

SEQ ID NO: 165634 - DNA, 514 bp, Homo sapiens
  misc_feature: GYAE6OF01AVGOY.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtcggggtccatcaaggttcagcggcagtggatcgtggcacagtatttcactctcaccatcagcagcctgcagcctagaacgtatttcgactaacttattactcgtactaacaagtacttaacaacttacccgtcggtacgttccgacgacgggaccgaggtaggaaatacgaaacgacgtgtaggctgcacgtac

SEQ ID NO: 165635 - DNA, 659 bp, Homo sapiens
  misc_feature: GYAE6OF01ER6I8.15.67.G01.1.454.CMB.1.raw
  modified_base (200)..(200): a, c, t, g, unknown or other
  misc_feature (200)..(200): n is a, c, g, or t
  modified_base (226)..(226): a, c, t, g, unknown or other
  misc_feature (226)..(226): n is a, c, g, or t
tcagtctacgtagccacgaccggtgctcgatttagagtatacatattgggtttgggggcaggagtcagacccactcagtacacagcatggacatgaggtccccgctcagctcctggggctcctgctgctctggctcccaggtgccagatgtgccatccagatgacccagtctccatcctccctgtctgcatctgtagganacagagtcaccatcacgttgccgganaagtcaggactattagaactgtacgttaggttgtatcagacaagaaacgtaccgggaaactcccctaagcctacctgacttcgtgtcgctgcctactacctaactttaacgaacggttccgggtacctagtacgtaacggttcgacggcggacgtaggtcgactcgtcggactactagtactttcaccttctacacctatcacgcacgcctgaccagcctaggaacttctttaccgaacttaacgtttacttacgtacgttacctaacgtaaacgttacttaaccgtaaccgttaccccgtacgggttacccggttaccggaacccggtaacgggggtaaacccgttaaaggggtaacgtaaaaccgtaaccggtaaaaccggttaacccggttgggtacccggtaaccgtccggtaacctaacccgttaacg

SEQ ID NO: 165636 - DNA, 505 bp, Homo sapiens
  misc_feature: GYAE6OF01C6ZT0.15.67.G01.1.454.CMB.1.raw
tcagtctacgtagccacgaccggtgctcgatttagagtatacatattgggtttgggggcaggagtcagacccactcagtacacagcatggacatgaggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcaagaaatccgggaaagcccctaagctcctgatctgtgctgcatccactttacaagtggggtcccatcaaggttcagcggcagtggatctggcacagatttcactctcacatcagcagctgcagctgaagtatttcgactaactttattacttgtactataagtattaacattaccctcggtacgtcggccgaggggaccaaggtaggaaataccgaaagacgtacgtaggctgccactaacg

SEQ ID NO: 165637 - DNA, 555 bp, Homo sapiens
  misc_feature: GYAE6OF01DPSWB.15.67.G01.1.454.CMB.1.raw
tcagtctacgtagccacgaccggtgctcgatttagagtatacatattgggtttgggggcaggagtcagacccactcagtacacagcatggacatgagggtcccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccatttacaagtgggtccatcaagttcagcggcagtgatctggcacagtatttcactctcaccatcagcagcctgcagcctagaagtatttcgactaactttattacctgttactaacaagtactttacaactttacccgtacgggtaccgtttccgggacccgaagggggtaacccgtaaagggtacggaaaacgtaaccgaaaacggtaaaccgttaggtacgggtaccgtacggcctaaccgtaacg

SEQ ID NO: 165638 - DNA, 559 bp, Homo sapiens
  misc_feature: GYAE6OF01CVHON.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgttgcatccactttacgaagtcgggtacccatcaaggttcagcgcagtggatctggcacagtatttcaactctcaccatcagcagcctgcagcctgaagtatttcgactaactttattactgtactaactaatacttaactaacttacccgtcggtaaccgtttccggaccgtagggggaacccgtaaaggggtaggtaaaactaccgaaaacggtaacgttaggttacggacttggaacctaacccgtacgttacccgg

SEQ ID NO: 165639 - DNA, 539 bp, Homo sapiens
  misc_feature: GYAE6OF01CDOYK.15.67.G01.1.454.CMB.1.raw
  modified_base (358)..(358): a, c, t, g, unknown or other
  misc_feature (358)..(358): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgttctgcatctgtaggagacagagtcaccatcacttgccgggcaagtcaggacattagaactgacttaggttggtatcagcagaatccggaagcccctaagctcctgatctgtgctgcatccactttacaagtcggggtcccatcgaaggttcagcggcaggtggatctggcanagtatttccacttctcaccatcagcagcctgcagcctgaatcgtttacgctaactttattactgtctaacaagtattaacaacttacccgtcggacgtttcggaccgtaacggggacctaagggtacggaaacttaccgaaaacggtaaccgttaggtacggaccgtgcccaaccgttacg

SEQ ID NO: 165640 - DNA, 537 bp, Homo sapiens
  misc_feature: GYAE6OF01CEWVS.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaaggtcgggtccatcaaggtcagcggcagtggatcgtggcacagtatttcacttctcaccatcagcagcctgcagcctagaagtctttcgactaacttattactgtactaacaagtacttaacacgttacccgtcggtacgttccggaccgtacggggaacctaagggtacggaaactacgaaaacgtacgttaggtacggtactacggcctaaccgtacg

SEQ ID NO: 165641 - DNA, 546 bp, Homo sapiens
  misc_feature: GYAE6OF01EFW64.15.67.G01.1.454.CMB.1.raw
  modified_base (227)..(227): a, c, t, g, unknown or other
  misc_feature (227)..(227): n is a, c, g, or t
  modified_base (450)..(450): a, c, t, g, unknown or other
  misc_feature (450)..(450): n is a, c, g, or t
tcagtctacgtagccacgaccggtgctcgatttagagtatacatattgggtttgggggcgaggagtcagacccactccagtacacagcatggacatgagggtccccgctcagctcctggggctcctgctgctctggctccaggtgccagatgtgccatccagatgacccagtctccatcctccctgtctgcatctgtaggagacagagtcaccatcacttgccgggnaagtcaggacattagaactgacttaggttgtatcagcaagaatccggaaagcccctaagctcctgatcgtgtgctgcatcctaacttttacaaaggttcggggtacccagtacgtaaaggttcaaggcggacaggtggactcgtggcacagtatttcactctacactatcaagcagcctgcagcctagaagtatttcgactaactttagttactgttactaanaagtattacctaacttacccgtcggtacgttccggaccgtaaggggaccctaagggtagtaaactacgaaacacgttggtacgactacgctactac

SEQ ID NO: 165642 - DNA, 548 bp, Homo sapiens
  misc_feature: GYAE6OF01CEQ5R.15.67.G01.1.454.CMB.1.raw
  modified_base (333)..(333): a, c, t, g, unknown or other
  misc_feature (333)..(333): n is a, c, g, or t
tcagtctacgtagccacgaccggtgctcgatttagagtatacatattgggtttggggcaggagtcagacccactcagtacacagcatggacatgagggtccccgctcagctcctggggctcctgctgctctggctcccaggtgccagatgtgccatccagatgacccagtctccatcctcctgtctgcatctgtaggagacagagtcaccatcacttgccggcaagtcaggacattagaactgacttaggtgtatcagcagaaatccggaaagcccctaagctcctgatctgtgctgcatccatttacaaagtgggtccatcaggttcagcgnagtgatctggcacagatttcatctcacatcagcagctgcagcctgaagtactttcgactaaactttattcgctttacgtacttaacgaaagtaattaacaaactttacccgttacggaccgtttacgggacccgaacggggtaccctaaaacgggtagggaaaacttaacgaaaaacggtaaaccgttaggtacgggacttacggctaaaccccg

SEQ ID NO: 165643 - DNA, 557 bp, Homo sapiens
  misc_feature: GYAE6OF01ENUQN.15.67.G01.1.454.CMB.1.raw
tcagtctacgtagccacgaccggtgctcgatttagagtatacatattgggtttggggcgaggagtcagacccactccagtacacagcatggacatgaggtcccgctcagctcctgggctcctgctgctctggctcccaggtgccagatgtgccatccagatgacccagtctccatcctccctgtctgcatctgtaggagacagagtcaccatcacttgccgggcaagtcaggacattagaactgacttaggttgtatcagcagaaatccggaaagcccctaagctcctgatctgtgctgcatccactttacaaagtgggtcccatcaaggttcagcggcagtggatctggctacagtatttcactctcacatcagcagcctgcagcctgagatttcgactaattattactgtactacaagtatttaaccaactttaccctacgggtaccgtttccgggaccctaacgggggaaccctaaaggggttacggaaaacgttaccgaaaaaccggtaaccttagggtaacgggtcctttcggacctaaaccccggttaacg

SEQ ID NO: 165644 - DNA, 564 bp, Homo sapiens
  misc_feature: GYAE6OF01ATPQP.15.67.G01.1.454.CMB.1.raw
  modified_base (226)..(226): a, c, t, g, unknown or other
  misc_feature (226)..(226): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggnaagtcaggacattagaactgacttaggttggtatcagcagaaatccgggaaacgcccctaagctcctgatctgtgctgcatccactttaacaaaggtcggggtaccatcaaggttcagcggcaggtgatcgtggcactagtacttcactctcacctatcagcacgcctcgcacgtcctagaacgtactttcgacttaacttacttaacttcgtactaacaagttacttaactaactttacccgtacggtacgttaccggaccggaacggggtaaccgtaagggtaacggtaaactaccgaaaaccggtacgtacggtacggacgtacgccaacgtacg

SEQ ID NO: 165645 - DNA, 546 bp, Homo sapiens
  misc_feature: GYAE6OF01A2NUB.15.67.G01.1.454.CMB.1.raw
  modified_base (225)..(225): a, c, t, g, unknown or other
  misc_feature (225)..(225): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccggnaagtcaggacattagaactgacttaggttggtatcgagcagaaacgtccgggaaacgcccctaagcctcctgatctgtgctgcatccactttacgaagtcggggtacccatacaaggttcagcggcagtgatctgcacagtattcactctcaccatcagcacgcctgcacgcctagtaagtactttcgactaacttattacttgtactacaagtactttaactaacttacccgtcggtaccgttccggtaccgtacggggaacctaagggtacggtaaactaccgaaaacgtacgttacggtaggactcgaccacgttacg

SEQ ID NO: 165646 - DNA, 549 bp, Homo sapiens
  misc_feature: GYAE6OF01CAT4K.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatcctactttacaagtcgggtaccatcaaggttcagcgcagtgatcgtggcacagtatttcactctcacctatcagcagcctgcacgcctagaacgtactttacgactaactttattactagttactaactaaagtacttaactaacttaccccgtacggtacgttccggaccggaacggggtaacctaagggtaggtaaactacgaaaacgtacgtacggtacggtctacggaccaccgtaacg

SEQ ID NO: 165647 - DNA, 788 bp, Homo sapiens
  misc_feature: GYAE6OF01EM6NB.15.67.G01.1.454.CMB.1.raw
  modified_base (145)..(145): a, c, t, g, unknown or other
  misc_feature (145)..(145): n is a, c, g, or t
  modified_base (149)..(149): a, c, t, g, unknown or other
  misc_feature (149)..(149): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtcncagntgtcgacactccgagataccgaacctagtcctacctacttcccttccgttgtctcgactactcgttaggtaagggacgaacgaaggtacgtaccaacctactacctacgttccgggaccgggaacgtaacgtacggaacggtaactaagttaaacgaaccgtaggttaacgtttaggggttacgttactacgagacaaaaggtaaccggtaaccggggaaaccgtacccctaaggtcccttacgtagtacttcgtggtcgtctcgaccttactacccttaacgtttaaacggaacggggttccggtaccctaagttaacggtaacggttacacgggccggtaggtacggtacggtactcggtacggacctaaacgtacgtttactttaccctacttacctaaccacctacgtaacgacgtacgaccgtccgacgtacgtaccgtcgtaagtaacgttcttaaccgaacttaactttacgttacgtcgttaacctaaacgtaacgtaactttaacctaacccgttacccgtaccgggttacggttacccgaacgggtaacggggtaaccgttaaggggtaactaaaaccgtaccgaaaacggttacgtacgggtacgttacgcggtaaacccacgttacg

SEQ ID NO: 165648 - DNA, 545 bp, Homo sapiens
  misc_feature: GYAE6OF01DM7AX.15.67.G01.1.454.CMB.1.raw
  modified_base (299)..(299): a, c, t, g, unknown or other
  misc_feature (299)..(299): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctcctgtctgcatctgtaggagacagagtcaccatcacttgccgggcaagtcaggacattagaactgacttaggttggtatcagcagaaatccgggaaagcccctaagctcctgatctgtnctgcatccactttacaaagtcggggtacccatacaagttcagcggcagtgatctggcacagtatttcactctcaccatcagcacgcctgcacgcctagaagtactttcgactaactttattaactgtactacaaagtacttaactaacttacccgtcggtaccgttccggaccgaacggggtaaccgtaaggtaacggaaactaccgaaaacgaacgttacggtacggacctacgccaccgtaacg

SEQ ID NO: 165649 - DNA, 558 bp, Homo sapiens
  misc_feature: GYAE6OF01CPNGH.15.67.G01.1.454.CMB.1.raw
tcagtctacgtagccacgaccggtgctcgatttagagtatacatattgggtttgggggcaggagtcagacccactcagtacacagcatggacatgagggtcccgctcagctcctggggctcctgctgctctggctcccaggtgccagatgtgccatccagatgacccagtctccatcctccctgtctgcatctgtaggagacagagtcaccatcacttgccggcaagtcaggacattagaactgacttaggttggtatcagcagaaatccgggaaagcccctaagctcctgatctgtgctgcactccacttttacaaaggtcgggtcccaatcgaaggttcagcgacagtgatcgtggcacagtacttcactctcaccatcagcacgctgcagcctagaacgtactttcgactaacgtttacttactcgttactaacgtaaacgtaattttaaccaactttaccccgtacggttaccgttaccgggtaccgaaggggtaaccaagggtaacggaaacttacgaaaacgtacgtagttacggacttcgacgtacctacg

SEQ ID NO: 165650 - DNA, 528 bp, Homo sapiens
  misc_feature: GYAE6OF01AZS79.15.67.G01.1.454.CMB.1.raw
tcagtctacgtagccacgaccggtgctcgatttagagtatacatattgggtttgggggcaggagtcagacccactcagtacacagcatggacatgagggtcccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtccatcaaggttcagcggcagtgatcgtggcacagatttcactctcacatcagcagcctgcagcctagaagtatttcgactaacttattactgtactaacaagtacttaacaacttaccccgtacggtaccggttccggaccgaacggggtaaccgtaagggtacggaaactacgaaaacgtactacggtaggactgccactacg

SEQ ID NO: 165651 - DNA, 542 bp, Homo sapiens
  misc_feature: GYAE6OF01A9YKI.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaacgcccctaagcctcctgatctgtgctgcatccactttacgaaagtcggggtacccatcgaaggttcagcggcaggtggatcgtggcacagtactttcacttctcaccatcagcacgcctgcacgcctagaacgtactttcgaccttaactttattacttgtactaactaagtacttaactaacttacccgtcggtaccgttcggaccgacgggaccgtaagggtacggaaactacgaaacgacgtgtacggactcgcacctacg

SEQ ID NO: 165652 - DNA, 544 bp, Homo sapiens
  misc_feature: GYAE6OF01EL1QU.15.67.G01.1.454.CMB.1.raw
  modified_base (224)..(224): a, c, t, g, unknown or other
  misc_feature (224)..(224): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagatcaccatcacttgccggnaagtcagacattagaactgacttaggttggtatcagcagaatccgggaaagcccctaagctcctgatctgtgctgcatcctacttacaagtgggtccatcaaggttcagcggcagtggatcgtggcacagtactttccacttcctaccacctactacgagacgagtccctagccagtccctagaacgtctttccgactaacttattactgtactaacgtaatacttaactaacttaccccgtaggtaccgttccggaccgtacgggtaaccgtagggtagtaaactacgaacgtaacgtgtacggactacgccactaccg

SEQ ID NO: 165653 - DNA, 546 bp, Homo sapiens
  misc_feature: GYAE6OF01CLDGW.15.67.G01.1.454.CMB.1.raw
  modified_base (224)..(224): a, c, t, g, unknown or other
  misc_feature (224)..(224): n is a, c, g, or t
  modified_base (277)..(277): a, c, t, g, unknown or other
  misc_feature (277)..(277): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcacatcacttgccggnaagtcaggacattagaactgacttaggtggtatcagacagaactccgggaaancccctaagcctcctgatctgtgctgcatcctaactttacgaaaggttcgggtacccatacgtaaggttcaggcgcaggtggatcgtggacacagtatttccacttctaccactatcagcacgcctacgcagtccgtagaacgtattcgactaacttattactgtactacaagtattaactacttacccgtcggtacgttccggaccgtacgggaacctaagggtaggaaactaccgaaaacgtacgtaggtacgctacgcctaccgtac

SEQ ID NO: 165654 - DNA, 566 bp, Homo sapiens
  misc_feature: GYAE6OF01D8M04.15.67.G01.1.454.CMB.1.raw
  modified_base (370)..(370): a, c, t, g, unknown or other
  misc_feature (370)..(370): n is a, c, g, or t
tcagtctacgtagccacgaccggtgctcgatttagagtatacatattgggtttgggggcaggagtcagacccactcagtacacagcatggacatgagggtccccgctcagctcctgggggctcctgctgctctggctcccaggtgccagatgtgccatccagatgacccagtctccatcctcctgtctgcatctgtaggagacagagtcaccatccacttggccgggcaagtcaaggacattagaactgacttaggttggtatcagcaagaataccgggaaagcccctaagcctctgactctgtgctgcatcctactttacaaagtcggggtaccagtcaaggttcaggcggcaggtgactcgtggacanagtattcactctcacatcagcacgcctgcgagtcctagtaacgtactttacgactaactttattaccttgtacctaaataacgtacttaactaactttacccgtacgggtaccgttccggaccggtacgggaaccgtaagggtaaggaaacgtaaccgaaacgtacgtaggtacggaccgtacggctaccgtaacg

SEQ ID NO: 165655 - DNA, 556 bp, Homo sapiens
  misc_feature: GYAE6OF01B333J.15.67.G01.1.454.CMB.1.raw
tcagtctacgtagccacgaccggtgctcgatttagagtatacatattgggtttgggggcaggagtcagacccactcagtacacagcatggacatgaggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaatccgggaagcccctaagctcctgatctgtgctgcatcctactttacaaagtcggggtcccagtcaaggttcagcgcgagtggactcgtggcacgagtactttcactctacacctatcacgcacgcctcgcagcctagaacgtatttccgactaacttacttactgtacctaactaagtacttaacctaacttaccccgtcggtaccgttccgggaccgtaacggggacctaaaggggtacggaaacgtacgaaaacggtaacgttggtacggactcgtccgaccgtacg

SEQ ID NO: 165656 - DNA, 527 bp, Homo sapiens
  misc_feature: GYAE6OF01A3B0U.15.67.G01.1.454.CMB.1.raw
  modified_base (422)..(422): a, c, t, g, unknown or other
  misc_feature (422)..(422): n is a, c, g, or t
tcagtctacgtagccacgaccggtgctcgatttagagtatacatattgggtttgggggcaggagtcagacccactcagtacacagcatggacatgagggtccccgctccgctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaagtgggtccatcaagttcagcgcagtggatctggcacagtatttcactctcacatcagcagcctgcagcctgaagtactttcgactaacttattactagtcctaanaagtattaactaacttacccgtcggtacgttcggacccgaggggaaccgtaagggtaggaaatacgaaaacgtaatcggtacggactagcccaaccgtattaccg

SEQ ID NO: 165657 - DNA, 531 bp, Homo sapiens
  misc_feature: GYAE6OF01BM338.15.67.G01.1.454.CMB.1.raw
  modified_base (279)..(279): a, c, t, g, unknown or other
  misc_feature (279)..(279): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaancccctaagctcctgatctgtgctgcatcctaactttacaaagtggggtcccatcaaggttcagcggcagtgatcgtggcacagtatttcacttctcaccatcagcagcctgcagcctagaatatttcgactaacttattactgtactaacaagtattaacaacttacccgtacggtaccgttcggaccgtacggggaaccaagggtacgaaactacgaaaacgacgtacggtacgacgtcgccgtacctacg

SEQ ID NO: 165658 - DNA, 533 bp, Homo sapiens
  misc_feature: GYAE6OF01BRDCE.15.67.G01.1.454.CMB.1.raw
  modified_base (226)..(226): a, c, t, g, unknown or other
  misc_feature (226)..(226): n is a, c, g, or t
  modified_base (370)..(370): a, c, t, g, unknown or other
  misc_feature (370)..(370): n is a, c, g, or t
  modified_base (443)..(443): a, c, t, g, unknown or other
  misc_feature (443)..(443): n is a, c, g, or t
  modified_base (525)..(525): a, c, t, g, unknown or other
  misc_feature (525)..(525): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggnaagtcaggacattagaactgacaggtttttttggatcagcagaaagtaccgggaaacgcccctaagctcctgatctgtgctgcatcctactttaacaaaggtcgggtaccatacaaggttcaggcggcagtggatcgtaggcanagtatttacgactctcacatcaagcagcctgcacgcctagaagtactttcgactaacttattactgtactaanaagttataacctaacttacccgtcgtacggttcgaccggaacgggacgtaaggtagtaaacacgaaacgacgtagtacgacncgcactac

SEQ ID NO: 165659 - DNA, 512 bp, Homo sapiens
  misc_feature: GYAE6OF01CMS2P.15.67.G01.1.454.CMB.1.raw
  modified_base (356)..(356): a, c, t, g, unknown or other
  misc_feature (356)..(356): n is a, c, g, or t
  modified_base (373)..(373): a, c, t, g, unknown or other
  misc_feature (373)..(373): n is a, c, g, or t
  modified_base (430)..(430): a, c, t, g, unknown or other
  misc_feature (430)..(430): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgtacttaggttggtatcagcagaaatccgggaaagcccctaagctcctgatctgtgctgcatcctactttacaaaggtcggggtccatacaaggttcagcggcagtgatcnggcacagtattcactcncacatcagcacgcctgccagcctagaagtatttcgacttaacttattactgtactanaagtattaacacttaccgtcggtacgttccggacgacggggaccaagggtagaaactacaaagactggcgactcgcacgtac

SEQ ID NO: 165660 - DNA, 712 bp, Homo sapiens
  misc_feature: GYAE6OF01CNV3F.15.67.G01.1.454.CMB.1.raw
  modified_base (230)..(230): a, c, t, g, unknown or other
  misc_feature (230)..(230): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggcctcccaggtgccagatgtgccatccagatgacccagtctccatcctcctgtctgcatctgtaggagacagagtcaccatcacgttcggccggganaagtcaggacattagaactgtacttaggtgtatcgagacaagaaacgtaccgggaaacgcccctaagccttccgtgacttcgtgtgctcgactactaccctaactttaacgaaggttcgggtaccctagtaccgtaagggttcacgggtcggacgtaggtacggtactcggtaggactaacgacgttacttccaaccttctaccaacctagtacgaacgctacgtcctacgaccgtacgtccgtaagtaacgttacgttttacgaacctttaaaccgttttacttaaccgttacgttaacctaaacgttaaaggttaacctttaaaccgtaacccgtttaaccccggtacgggttaaccccggttacccgggaaaccgggtaaaccgggggtaaaccggttaaacggggtaaacgtaaaacgttaacccgaaaacggttaccgttacgggttacgaccgttacgacccttaaccgttaaccg

SEQ ID NO: 165661 - DNA, 734 bp, Homo sapiens
  misc_feature: GYAE6OF01A3DU1.15.67.G01.1.454.CMB.1.raw
tcagtctacgtagccacgaccggtgctcgatttagagtatacatattgggtttgggggcaggagtcagacccactcagtacacagcatggacatgagggtcccgctcagctcctggggctcctgctgctctggctcccaggtgccagatgtgccatccagatgacccagtctccatcctccctgtctgcatctgtaggagacagagtcaccatcacttggccgggcaagtcaggacattagaactgacttaggttggtatcagacaagaaacgtaccgggaaacgcccctaagcctcctagactctgtgtctgctactcctaactttaacgaaacggttcggggtaccctaagtacgtaaacgggttcaggaccggacgtaacggtcggtaacgtcgttacgggacctaacgtaacggttaactttacccaacttccctacctaaccctaacgttacccgaacggtaccaacggtcccttacggaccgtaacggtcccgttaaggtaaaccgttacgttttaccggaacctttaaaccgttttaacttaaccgttacggttaccttaaaccgtaaagttaacttaaaccttaaccgtttaccccggtacgggttaccgttaccgggaacccggtaaacggggtaacccgtaaggggttaacggtaaaccgttaaaccgaaaaccggttaacggtacgggttaccggtacgttaccggtacccgtaaccgtaccg

SEQ ID NO: 165662 - DNA, 554 bp, Homo sapiens
  misc_feature: GYAE6OF01D4Y1G.15.67.G01.1.454.CMB.1.raw
  modified_base (225)..(225): a, c, t, g, unknown or other
  misc_feature (225)..(225): n is a, c, g, or t
  modified_base (278)..(278): a, c, t, g, unknown or other
  misc_feature (278)..(278): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccggnaagtcaggacattagaactgacttaggttggtatcagcagaaatccgggaaancccctaagctcctgatctgtgctgcatccatttacaaaggtcgggtacccatcaagttcagcggcagtggatcgtggcacgagtatttcactctacactatcagcacgcctgcagcctagaacgttatttccgacttaacgtttattacgtcgttactaacaagttacttaacactttacccgtcgggtaccgttccgggaccgtacggggtaaccgaaggttacggaaactaaccgaaacgtaacgttcggacggtacgtcgccaaccgttaacg

SEQ ID NO: 165663 - DNA, 606 bp, Homo sapiens
  misc_feature: GYAE6OF01DHG80.15.67.G01.1.454.CMB.1.raw
  modified_base (199)..(199): a, c, t, g, unknown or other
  misc_feature (199)..(199): n is a, c, g, or t
  modified_base (223)..(223): a, c, t, g, unknown or other
  misc_feature (223)..(223): n is a, c, g, or t
  modified_base (271)..(271): a, c, t, g, unknown or other
  misc_feature (271)..(271): n is a, c, g, or t
  modified_base (448)..(448): a, c, t, g, unknown or other
  misc_feature (448)..(448): n is a, c, g, or t
tcagtctacgtagccacgaccggtgctcgatttagagtatacatattgggtttgggggcaggagtcagacccactcagtacacagcatggacatgagggtcccgctcagctcctggggctcctgctgctctggctcccaggtgccagatgtgccatccagatgacccagtctccatcctcctgtctgcatctgtagganacagagtcaccatcacttgccggnaagtcagacattagactgacttaggtgtatcagcagaatcgggaaacnccctaagctcctgatcgtgtgctgcatcctaactttacgaaacggtcggggtacccaagtacgtaagggttcaaggtcggcaggtggtatccgttgggacctagagtactttacactctacaaccatcaacgtcacggtcctgcacgtcctagaagttacttacgacttaaactttnttaaccttcgttaactaacgtaacgtaatttaacccgtaacttacccgtacggtaccggttaccgggacccgtaacgggggaaccctaaagggtaacggtaaacgtaaccgaaaacggtaaccgttcgggtacggtacctacggacctaccgttaacg

SEQ ID NO: 165664 - DNA, 513 bp, Homo sapiens
  misc_feature: GYAE6OF01A7MZT.15.67.G01.1.454.CMB.1.raw
  modified_base (375)..(375): a, c, t, g, unknown or other
  misc_feature (375)..(375): n is a, c, g, or t
tcagtctacgtagccacgaccggtgctcgatttagagtatacatattgggtttgggggcaggagtcagacccactcagtacacagcatggacatgaggtccccgctcagctcctggggctcctgctgctctggctcccaggtgccagatgtgccatccagatgacccagtctccatcctccctgtctgcatctgtaggagacagagtcaccatccacttgccgggcaagtcaggacattagaactgacttaggttggtatcagcagaaatccgggaaagcccctaagctcctgatctgtgctgcatccactttacaagtggggtcccatcaaggttcagcgcagtggatcgtggcacagtatttcactctcaccntcagcagcctgcagctagagtacttcgactaacttattactgtactacaagtattaactacttaccgtcggtacgttccgaccggagggaccgaaggtacggaactaccgaaacgtacgtggtgaccgtcgcacgtac

SEQ ID NO: 165665 - DNA, 517 bp, Homo sapiens
  misc_feature: GYAE6OF01COHJ8.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtcggggtccagtcaaggttcagcggcagtggatctggcacagtatttcactctcaccatcagcacgcctgcacgcctagaagtactttcgactaactttattacctgtacctacaagtacttacacttacccgtcggtacgttccggaccgaggggaccaaggtaggaaatacaaacgacgtgtaggatcgcactacg

SEQ ID NO: 165666 - DNA, 581 bp, Homo sapiens
  misc_feature: GYAE6OF01EYCX2.15.67.G01.1.454.CMB.1.raw
  modified_base (426)..(426): a, c, t, g, unknown or other
  misc_feature (426)..(426): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatcctaactttacgaaagtcggggtacccatcgaaggttcagcggcagtggatctggcacagtatttcactctcacatcagcagcctgcacgtcctagaacgtactttacgactaaactttnttaacgtgttactaacaaagttacttaactaacgtttaccccgtacgggtaccgtttccggaccgtaacggggtaacccgtaaagggttacggaaaacttaccggaaaaaccgtaaccgttacgggtaggtcccttacggaccctaaccttaacg

SEQ ID NO: 165667 - DNA, 590 bp, Homo sapiens
  misc_feature: GYAE6OF01BCFJK.15.67.G01.1.454.CMB.1.raw
  modified_base (224)..(224): a, c, t, g, unknown or other
  misc_feature (224)..(224): n is a, c, g, or t
  modified_base (277)..(277): a, c, t, g, unknown or other
  misc_feature (277)..(277): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctccaggtgccagatgtgccatccagatgacccagtctccatcctcctgtctgcatctgtaggagacagagtcaccatcacttgccgggnaagtcaggacattagaactgacttaggttggtatcagcagaaatccgggaaancccctaagctcctgactctgtgctgcactcctaacttttaacgaaaacggtcgggggttacccagttacgaaagggttccaggcgggctaaggtggaactcgtggcacagtatttcactctacaccatcagcagcctgcagcctagaacgtactttcgactaacgtttattacgtgttacctaactaacgtaacttaactaactttacccgtacgggtacgttaccggaccggtaacggggtaaccgtaagggtaacggtaaaactaccgaaaacggtaacttcgggtacggtactcggccctaacgtaaccg

SEQ ID NO: 165668 - DNA, 642 bp, Homo sapiens
  misc_feature: GYAE6OF01BPAHA.15.67.G01.1.454.CMB.1.raw
  modified_base (327)..(327): a, c, t, g, unknown or other
  misc_feature (327)..(327): n is a, c, g, or t
  modified_base (463)..(463): a, c, t, g, unknown or other
  misc_feature (463)..(463): n is a, c, g, or t
  modified_base (479)..(479): a, c, t, g, unknown or other
  misc_feature (479)..(479): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgcccagagtcgtagccaaggtccgaccgaagtaggacccctaggtaccgtcccggacttcccggtccctaagggtccgtcgactaagtctgtaggagacgagtagtccaccatccgacgttcgccgggacaagtccaggacattacgaactgtacttaggtgtatcagcaagaactcggaaacncccctaagcctctgactcgtgtcgctgacacttacctaacgtttaacgaacggtccggtacccagtaccgtaaggttccaaggcgtacaggttcggaatcgtacggcaacgagttactttacactctacaacctcncgaacgtcgacgtccncgtacgacgtaccgtagtaacgtacgttactaaccttaacgttacgttacgtacgtactaacgtaacgttacttaactaccgttacccgtcggtaccgtacggaccggaacggacgtaaggtacgtaacgtaacgaacgtacgtcgtacgactcgacctgtac

SEQ ID NO: 165669 - DNA, 646 bp, Homo sapiens
  misc_feature: GYAE6OF01CPDJ7.15.67.G01.1.454.CMB.1.raw
  modified_base (220)..(220): a, c, t, g, unknown or other
  misc_feature (220)..(220): n is a, c, g, or t
  modified_base (240)..(240): a, c, t, g, unknown or other
  misc_feature (240)..(240): n is a, c, g, or t
  modified_base (408)..(408): a, c, t, g, unknown or other
  misc_feature (408)..(408): n is a, c, g, or t
tcagtctacgtagccacgaccggtgctcgatttagagtatacatattgggtttgggggcagggagtcagacccactcagtacacagcatggacatggacgggtccccgctcagctccgtgggggctcctgctgctctggcctcccaggtgccagatgcgccagtccagagtcgaccctagtcctccactcctccctggcctgacatcgtgaggagacagntccacatcacgtggccgganaagtcgaagtatattaacgaactgtagttaggttggactgagacaaggtaaacgtccggggaaactcccctaagcctacctgatcgtgtcgctagaccataccctaattaacgaaggtccggaccagtaacgtaaggtcaggccgagtagtggactcggtagacctanagtacttcaaccttcaccaactgacaacgcgtacggtcctgaccgacgtaccgtaagaacggttactttacgaaccttaaccttttagaaccttcgttaacaacgtaaacgttaacttaacctaacgtttacccccgaaggttaccggtaccggtaaccgggaacgggtaaacggtaagggtacgtaaacgtaaccgaaaacgtacgttacggacgtaggtacgaccgtaactaccgg

SEQ ID NO: 165670 - DNA, 550 bp, Homo sapiens
  misc_feature: GYAE6OF01B6KPB.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagcctcctgatctgtgctgcatccactttacaaagtggggtcccatcaaggttcagcggcagtggatctggcacagtatttcactctcaccatcagcagcctgcagcctgaagtctttcgctaacttattactcgtactaacaagtacttaactaacttaccccgtacggtaccgttaccggccggtaacggggtaacccgtaagggtacggaaaacgtaccgaaaacggtaaccgtacggtacgggactcggaccaccgtaacg

SEQ ID NO: 165671 - DNA, 510 bp, Homo sapiens
  misc_feature: GYAE6OF01BG2W9.15.67.G01.1.454.CMB.1.raw
  modified_base (502)..(502): a, c, t, g, unknown or other
  misc_feature (502)..(502): n is a, c, g, or t
tcagtctacgtagccacgaccggtgctcgatttagagtatacatattgggtttgggggcaggagtcagacccactcagtacacagcatggacatgagggtcccgctcagctcctggggctcctgctgctctggctcccaggtgccagatgtgccatccagatgacccagtctccatcctccctgtctgcatctgtaggagacagagtcaccatcacttgccggcaagtcaggacattagaactgacttaggttggtatcagcagaaatccggaaagcccctaagctcctgatctgtgctgcatccactttacaagtgggtccatcaaggttcagcggcagtggatctggcacagtactttcactctcaccatcagcagcctgcacgcgtagaagtctttcgactaactttattactgtctaacaagtacttacaacttacccgtcggtacgttcggccgaacggggaccaagggtagaaactacgaaacgactcgaggactncgactacg

SEQ ID NO: 165672 - DNA, 582 bp, Homo sapiens
  misc_feature: GYAE6OF01ERCL8.15.67.G01.1.454.CMB.1.raw
  modified_base (225)..(225): a, c, t, g, unknown or other
  misc_feature (225)..(225): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctcctgtctgcatctgtaggagacagagtcaccatcacttgccgggnaagtcaggacattagaactgacttaggtggtatcagcaagaaatccgggaacgccccaagctcctgatctgtgctgcatcctaactttaacaaaggtcggggtaccatacgtaaggttcaggccggcgtaggtaggtatcgtggacacagtactttcactctacaccatcacgcacgcctgaccacgtcctagaacgttctttcgacttaactttattacttcgtaacctaaactaagttaactttaacctaaccgtttacccgtacgggtaccgttacgggacccggtacgggtaaccgtaagggtaacggaaacgtaaccgaaaacgtaacgtcggtacggatcggactccgtag

SEQ ID NO: 165673 - DNA, 631 bp, Homo sapiens
  misc_feature: GYAE6OF01BO09P.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatcgacccagtctccatccctccctgtctgcatctgtaggagacagagtcacatcacttggccgggcaagtcaggacattagaactgtacttaggttgtatcagacaagaaacgtaccgggaaacgcccctaagcctaccgtgtactcgttgtcgcctgactacttacctaactttaacgaaaggtcgggtacccaatacgaagtccagcggactaggtgtatcgtgacacgtagtactttcactactcaacatcagtacacgccgtgaccagtccgtaagtaacgtactttacgaacttaaactttacttaacgttacgtaaccgtaactaaacgttaactttaaccgtaacctttacccggtcgggtaaccgttccggtaacccgggaacggggtaacccgtaaaggggttacgaaaacgttaccgaaaacgtaacgttcggtacggacctacggacccgtatacccg

SEQ ID NO: 165674 - DNA, 565 bp, Homo sapiens
  misc_feature: GYAE6OF01BOPXI.15.67.G01.1.454.CMB.1.raw
  modified_base (360)..(360): a, c, t, g, unknown or other
  misc_feature (360)..(360): n is a, c, g, or t
  modified_base (405)..(405): a, c, t, g, unknown or other
  misc_feature (405)..(405): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacgttgccgggcaagtcaggacattagaactgacttaggtgtatcagcagaataccggaaagcccctaagccttcctgatctgtgctgcatcctaactttagaacgtcgggtaccatacgaagttcagcggcagtgatctggcanagtacttcactcactacatcagcacgcctgcacgccgtagaagtntttccgacttaactttacgttactgttacctaacgtaataacttaccgtaactttaccccgtagggtaaccgttccggaccggacggggtaaccgtaagggtaacgtaaacgttaccgaaaacggtaacgtacggtacggacctacggtcctaactaccg

SEQ ID NO: 165675 - DNA, 547 bp, Homo sapiens
  misc_feature: GYAE6OF01DK1JX.15.67.G01.1.454.CMB.1.raw
  modified_base (277)..(277): a, c, t, g, unknown or other
  misc_feature (277)..(277): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttgtatcagcagaaatccgggaancccctaagctcctgatctgtgctgcatcctaactttacgaagtcggggtcccatctaaggttcagcggcaggtggatcgtggcacagtatttcactctcacatcagcacgcctgcacgccgtagaacgtatttaccgactaactttacttacttcgttactaacaagtacttaactacgttacccgtacggtacgttccggaccgacggggtaacctaagggtacggtaaactaccgaaacgtacgttaggtacggactcgcaccgtacg

SEQ ID NO: 165676 - DNA, 694 bp, Homo sapiens
  misc_feature: GYAE6OF01BSAVY.15.67.G01.1.454.CMB.1.raw
  modified_base (145)..(145): a, c, t, g, unknown or other
  misc_feature (145)..(145): n is a, c, g, or t
tcagtctacgtagccacgaccggtgctcgatttagagtatacatattgggtttgggggcaggagtcagacccactcagtacacagcatggaccatgacggtccccgctcagctcctggggctcctgctgctctggctcccaggtnccagatgtgccatccagatcgacccagtcctccatcctcctgtctgcatctgtaggagacagacgtcaccatccacgttcggccgggacaagtcaggactagttagaactgtacttaggttgtatcgagacgaaggtaaacgtccgggaaacgtcccccgtaaaggtcctacccgtgtacttccgtgtcggcctagacctacttaccctaaacgttttaacgaaaacggttccggggtaccctagttacgtaaacgggttcaacgggcccggagtaagggtggtaacgtcgtacggacaacgtaggttactttaccacttaccctaccgacctactcgacgtcacgtacctgaccgacgtaccgtagtaacgttactttaccgaactttaacttacttaacgtacgttaactaactaaagttacttaaccgtaaccgttacccggtacggtacccggttacgggaacccggacggggtaacctaagggttaacgaaactaaccggtaaacgtaacgttcgggacgtaccgtccgaaccgtccgttaacg

SEQ ID NO: 165677 - DNA, 662 bp, Homo sapiens
  misc_feature: GYAE6OF01CALC6.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttgtatcagcagaaatccgggaaagcccctaagcctcctgatctgtgctgcactcctactttaacgaaggtcggggtacccatactaaaggttcaggcggcgaggtggatcgtggcactagtactttccgacttcctacaaccattaccaagctaacgtcccttaggtaaccggtcccttaaggtaaacgttacgttttaccgtaacttaaaccgttttaatttaaccgttacgttaaccttaaaccgtaaagttaaccttttaaacctaaccgtttaaccccgtaccgggtaccggttaccggacccggaaccgggggtaaaccgtaacggggttaacggaaaaccgttaccgaaaaccggttaaacgtacgggttacggaccgttacgacccgtaaccctagttccg

SEQ ID NO: 165678 - DNA, 595 bp, Homo sapiens
  misc_feature: GYAE6OF01CEBSO.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatccctccctgtcctgcatctgtaggagacagagtcaccatcacttgccggcaagtcaggacattagaactgacttaggttggtatcagacaaggaaactaccggggaaacacccctaagcctcctgactcgtgtcgctgctactacctaactttaacgaaaggttcggggtaccctaagtacgtaaacggttcagggtcggacgtaggtggatcgtaggcctaacgagtactttaccgacttctaccaacctagtacacgacacgcctgcacgtctagaacgtactttcgaacctaactttatacctgtaccttaacaagttacttaactaacgttacccgtaggtaccgttccggacgaacggggaccgtaagggtagaaactacgaaacgtactacggtacgactacgcctactacg

SEQ ID NO: 165679 - DNA, 553 bp, Homo sapiens
  misc_feature: GYAE6OF01ECK0W.15.67.G01.1.454.CMB.1.raw
  modified_base (302)..(302): a, c, t, g, unknown or other
  misc_feature (302)..(302): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccggcaagtcaggacattagaactgacttaggttggtatcagcaagaaagtccgggaaacgcccctaagctcctgatctgtnctgcatcctaactttacgaaaggtcggggtacccatacgtaaggttcaggcggcaggtggatcgtggcactagtactttcactctcacctatcagcacgcctgcacgcctagaacgtactttcgactaacttacttactagtacctaataagtacttaactaacttacccgtggtaccgttccggaccgtaacggggacctaagggtacggaaactaccgaaacgacgttcggacgactacgcgacctacg

SEQ ID NO: 165680 - DNA, 577 bp, Homo sapiens
  misc_feature: GYAE6OF01BJZRS.15.67.G01.1.454.CMB.1.raw
  modified_base (226)..(226): a, c, t, g, unknown or other
  misc_feature (226)..(226): n is a, c, g, or t
  modified_base (275)..(275): a, c, t, g, unknown or other
  misc_feature (275)..(275): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggnaagtcaggacattagaactgacttaggttgtatcagcagaatccggaancccctaagctctgatctgtgctgcatcctactttacaaaggtcggggtacccatacaaggttcagcggcagtggatcgtggcacagtatttcactctcaccatcagcagcctgacacgcctagaacgtactttccgacttaacgtttacttacgttcgtacctaacgtaaagtaactttaaccaaccgtttaccccgtacgggtaccgtttacccgggaccggtaacggggaacccgtaaggggtaacggaaaacttaccgaaaacgtaaaccgttggtacggtactacggccaaccgtacg

SEQ ID NO: 165681 - DNA, 543 bp, Homo sapiens
  misc_feature: GYAE6OF01B87PQ.15.67.G01.1.454.CMB.1.raw
  modified_base (226)..(226): a, c, t, g, unknown or other
  misc_feature (226)..(226): n is a, c, g, or t
  modified_base (380)..(380): a, c, t, g, unknown or other
  misc_feature (380)..(380): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggnaagtcaggacattagaactgacttaggttggtatcagcagaaatccggaaagcccctaagctcctgatctgtgctgcatccactttaacgaaagtcgggtcccatcgaaggttcagcggcagtggatcgtggcacagtatttcacttctcactntcagcagcctgcagcctagaatactttcgactaatttattactgtactaacaagtacttaactaacttacccgtacggtacgttccggaccggtaacggggaaccgtaagggtacggtaaactaccgaaaacgtaacgtggtcggacttcgacctaccgtacg

SEQ ID NO: 165682 - DNA, 573 bp, Homo sapiens
  misc_feature: GYAE6OF01ET488.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaacgtccgggaaacgcccctaaggctcctgatctgtgctgcatcctactttacgaaagtcgggtcccagtcaaggttcagcggcaggtggatcgtggcacagtactttcacttctacaccatcagcagtccctgccagtcccgtagaacgtatttaccgactaacttattaactcgtacttaacaagttacttaacctaacttaccccgtagggtaccgtttccgggaccgtaacggggtacctaaaggggtacggtaaactaacgaaaacggtacgtacgggtacggactacggacaccgttaacg

SEQ ID NO: 165683 - DNA, 651 bp, Homo sapiens
  misc_feature: GYAE6OF01B36W5.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctcctgtctgcatctgtaggagacagagtcaccatcacttgccggcaagtcaggacattagaactgacttaggtggtatcagcagaagtccggaagaccctacgactcctgatctgtgctgcactctactttaacgaacgtcggggtcctatactaaggttcgagcggcgagtggagtcgtggcacgtagtactttcaccgtacctaccgaaccagttaccacggtaccgtacgccctagtccgacggtaccgtagtaaggttaccgttcgttaaccttaactttaacgtttaaccttacgttacgtaactaaacgttaactttaactaaacccgtttaccccggttaccgggtaaccggttacccgggtaacccgggtaacggggtaaccggtaaaggggtaaccggtaaaacgtaacccgtaaaaccgggttaacgtcgggttacgggactcggtaaccctacgttaaccg

SEQ ID NO: 165684 - DNA, 541 bp, Homo sapiens
  misc_feature: GYAE6OF01D1DZY.15.67.G01.1.454.CMB.1.raw
  modified_base (277)..(277): a, c, t, g, unknown or other
  misc_feature (277)..(277): n is a, c, g, or t
  modified_base (431)..(431): a, c, t, g, unknown or other
  misc_feature (431)..(431): n is a, c, g, or t
  modified_base (526)..(526): a, c, t, g, unknown or other
  misc_feature (526)..(526): n is a, c, g, or t
tcagtctacgtagccacgaccggtgctcgatttagagtatacatattgggtttgggggcaggagtcagacccactcagtacacagcatggacatgaggtcccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaagtccgggaancccctaagctcctgatctgtgctgcatctactttacaagtcgggtccatcaaggttcagcggacagtggatcgtggacacgagtctttcacctctacacctatcagcagcctgcacgcctagaatactttcgactaacttattactgtactaanaagtacttaactaacttacccgtcggaccgtttcggaccggtaacggggaccgtaaagggtacggaaactaaccgaaacgtaacgttggacggtntacgcctacgtaacg

SEQ ID NO: 165685 - DNA, 547 bp, Homo sapiens
  misc_feature: GYAE6OF01C00I6.15.67.G01.1.454.CMB.1.raw
  modified_base (278)..(278): a, c, t, g, unknown or other
  misc_feature (278)..(278): n is a, c, g, or t
  modified_base (353)..(353): a, c, t, g, unknown or other
  misc_feature (353)..(353): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatcccagatgacccagtctccatcctccctgtctgcatctgtaggagacagagtcaccatcacttgccgggacaagtcaggacattagaactgacttaggtggtatcagcagaatccgggaancccctaagctcctgatctgtgctgcatccactttacaaggtcggtacccatctaaggttcagcggacagtgatcnggcacagtactttcactctacacatcagcacgtcctgcacgtcctagaacgtatttacgacttaacgtttacttactagttactacaagtacttaactactttacccgtacggtacggttccggaccgacggggtaacgtaagggtaacggtaaacaaccgtaaacgtacgtcggtacggactcgccacgtacg

SEQ ID NO: 165686 - DNA, 571 bp, Homo sapiens
  misc_feature: GYAE6OF01BJ2ST.15.67.G01.1.454.CMB.1.raw
  modified_base (279)..(279): a, c, t, g, unknown or other
  misc_feature (279)..(279): n is a, c, g, or t
  modified_base (366)..(366): a, c, t, g, unknown or other
  misc_feature (366)..(366): n is a, c, g, or t
tcagtctacgtagccacgaccggtgctcgatttagagtatacatattgggtttggtggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccggacaagtcaggacattagaactgacttaggttggtatcagcagaaatccgggaaancccctaagctcctgatctgtcgctgcatccactttacaaaggtcgggtccatcaaggttcaggcggcaggtggatcgtggcacagtnttcactctcaccatcagtcacgcctgcgacgtccgtaggaacgttactttaccgacttaaactttactttacctcgttaactaactaagtacttaacctaactttaccccgtaggtaccgttccgggacccggtaaggggaacccgtaaagggtcggaaaactaccgaaaacggtacgttaggtacggaccttggacctaacccg

SEQ ID NO: 165687 - DNA, 518 bp, Homo sapiens
  misc_feature: GYAE6OF01D0DS1.15.67.G01.1.454.CMB.1.raw
  modified_base (359)..(359): a, c, t, g, unknown or other
  misc_feature (359)..(359): n is a, c, g, or t
  modified_base (417)..(417): a, c, t, g, unknown or other
  misc_feature (417)..(417): n is a, c, g, or t
  modified_base (508)..(508): a, c, t, g, unknown or other
  misc_feature (508)..(508): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccaactttacaaagtcggggtccatcaaggttcagcgcagtggatcgtggcanagtatttcactctcactatcagcagcctgcagcctagaacgtatttcgactaactttnttaactgtactacaagtacttaacaacttacccgcggtacgttccggacgaggggaaccaaggtaggaaataccgaaacgactggtacggntcgcactacg

SEQ ID NO: 165688 - DNA, 524 bp, Homo sapiens
  misc_feature: GYAE6OF01DIKJL.15.67.G01.1.454.CMB.1.raw
  modified_base (516)..(516): a, c, t, g, unknown or other
  misc_feature (516)..(516): n is a, c, g, or t
tcagtctacgtagccacgaccggtgctcgatttagagtatacatattgggtttgggggcaggagtcagacccactcagtacacagcatggacatgagggtcccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtgggtccatcaaggttcagcggcagtggctcgtgggacagatttcacttctcaccatcagcagtcctaccaactgaagtattttcgactaaactttactactgtacaactaggtagtttcagttacgtccccgggtacgttccggaccgtaagggaccaagggtggaacagtacaaacgtacgtaggtgctagcaccntcgttacg

SEQ ID NO: 165689 - DNA, 526 bp, Homo sapiens
  misc_feature: GYAE6OF01B02P8.15.67.G01.1.454.CMB.1.raw
  modified_base (519)..(519): a, c, t, g, unknown or other
  misc_feature (519)..(519): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttgtatcagcagaaatccgggaaagcccctaagctcctgatctgtgctgcatccactttacaaggtcgggtccatcaaggttcagcgcagtggatctggcacagtatttcactctcacatcagcagcctgcagcctagaagtactttcgactaacttattactgtactaacaagtacttaacaattaccccgtacggtacgttcggaccgacggggtaccgtaaaggtaggaaactacgtaaaacgacgtacggtacggactgacncgtaacg

SEQ ID NO: 165690 - DNA, 584 bp, Homo sapiens
  misc_feature: GYAE6OF01C1MQL.15.67.G01.1.454.CMB.1.raw
  modified_base (360)..(360): a, c, t, g, unknown or other
  misc_feature (360)..(360): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggtggtatcagcagaatccgggaaagcccctaagctcctgatctgtgctgcatccactttaacaagtcggggtccagtcaaggttcagcggcagtgatctggcacagtnttcgactctacacatcagcagcctgcagcctagaacgtatttcgacctaagtttaacttactacggtttacctaactaaagtactttaaccgtaaatttacccccgttaggtaccgttaccgggtaccgaacggggggtaacctaaaggggttacgggtaaaaatacccggtaaaaaccgtaacgttacggttacggtaccgtacgtaccgtaccttaaaccgg

SEQ ID NO: 165691 - DNA, 675 bp, Homo sapiens
  misc_feature: GYAE6OF01EVIYV.15.67.G01.1.454.CMB.1.raw
  modified_base (203)..(203): a, c, t, g, unknown or other
  misc_feature (203)..(203): n is a, c, g, or t
  modified_base (291)..(291): a, c, t, g, unknown or other
  misc_feature (291)..(291): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatcgacccagtcctccatcctcctgtctgcatcgtgtagganacagagtcaccatccacttcggccggacaagtcaggactatagaactgtacgttaggttggtatcagacaagaacgtaccgggaaacnccccgtaagcctaccgtgactcgtgtgctgactactacctaactttaacgaaggtcgggtacctagtacgtaagttcgaggcgacgtaggtgactcgtcggacacgtagttacttcgacctcgtaccactatcgacgacgacgcctagccgtacgtccgtaaggtaacgttctttaccggacttaaactttacttaaccgttacggttaacctaaacgtaacgttaactttaacccgttaaccgtttaccccggttacgggtaacccggtttccgggaaaccgttaaccgggggtaacccgtaaagggttaacggtaaaaccgttaaccgtaaacggtaaccgttagggtacccggtacgtaccgtaacccgtaccgttaacgg

SEQ ID NO: 165692 - DNA, 706 bp, Homo sapiens
  misc_feature: GYAE6OF01B08ZU.15.67.G01.1.454.CMB.1.raw
  modified_base (194)..(194): a, c, t, g, unknown or other
  misc_feature (194)..(194): n is a, c, g, or t
  modified_base (226)..(226): a, c, t, g, unknown or other
  misc_feature (226)..(226): n is a, c, g, or t
  modified_base (316)..(316): a, c, t, g, unknown or other
  misc_feature (316)..(316): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatccctcctgtctgcatcngtaggagacagatcaccatcacttggccgganaagtcaggacattagaactgacgtttaggttacggtatcagacaaggaacgtaccgggaaacgccccgtaagcctctgattcgtgtgctnctactcctaacgtttaacgaacggttcgggtaccctagtacgtaacgggttcgacggtccggagtaggtaggtactcgtaggacctaacgtacgttactttaccgtaccttacctaccgaaccctataccgaaccggtcaaccgtccgtcgaccgacggtaccgtaggtaagttacctttacgactttaaaccgtttacgttaaccttacggtaccttaaataacgtttaacttaacccgtaacctttacccgggtaccgggttaacccgttaccgggaaccgggtaaaccgggggtaaccgtaaaaggggtacggtaaaaaccctaacccggtaaaaccggttaccggttacgggtacccggtaccttcggaacccgtaacccgttacg

SEQ ID NO: 165693 - DNA, 573 bp, Homo sapiens
  misc_feature: GYAE6OF01ARF3I.15.67.G01.1.454.CMB.1.raw
  modified_base (228)..(228): a, c, t, g, unknown or other
  misc_feature (228)..(228): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatccctccctgtctgcatctgtaggagacagagtcaccatcacttggccgggnaagtcaggacattagaactgtacttaggttggtatcgagacaagaaacgtaccggaaacgccccgtaagctccgtgtactctgtgctgctactcctaactttaacgaaacggtcggggtacccagtacgaaggttcgaggcggcgaggtggatcgtggcactagtactttcactctacacatcagcacgctgcacgctagaagtcttacgacttaacttacttactagttacctaacaattaacttacctaacgttcccgtacggtacgttaccggaccggtaacgggtaaccgaagggtacgaaacgtacgaaaccgtacgtagtacggactcgcctacgtacg

SEQ ID NO: 165694 - DNA, 612 bp, Homo sapiens
  misc_feature: GYAE6OF01AORFI.15.67.G01.1.454.CMB.1.raw
  modified_base (206)..(206): a, c, t, g, unknown or other
  misc_feature (206)..(206): n is a, c, g, or t
  modified_base (413)..(413): a, c, t, g, unknown or other
  misc_feature (413)..(413): n is a, c, g, or t
tcagtctacgtagccacgaccggtgctcgatttagagtatacatatttggggtttgggggcaggagtcagacccactcagtacacagcatggacatgagggtccccgctcagctccgtggggctcctgctgctctggcctcccaggtgccagatgtgccatccagatgacccagtcctccatcctccctgtctgcatctgtagganacagacgtccaccatccgacttcggcccgggcaagtcaggacattagactgacttaggttggtatcagcaagaacgtaccggaaacgcccctaagcctcctgtactctgtgctgcactcctactttacgaaggttcggggtacccatacgtaaggttcacggcggctaggtcggactcgtcggacacgagtactttcactctccacntcacgcacgcctcgcgacgtcctagtacgtactttacgaccttaactttacttactacggtacctaactaaacgttacttaaccgtaccgttaacccgtaccgggtaccgttaccgggaccggtaacggggtaccgtaagggtacggtaaaccgtaccgtaaacggtacgttcggacggtacctcgcccgtaacgtacg

SEQ ID NO: 165695 - DNA, 625 bp, Homo sapiens
  misc_feature: GYAE6OF01BDIMM.15.67.G01.1.454.CMB.1.raw
  modified_base (227)..(227): a, c, t, g, unknown or other
  misc_feature (227)..(227): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttggccgggnaagtcaggacattagaactgacttaggttggtatcagcagaatccgggaaagcccctaagctcctgatctgtgctgcatccctaactttaacgaaaggtcggggtacccatacgaaggttcaggcggcaggtggactcgtcggactacagtactttcaccgttcctaccacctacttacgagtcaacgtccctggaccacggacccttaggaacggttacttttccggaccttaacttttaagttaaccttacgttacctaactaaacgttaactttaactaaccgtttacccgtaccgggttaaccgtttccgggacccgtaacgggggtaaccctaaaggggttacggaaactaacgaaaccgtaacgtggtacggtacgtacgccaaccgttacg

SEQ ID NO: 165696 - DNA, 652 bp, Homo sapiens
  misc_feature: GYAE6OF01EDDWR.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcaagaaagtccgggaaacgcccctaagctcctgatcgtgtgctgctactccctaacttttaacgaaaggttcggggtaccctagttacgtaaaggtttccgacggccggacgtaaggtcgggtagtctacggggaccaacgtagttaacttttaccgaccttacctccaaccctattaccgaacggaccgacggcccctagaccgtacgtacccgtaggaaacgttacgttttaccgacttaactttaactttacctacgttacctaactaaagtactttaacctaacgtttaccccgtacggtaccggttccggacccggtaacggggtaaccgaagggtaacggaaactacgaaaacgtacgtaggtacggctcgtacccacgtacg

SEQ ID NO: 165697 - DNA, 590 bp, Homo sapiens
  misc_feature: GYAE6OF01AEGW1.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaagtccgggaaagcccctaagctcctgatctgtgctgcatcctaactttaacgaaaggttcggggtacccagtacgaaggttcaggcggcaggtggatcgtggcacgagtactttcactctcaccatcagcagccctgccacgtcctagaacgtctttacgactaactttattactagtacctaactaacgtacttaacctaacgtttacccgtacgggtaccgtttaccgggaccgtaacgggggtaacctaaaggggtaacggtaaacgtaccgtaaaacggtaaccgtcggttacggaccgttacgcccgtaaccgtacg

SEQ ID NO: 165698 - DNA, 566 bp, Homo sapiens
  misc_feature: GYAE6OF01EETGG.15.67.G01.1.454.CMB.1.raw
  modified_base (272)..(272): a, c, t, g, unknown or other
  misc_feature (272)..(272): n is a, c, g, or t
  modified_base (558)..(558): a, c, t, g, unknown or other
  misc_feature (558)..(558): n is a, c, g, or t
tcagtctacgtagccacgaccggtgctcgatttagagtatacatattgggtttgggggcaggagtcagacccactcagtacacagcatggacatgaggtcccgctcagctcctggggctcctgctgctctggctcccaggtgccagatgtgccatccagatgacccagtctccatcctcctgtctgcatctgtaggagacagagtcaccatcacttgccgggcaagtcaggacattagaactgacttaggttgtatcagcagaatccggaanccctaagctctgatctgtgctgcatcctaactttaacgaaacggtcggggtacccagttacgaaggttcaaggtcggactaggtggactcgtcggacacgagtactttcacttctaccactatacagcagcctgacacgcgtagaagtctttaccgactaactttattactcgttactaactaagtaacttaacctaacttacccgtcggtaaccgttccggaccgtaacggggaacctaagggtacggaaactaaccgaaacgtaacgtggtacggactcgaccnccgttacg

SEQ ID NO: 165699 - DNA, 724 bp, Homo sapiens
  misc_feature: GYAE6OF01D7DCX.15.67.G01.1.454.CMB.1.raw
  modified_base (376)..(376): a, c, t, g, unknown or other
  misc_feature (376)..(376): n is a, c, g, or t
  modified_base (501)..(501): a, c, t, g, unknown or other
  misc_feature (501)..(501): n is a, c, g, or t
tcagtctacgtagccacgaccggtgctcgatttagagtatacatattgggtttgggggcaggagtcagacccactcagtacacagcatggacatgacgggtccccgctcagctcctggggctcctgctgctctggcctcccgaggtgccagatgtgccatccagatcgaccctagtcctcccactccctccctgtctgcatcgtagtaggagacagagtaccaccatcctacgtcggccgggactaagtaccgaggactaagttacgaacgttgttaacggttaggttaggtactacggaagtacgaaacggaaaccgtacccgggggaaacctccccgtaaggtcccttccgtagactttcgtggtcgtccgtanacctaccgttacccttaaacggtttaaccggaaacgggtttccgggtacccctaagtaaccgtagggttaccacgggtccggacgtaggtcgtaacgttccgaggacctagttacgttactaccncctctaccactacacgagacctacgtccgtagaccgtactacgtaaggtaacttacgttacctaacttactttacgttactacgtaactaaatacgttaacttaaccgtaccgttaccccggagggttacccggtccgggaccggtaaagggtaccgtaaaggttaacgaaacggtaccctaaaacgggtcttacggcggttaccaccgtaacctcccgttag

SEQ ID NO: 165700 - DNA, 557 bp, Homo sapiens
  misc_feature: GYAE6OF01DAB4I.15.67.G01.1.454.CMB.1.raw
tcagtctacgtagccacgaccggtgctcgatttagagtatacatattgggtttgggggcaggagtcagacccactcagtacacagcatggacatgagggtcccgctcagctcctggggctcctgctgctctggctcccaggtgccagatgtgccatccagatgacccagtctccatcctccctgtctgcatctgtaggagacagagtccaccatcacttgccgggcaagtcaggacattagaactgacttaggttggtatcagacaagaaacgtaccgggaaacgcccctaagctcctgatctgtgctgacactacctaactttaacaaaggtcgggtacccagtacgaaaggttcagcggacaggtggatcgtggacacgagtatttacacctctacacctatcagacagcctgctacgcctagaacgtactttacgacttaactttattacctgtactataagtaactttacacttacccggtacggtaccgttccggacggacgggtaacaaggtacggaaactacgaaacgacgtagaggctacgctaccgta

SEQ ID NO: 165701 - DNA, 589 bp, Homo sapiens
  misc_feature: GYAE6OF01A1JBG.15.67.G01.1.454.CMB.1.raw
  modified_base (226)..(226): a, c, t, g, unknown or other
  misc_feature (226)..(226): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggnaagtcaggacattagaactgacttaggttggtatcagacagaaacgtccgggaaagcccctaagcctacctgatctgtgctgcactcctactttaacaaacggtcgggtacccatacgaaggttcaggcggcgtagtggatcgtggcacgtagtatttccacttcctaccaccatcagccagtccctgaccacgtcccgtagaacgtactttcgacttaactttaacttactagttacctaactaagtactttaacctaacgttacccgtacggtaccgttaccgggaccgtaacggggaaccgtaagggtacggaaacgtaaccgaaacgtacgtacggtacggacctcgacctaccgtacg

SEQ ID NO: 165702 - DNA, 598 bp, Homo sapiens
  misc_feature: GYAE6OF01BEOK9.15.67.G01.1.454.CMB.1.raw
  modified_base (280)..(280): a, c, t, g, unknown or other
  misc_feature (280)..(280): n is a, c, g, or t
tcagtctacgtagccacgaccggtgctcgatttagagtatacatatttggggttttggggggcaggagtcagacccactcagtacacagcatggacatgagggtccccgctcagctcctggggctcctgctgctctggctcccaggtgccagatgtgccatccagatgacccagtctccatccctcctgtctgcatctgtaggagacagatcaccatcacttgccggacaagtcaggacattagaactgacttaggttgtatcagcagaatccgggaaancccctaagctcctgatctgtgctgcactcctaactttaacgaaaggttcggggtacccaagtaccgtaaaggttcaggccggacgaggtggatcgtggacaacgagttactttaccacttcctaccaccatcagccacgcctgacacgcctagaagtactttcgaccttaactttacttacttgtacctaactaagtaactttaacctaacttacccgtacgggtaccgttccgggaaccggtacggggtaacctaaggggtacggtaaaactaccgtaaaacgtaacgttcgtacgggtactacgacctaccgtacg

SEQ ID NO: 165703 - DNA, 799 bp, Homo sapiens
  misc_feature: GYAE6OF01AOMPM.15.67.G01.1.454.CMB.1.raw
  modified_base (290)..(290): a, c, t, g, unknown or other
  misc_feature (290)..(290): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatccctcctgtctgcatctgtaggagacagacgtcaccatcacgttggccgggacaagtcgaggactattagaactgtacgttaggttgtatcagacaagaacgtaccgggaacncccgtaagcctctgactcgtgtcgctgactacttacctaacgtttaacgaaacggttccgggtaccctaagtaccgtaagggttccgaaggtccggacgtaggtacggtaacgttccggtacggtactaacgtaacggttaccttttacccgaaccctttccctaaccgtaaccctaacgttacccgaacggtaccctaaccggtacccgtcggtaccgaaccggttacccgttaacggtaaaccggtttaccgttttaaccgaaacccttttaaacgttttaaccgtttaaccgttaccggttaaaccttaaaaccgtaaacggtttaaacctttaaacccgttaacccgtttaacccccggttacgggttaacccggttacccgggaacccgggtaaaccgggggtaaaccgttaaagggggttaaaccgtaaaacgttaaacccgtaaaccggttaaccggttacgggtacggtacccgttaccgtaacccgtaacgtttaaccgg

SEQ ID NO: 165704 - DNA, 604 bp, Homo sapiens
  misc_feature: GYAE6OF01B91E2.15.67.G01.1.454.CMB.1.raw
  modified_base (227)..(227): a, c, t, g, unknown or other
  misc_feature (227)..(227): n is a, c, g, or t
  modified_base (295)..(295): a, c, t, g, unknown or other
  misc_feature (295)..(295): n is a, c, g, or t
  modified_base (305)..(305): a, c, t, g, unknown or other
  misc_feature (305)..(305): n is a, c, g, or t
  modified_base (464)..(464): a, c, t, g, unknown or other
  misc_feature (464)..(464): n is a, c, g, or t
  modified_base (479)..(479): a, c, t, g, unknown or other
  misc_feature (479)..(479): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtcctccatccctcctgtctgcatctgtaggagacagagtcaccatcacgttgccggnaagtcaggactatagaactgtacttaggttgtatcagacaagaactaccgggaacaccctaagctacngactctgtcnctgctactacctacgtttaacgaaggttccgggtacctagtacgtaaggttcacggtcggacgtaggtcggtagtcgtaggactaacgtagttacttacgactcctacactatacgacgctacgtcctgacacgcctagattacttcgaactaactttntaactagtacctaanaacgttacttactaaccgttcccgtacgggtaccgttaccggacggtaacgggaaccgtaaggttaacggtaaacgtaccgtaaaacggtacgttacggtacggtccaacgtcccgaacttaccg

SEQ ID NO: 165705 - DNA, 544 bp, Homo sapiens
  misc_feature: GYAE6OF01D18R1.15.67.G01.1.454.CMB.1.raw
  modified_base (380)..(380): a, c, t, g, unknown or other
  misc_feature (380)..(380): n is a, c, g, or t
  modified_base (411)..(411): a, c, t, g, unknown or other
  misc_feature (411)..(411): n is a, c, g, or t
  modified_base (424)..(424): a, c, t, g, unknown or other
  misc_feature (424)..(424): n is a, c, g, or t
  modified_base (449)..(449): a, c, t, g, unknown or other
  misc_feature (449)..(449): n is a, c, g, or t
  modified_base (539)..(539): a, c, t, g, unknown or other
  misc_feature (539)..(539): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagatcaccatcacttgccgggcaagtcaggacattagaactgacttaggttggtatcagcaagaaacgtccgggaaacgacccctaagcttcctgatctgtgctgctactcctaactttaacgaaaggtcggggtacccagtcgtaaggttcaggcggcaggtggactcgtggacanagtcttacactctacacatcagcagcctgcncgcctagaacgtnttcgactaacttattactgtactanaagttacttaactacttacccgtacggtaccgtcgacggaacgggaacgtagggtaacggaaacacgaaacgacgtaggacgactcgccnctacg

SEQ ID NO: 165706 - DNA, 578 bp, Homo sapiens
  misc_feature: GYAE6OF01E4X2O.15.67.G01.1.454.CMB.1.raw
tcagtctacgtagccacgaccggtgctcgatttagagtatacatattgggtttgggggcaggagtcagacccactcagtacacagcatggacatgagggtcccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacgttaggttggtatcagcaagaaagtaccgggaaacgcccctaagcctcctgatctgtgctgcactcctaactttacgaaaggtcgggtacccagtacgaaggttcaggcggcgaggtggatcgtggcacgagtactttccaccttcctaccacctactcaacgcacgccctgacacgtccgtagtaacgtatttccgactaactttattaactcgttactaactaagttacttaactaacttaccccgtacggtaccgttccgggaccgaaggggaccctaagggtacggaaactaccgaaacgtacgtggtacgactcggacctcgtacg

SEQ ID NO: 165707 - DNA, 569 bp, Homo sapiens
  misc_feature: GYAE6OF01C5Q15.15.67.G01.1.454.CMB.1.raw
  modified_base (226)..(226): a, c, t, g, unknown or other
  misc_feature (226)..(226): n is a, c, g, or t
  modified_base (374)..(374): a, c, t, g, unknown or other
  misc_feature (374)..(374): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggnaagtcaggacattagaactgacttaggttgtatcagcaagaatccgggaaagcccctaagctcctgatcgtgtgctgcactcctaactttaacgaaggtcggggtcccatacgtaaaggttcaggcggcagtggatcgtggcacagtntttacactctacacatcagcacgcctgcacgtacctagtaacgttactttacgactaaacttttaacttacttcgttactaacaagtaactttaacctacgtttacccgtacggtaccgttccggacggacggggtaaccgtaagggtaacgaaacgtaccgaaaacggtacgttcggacgctacgcctactacg

SEQ ID NO: 165708 - DNA, 723 bp, Homo sapiens
  misc_feature: GYAE6OF01D0LGU.15.67.G01.1.454.CMB.1.raw
  modified_base (226)..(226): a, c, t, g, unknown or other
  misc_feature (226)..(226): n is a, c, g, or t
tcagtctacgtagccacgaccggtgctcgatttagagtatacatattgggtttgggggcaggagtcagacccactcagtacacagcatggacatgagggtcccgctcagctcctggggcctcctgctgctctggctcccaggtgccagatgtgccatccagatgacccagtctccatcctccctgtctgcatctgtaggagacagacgtcaccatcacttgccggnaagtcaggacattagaactgtacgttaggttgtatcgaagacaagaaacgtaccgggaaacgaccccgtaagcctcgtgactctgtgctgctactcctaacgtttaacgaaacggtcggggtaccctaagtacgtaaacggttcgaacggtccggacgtaggtcgggtactcggtaggacctaacgtaaggttaccttttacccaaccgtttccctaacctaaccctaacgttacccgaacgtacccaacgtccccttaggaccgtacgtacccgttagtaaaccgttcttttaccgactttaaacgtttacttaacgttacgttaacctaacggtaaacttaacctttaacgtaaccgttacccggttaccggggtaaccgttaccggggaacccggtaacgggggtaaaaccgtaaaggggttacgggtaaaaacctaaccggtaaaacggtaaccggttcggttacggaccgtacggtacctaacccgtaacgg

SEQ ID NO: 165709 - DNA, 617 bp, Homo sapiens
  misc_feature: GYAE6OF01EYI9Q.15.67.G01.1.454.CMB.1.raw
  modified_base (201)..(201): a, c, t, g, unknown or other
  misc_feature (201)..(201): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtagganacagagtcaccatcacgttgccggcaagtcaggacattagaactgtacttaggttggtatcagcaagaaacgtccgggaaacgtcccctaagcctccgtgtattcgtgtcgctgctacttaccctaactttaacgaaacggttcggggtaccctagtacgtaaggttcaggcggacaggtgactcgtggacacgtagtactttcaccttctacaacctatcgacgcacgtccgtagccacgccgtagaacgttctttaccgacttaactttacttactcgtaactaacaaagttaaccttaacgtaacctttacccggtaccggtaccgtttacccgggaccggtaacggggtaccgtaaagggttacggaaactaccgaaacgtacgttcggacgtacgtacgcctaacgttacg

SEQ ID NO: 165710 - DNA, 560 bp, Homo sapiens
  misc_feature: GYAE6OF01CZ8VX.15.67.G01.1.454.CMB.1.raw
  modified_base (443)..(443): a, c, t, g, unknown or other
  misc_feature (443)..(443): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagacaagaatccgggaaagcccctaagctcctgatctgtgctgcatccaactttacgaagtcgggtccagtcgaaggttcagcggcagtggactcgtggcacgagtactttcacttcgtaccaccatacagcacgcctagcagcctagaatactttcgacttaacttattactcgtactaanaagttacttaactaacgttacccgtacggtaccggtttacgggaccgtaacggggaacctaagggtaacggaaactaccgaaaacgtacgtaggtacgtactcggacctaccgtacg

SEQ ID NO: 165711 - DNA, 559 bp, Homo sapiens
  misc_feature: GYAE6OF01AWJO4.15.67.G01.1.454.CMB.1.raw
  modified_base (224)..(224): a, c, t, g, unknown or other
  misc_feature (224)..(224): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcacatcacttgccggnaagtcaggacattagaactgacttaggtggtatcagcagaatccgggaaagccccaagctcctgatctgtgctgcatcctatttacgaagtcgggtaccatcgtaaggttcagcgcaggtgatcgtggctacgagtatttcacttctacaccatcaagcacgtcctgacacgctaggaacgtacgtttacgacctaactttacttactcgtacttaacgaaagttacttaacctaaccgttcccgtacgggtaaccgttccgggaccgggtaacggggaccctaaagggtaggtaaacctacgaaaacggtaacgtcgtagggctgccacgtacg

SEQ ID NO: 165712 - DNA, 814 bp, Homo sapiens
  misc_feature: GYAE6OF01AWQ2W.15.67.G01.1.454.CMB.1.raw
  modified_base (226)..(226): a, c, t, g, unknown or other
  misc_feature (226)..(226): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggnaagtcaggacattagaactgacttaggttgtatcagacaagaaacgtccgggaaacgcccctaagcctcctgactctgtcgctgcatcctaactttaacgaacggttcggggtaccctaagtaccgtaaagggttccgaacggccgggtacgtaggttacgggtaacgttccggttacgggtacccaacgtaaggttaacctttttaccgaaccctttcccttaccccaacccctaacgttacccgaaacggacccgtaaccggtccccgttacggacccgtaaccggtaccccgttaaggtaaaccggtttaacgttttaccccggaacctttaaaaccgtttttaacgtttaacccgtttacggttaacccttaaaccgttaaaacgttaaccttttaaacccgtaaaccgttttacccccgggtaccgggttacccgggtttacccggggaacccgggtaaaccggggggtaaacccgtaaagggggttaacggtaaaaacccgttaaacccggtaaaaacccgggttaaccgtttacggggttacgggtacccgttacgggtaaacccctaacccgttaaccgg

SEQ ID NO: 165713 - DNA, 544 bp, Homo sapiens
  misc_feature: GYAE6OF01DARC3.15.67.G01.1.454.CMB.1.raw
  modified_base (443)..(443): a, c, t, g, unknown or other
  misc_feature (443)..(443): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcaagaaatccgggaaacgcccctaagcctcctgatcgtgtgctgcactcctaactttacgaaaggtcggggtacccagtcgaaggttcaggcggctagtggatcgtggcacagtatttcactctcaccatcagcagcctgcacgcctagaattacttcgactaacttatactagtactanaagtacttaactacttacccgtacggtacggtccggacggacgggtaaccaagggtaacgaaataccgaaacgacgttggtacggtatacgcgaccgtacg

SEQ ID NO: 165714 - DNA, 582 bp, Homo sapiens
  misc_feature: GYAE6OF01D1C75.15.67.G01.1.454.CMB.1.raw
  modified_base (420)..(420): a, c, t, g, unknown or other
  misc_feature (420)..(420): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagacgtcaccatcacttcggccgggcaagtcaggacattagaactgacttaggttggtatcagacagaaacgtccgggaaacgcccctaagctcctgatctgtgctgcacttccactttaacgaaacggtcggggtacccatcgaaggttcaggcggacaggtggctcgtggaccacagtactttccacttcctaccaccatcagcacgccctgacncgcctaggaactacgtttcacttaacttattaaccttgttactaacgtaaagttacttaaccgtaactttacccgtacgggtaccgttccgggaccggacggggtaaccgtaagggtacgaaactacgaaacgtaacgtcggtacgattaacggactattcg

SEQ ID NO: 165715 - DNA, 584 bp, Homo sapiens
  misc_feature: GYAE6OF01AV3TT.15.67.G01.1.454.CMB.1.raw
  modified_base (201)..(201): a, c, t, g, unknown or other
  misc_feature (201)..(201): n is a, c, g, or t
  modified_base (305)..(305): a, c, t, g, unknown or other
  misc_feature (305)..(305): n is a, c, g, or t
  modified_base (465)..(465): a, c, t, g, unknown or other
  misc_feature (465)..(465): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtagganacagagtcaccatcacttgccggcaagtcaggacattagaactgacttaggttggtatcagcagaaagtccgggaaagccccctaagcctacctgactctggtnctgcatcccaactttacgaaagtcggggtacccatacgtaaaggttcaaggcggcaggtgggacttcgtggcaacgagtactttccacttcctaccaaccatccacggccagccctgcagccctagaacgtactttcgacttaaactttacttaaccgtnttacctaactaagtaactttaaccaactttaacccggtcggtaaccgttccggacccgtaacggggtacctaagggtaacggaaataccgaaaacgtaacttggcgatcgctaactacg

SEQ ID NO: 165716 - DNA, 754 bp, Homo sapiens
  misc_feature: GYAE6OF01C8NJ8.15.67.G01.1.454.CMB.1.raw
  modified_base (209)..(209): a, c, t, g, unknown or other
  misc_feature (209)..(209): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctcgtggcctcccgaggtcgccagatgtgccatccagatcgacccagtctccactccctccctgtctgcatcgtgtagganacgagacgtccaacatcctacgtcggccgggacaagtcaggactattacgaactgtaacgtttagggttaggtactacgagtacgaaagtaaaccgtaccggggaaactacccccgtaaagtccttacctgacttcgtggtcgtcgtacgctaacctccctaaacctttaacggtaaagggttccggggtaccctaacgtacgtaaacggttacgacggcgggacgtagggttacgcgttacgtacggactaacgagttacttacctaccgtcctaaccacctactacacgacgtaccgtcctagccgtaaccggaccttaggtaacgtttaccgtttaccgtaaactttaaccgttttaaccttacgttaaccttaacgtaactaaaccgtttaacttaaacccttaaccgttaccccggttacgggtaacccggtcccgggaaccggtaaaccggggtaaaccgtaaggggttaaacgtaaaaccgttaaaccgaaaaccgggttacgtacggttaggacccttacgccccgttaacgtaccg

SEQ ID NO: 165717 - DNA, 704 bp, Homo sapiens
  misc_feature: GYAE6OF01CBZJ7.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctcctgtctgcatctgtaggagacagagtcaccatcacttgccggcaagtcaggacattagaactgacttaggttggtatcagacaaggaaacgtaccgggaaacgcccctaaaggccttaccctggtaactccgtgtgtctgcctacttcctaactttaaccgaaaacggtcgggggtaccctaagtactaaacggttccaggcggtactaaggtcggactcgtacggacctataaggtactttaccacgttccttaaccaccctaacgttacaaacgccaacggtccccgttagacccgtaagaccccttaggtaaacggtacttttaccggaaccttaaacgttttactttacttacgtaccttaacggaaattaacgttaacctaaacgtttaccccggttacgggtaaccggttacccggacccggtaaagggggtaacccgtaaaggttacgggaaaaccgtaaccgttaaaacggaaaccgtttggtaacggtccgtaccgtaagtacccccgttaagg

SEQ ID NO: 165718 - DNA, 751 bp, Homo sapiens
  misc_feature: GYAE6OF01C2DV3.15.67.G01.1.454.CMB.1.raw
  modified_base (203)..(203): a, c, t, g, unknown or other
  misc_feature (203)..(203): n is a, c, g, or t
  modified_base (320)..(320): a, c, t, g, unknown or other
  misc_feature (320)..(320): n is a, c, g, or t
  modified_base (401)..(401): a, c, t, g, unknown or other
  misc_feature (401)..(401): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatcgacccagtcctccatccctcctgtctgcatctgtagganacagatccacatcacgttcggccggacaagtcaaggactagttacgaactgtacgtttaggtgtactcgagacgaagaaacgtaccggaacacccctaagcctcctgtatcgtgtcnctgactactacctaacgtttaacgaaggttcgggtaccctagtacgtaaggttcgacggtcgacgtaggtcggacttcggnggactaacgacgttactttcaccttaccaccaacgttactacgaacgtacgtaaccgtcccgttaggacccgttaacggtacccgtaacggtaacgttttacccgttttaccggtaaaccttttaaaccgtttttaccgtttaaccgtttacggttaaaccccttaaacggtaaaactttaacctttaaacccgttaaacccgtttacccccgggtaacgggttaacccggtttcccggggaaacccgggtaaaccgggggtaacccgtaaaggggtaaacgtaaaccgttaaaccggtaaaaccggttacgtcgggtacgtacccgtacggacccgtaaccgtttaccg

SEQ ID NO: 165719 - DNA, 698 bp, Homo sapiens
  misc_feature: GYAE6OF01CNZD9.15.67.G01.1.454.CMB.1.raw
  modified_base (202)..(202): a, c, t, g, unknown or other
  misc_feature (202)..(202): n is a, c, g, or t
  modified_base (304)..(304): a, c, t, g, unknown or other
  misc_feature (304)..(304): n is a, c, g, or t
  modified_base (319)..(319): a, c, t, g, unknown or other
  misc_feature (319)..(319): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggcctcccaggtgccagatgtgccatccagatcgacccagtctccatcctcctgtctgcatctgtagganacagacgtcaccatccacgttcggccgggacaaggtccaggaactaagttaagaacttgtacgttaggttaggtatcagacaaggtaaacgaccgggaaacncccctaagccttccngtactcgtgtcgcttcgactactacctaacgtttaacgaaggttccgggtacctagtaccgtaacggttcacggccggagtaggttcggaacgttccggtacggaccgacgtaacggttacttttacccgtaaccttaccctaccctaacccgacgttaccgaacgaccgtacgcccttacggaccgacgtaccgtaagtaacggttactttccgaactttaactttacttaactagtaaccgttaactaaacgttactttaacctaaccgttacccggtggttaaccggttaccggtaccggtaacgggtaaacgtaagggtaacgtaaaccgtaccgaaaacgtacgttacggtacggacgtacgcccgtacgttac

SEQ ID NO: 165720 - DNA, 752 bp, Homo sapiens
  misc_feature: GYAE6OF01B4Q1F.15.67.G01.1.454.CMB.1.raw
tcagtctacgtagccacgaccggtgctcgatttagagtatacatattgggtttgggggcaggagtcagacccactcagtacacagcatggacatgaggtccccgctcagctccgtggggctcctgctgctctggcctcccaggtgccagatgtgccatccagatcgacccagtcctccactccctcctgtctgcatcgtgtaggagacagacgtcacctatccacgttcggccgggacaagtcgaaggactagttaagactgtacgtttaggtgtatcgagacgaagaacgtaccgggaaacctcccctaagccttccgtagtacttcgtggtcgcgtcgacctacttacccgtaacgtttaacggaaacgggttccggtaccctaagtaccggtaagggttccagggtccggactagggtcgtactcggtacggactagtaacgttactttcctactcctaccacctactacgacgtaccgacgtccgtacgaccgtacgtaccgtaagtacgttaccgtttccgaacctttaacgtttaccgttaaccgttcgttaaaccgttaaacgtacgttaaacgtttaacccgttaacccgtttaccccggttaccgggttaaccggttaccccggggtaaccggttaaaccggggtaaacccgtaacggggttaaacggtaaaccgttaaaccggttaaaaccggtcggttacgggtaccggtaaccgtaccggtacccgttaaccgttaccgg

SEQ ID NO: 165721 - DNA, 536 bp, Homo sapiens
  misc_feature: GYAE6OF01B52XY.15.67.G01.1.454.CMB.1.raw
  modified_base (433)..(433): a, c, t, g, unknown or other
  misc_feature (433)..(433): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaagtcgggaaacgcccctaagctcctgatctgtgctcgacactcctaactttaacgaaaggttcggggtacccagtacgtaaggttcaggtcggctaggtggactcgtggacacgagtactttcacttctaccactatacagcagtcctgctagcctagaacgttnttccgacttaacttcttatcgtactaacaagttacttaactacttacccgtcgacgttcgacgacgggtacgagtagaactcaaagacgtgagctgccagtac

SEQ ID NO: 165722 - DNA, 716 bp, Homo sapiens
  misc_feature: GYAE6OF01D4QWZ.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacatagaactgtacttaggttggtatcgagcaaggaaacgtaccggggaaaacgtccccctaaaggtcctccctaggacttcgtgtcggcttgacctactacctaactttaacgaaacggttcggggtaccctaagttacgtaaacggttcgaacggtcggaccgtaaggtcggtacttcggtacgggacaacgtaagttacttttccgaacctttctaacccaaccgtaataccgaacggtactaacggcccttaggaccaacggtcccctaaagggtaacgttaacgttttaccggaacctttaaacgttttaacgttaccttacggttaacctaaaccgtaacgttaaactttaacctaaaccgtttaccccggtagggtacccgtttaccgggaccgtaaccggggtaaccgtaaagggtaacggtaaaactaaccgaaaacggtacgtcggtacggtacctacgacctaccgtaacg

SEQ ID NO: 165723 - DNA, 641 bp, Homo sapiens
  misc_feature: GYAE6OF01A48BW.15.67.G01.1.454.CMB.1.raw
  modified_base (203)..(203): a, c, t, g, unknown or other
  misc_feature (203)..(203): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatcgacccagtctccatccctccctgtctgcatctgtagganacagagtcaccatccacgttcggccgggacaaggtcaaggacattagaactgtactttaggttggtatcagacaagaaacgtaccgggaaacgcccctaagcctcctggactctgtgctgctactcctaactttaacgaaaggttcggggtaccctagtacgtaaggttcagggccgacgtaggtggtaactcgtggacactagtactttccaccttcctaccactatccagcacgcctcgcacgctagaagtcttaccgacttacttacttactcgtacctaacgtaacgtaacttaaccgtaaccttaaccccggttcgggtaaccggttacccgggtaccgggtaacgggggtaacccgtaaaggggtaacggtaaaaccgttaaccgaaaaccggttacgtacgggtaccgtacgtaccgaccgtaacctaacg

SEQ ID NO: 165724 - DNA, 564 bp, Homo sapiens
  misc_feature: GYAE6OF01CEHGZ.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttggccggcaagtcaggacattagaactgacttaggtgtatcagcagaagtaccgggaaagcccctaagcctctgactctgtgctgcactcctactttaacaaaggtcggggtacccatccgaaggttcacgcggctaggtggatcgtcggcactagtatttccgacttcctcaccactcacgcacgcctgcagtcctagtaatctttacacttaacttagttactcgtactacaagtacttactaaccttcccgtacggaccgttcggaccgaacggggtaaccgtaaggtacggtaaacaccgtaaaacgacgttcgggacgtaccgtcggtacaacccgttacg

SEQ ID NO: 165725 - DNA, 751 bp, Homo sapiens
  misc_feature: GYAE6OF01EIXZQ.15.67.G01.1.454.CMB.1.raw
  modified_base (200)..(200): a, c, t, g, unknown or other
  misc_feature (200)..(200): n is a, c, g, or t
  modified_base (314)..(314): a, c, t, g, unknown or other
  misc_feature (314)..(314): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctcctgtctgcatctgtagganacagagtccaccatcacttcggccgggacaaggtcaggactattagaactgtacttaggttggtatcgagacagaaagtaccggaaacgtcccctaagctccgtgactctagtnctgactactctaactttaacgaaaggtcggggtaccctagtacgtaaggttacagcggtcgagtggtatcgtggaccacgtaacgttactttacgtaccttccgtacctaaccagttacccaaggtcctaacggcccctaggtcctaccgaccgttaaggtaaacgtttagttttacccggaacctttaaacgttttactttaacccgttacggttaacccttaaacgtaaacgttaacctttaaaacccgttaaaccgttttaacccccggtaacgggttaacccggtttaccgggggtaaacccgtaacccgggggggtaaacccgttaaagggggttaacccgggttaaaaacgtaaacccggttaaaaaacccgggtaacggtttacggggtaaccgggttaccgttaacgggacccttaaccccgttaaacg

SEQ ID NO: 165726 - DNA, 892 bp, Homo sapiens
  misc_feature: GYAE6OF01BEFXE.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggcctcccaggtgccagattgtcgcactcgagtagtccgaccctcgtccctacctaccttcccttcccgttgtctcgactacttcgttagggtaggaacgacgtaaggtacctacccaactactacctaccggttccgggccgggtaacgtaacgtacggaacggtaacttaagttaacgtacgttacggtttaaggttttaggggttaggttacacggaacgaacgtaaaacgggtaaacccgggtaaaccccggggaacccgtaaccccgtaagtcccctttaccggtaggttactccggttacggcgtacgtcgtaccttaccttaccgtttaaacgttaaacgggtacggggtaccgtacctaacgtaacggttacgggtacgacgggccggtaagtacgggtacgtcgtaccggtacggtaacctacggttacgttacctttaacccttaccgttacccttaaccccgtaaccgttacaccggaaccgaccggtaccgtacccggtacggtaaccggaccggtttacgtaaacggttaccgttttaacgttaccgttaaacctttaacgttttacgttaaccgttacttaaaccttaaggttaaccttaaaccttaccgtttaacccgttcccgggtaccggttaccgggttacccgggaaaccgggtaccgggtaaacggttaaagggtaaaccctaaggaaaacccgtaacggtaccgttacggtacgggacctacgtacccgtacgttaccg

SEQ ID NO: 165727 - DNA, 691 bp, Homo sapiens
  misc_feature: GYAE6OF01BF87A.15.67.G01.1.454.CMB.1.raw
  modified_base (202)..(202): a, c, t, g, unknown or other
  misc_feature (202)..(202): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatccctccctgtctgcatctgtagganacagagtcaccatccacgttggccggcaagtcaggacattagaactgtacttaggttggtatcagacaagaaacgtaccgggaaacgacccctaaggccttacctgactctgtcgctgctactacctaactttaacgaacggttcggggtaccctacgtacgtaacgggttcacggcggcgaggtgtatcgtggacacagtcttccactctccacgtactacgagtaccacgccgtacgccgtaacgtcccgttaaggacgtacgttttacggaaaccctttaaccgtttaactttaaccgttaccgttaaccttaaaccgttaaacggttaactttaaacccgttaacccgttaacccccggttaccgggttaaccggtttacccgggtacccgggaaaccggggtaaccgtaaccggggtaacggtaaaacgttacccgaaaacgttaccggtacggttacggacgttccgacccgtacgttaaccg

SEQ ID NO: 165728 - DNA, 783 bp, Homo sapiens
  misc_feature: GYAE6OF01DWH69.15.67.G01.1.454.CMB.1.raw
tcagtctacgtagccacgaccggtgctcgatttagagtatacatattggggtttgggggcaggagtcagacccactcagtacacagcatggacatggagggtccccgctcagctcctggggctcctgctgctctggcctcccgaggtcgccagatgtgccatccagatcgacccagtcctccatccctcctgtctgctatctaggtaggagacagacgtccacctatccacgttcggaccgggacaacggtcgaaggtaactaagttaacgaacgtggtaacgtttagggttggtactcgaagacaaggtaaacggtacccggggaaaccaccccgtaagtcctccgtagtacgttcgtacgtcgtcctacgtacctaacttacccgttaacgtttaacggaaaacgggttccggggttaaccctaagttaaccggttaaacggggttccgaacgggtcggtacgtagggtacggtacttcgggtacggactaacgttacgttactttaccgtaccctactacccgaacctactaaccgaacgtaccgaccgtcctacggaaccgtacgtacggtaacggtaaacgtttaccgtttaacgtaaaccttaaacgttttacttaccggtacttaaccgtaaacgtaacgtttaaaccttaaccgttaaccgtttacccggtacgggtaccgggttaccgggaccgggtaaaccggggaacgttaaagggtaacggtaaaactaccggtaaacgcggttacggtacggtacctcgacctacgtacg

SEQ ID NO: 165729 - DNA, 676 bp, Homo sapiens
  misc_feature: GYAE6OF01AVNJJ.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtcgccagatgtgccatccagactcgacccagtcctccatcctccctgtctgcatctaggtaggagacagacgtccaacctatccacgttcggaccgggacaagtcaggactattacgaactggtaacgttagggttaggtactcgaagacgaaacggtaaacggtacccgggaaacgtccccgtaaaggcccttaccgtagacgttccgtgtacgctagacctactacccttaacgttaacgaaggtccgggtaccagtacgtaaggttcaggtcgagaggtagctcgtgactacgtagttacttcacctcgtacacctacgtacacgtaccacgctcgacgtaacgtccgtaagtaacgttacttcgtaaccgttaactttacgttactacgtaactaacgtaaacgttaacttaacccgtaacgttacccgttacgggtacgttacccggaccggtaaacgggaccgttaagggtaagtaaaccgtaacgtaaacgtacgtaggttacgacggtaccctagtaacccttacg

SEQ ID NO: 165730 - DNA, 534 bp, Homo sapiens
  misc_feature: GYAE6OF01APJDI.15.67.G01.1.454.CMB.1.raw
  modified_base (226)..(226): a, c, t, g, unknown or other
  misc_feature (226)..(226): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggnaagtcaggacattagaactgacttaggttggtatcagcagaaatccgggaaagcccctaagctcctgatctgtgctgcatccactttacaaagtcggggtcccatcaaggttcagcggcagtggatctggcacagtatttcactctcaccatcagcagcctgcacgcctgaactactttcgactaactttattactgtactaacaagtactttaacaacttacccgtcggtacgttccggaccgaggggaaccgtaagggtacggaaactacgaaacgtaactacggtacggactcgccgtacctacg

SEQ ID NO: 165731 - DNA, 581 bp, Homo sapiens
  misc_feature: GYAE6OF01D36OQ.15.67.G01.1.454.CMB.1.raw
  modified_base (229)..(229): a, c, t, g, unknown or other
  misc_feature (229)..(229): n is a, c, g, or t
  modified_base (377)..(377): a, c, t, g, unknown or other
  misc_feature (377)..(377): n is a, c, g, or t
  modified_base (405)..(405): a, c, t, g, unknown or other
  misc_feature (405)..(405): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatcgacccagtctccatcctccctgtctgcatctgtaggagacagacgtcaccatcacttggccgggnaagtcaggactattagaactgtacttaggttggtatcagcaagaaacgtaccgggaaacgcccctaagcctcctgactctgtgctgctactcctaacttacgaacggtcggtacccagtacgtaaggtcaggcggataggtgactcgnggcagagtcttcactctacacatcagcncgctgactcgcctagacgttacttccgaacttaacttacttactagttacctaagtaacgttaacttaacctaacgttcccgtacgggtaccggttccggaccgggtaacgggaacctaagggtacgtaaaactaacgtaaaccgtacgtcggtacggtactcggcctaccgtacg

SEQ ID NO: 165732 - DNA, 576 bp, Homo sapiens
  misc_feature: GYAE6OF01BRJ61.15.67.G01.1.454.CMB.1.raw
  modified_base (283)..(283): a, c, t, g, unknown or other
  misc_feature (283)..(283): n is a, c, g, or t
  modified_base (427)..(427): a, c, t, g, unknown or other
  misc_feature (427)..(427): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagacgtcaccatcacgttggccggcaagtcaggacattagaactgtacgttaggttgtatcagacagaaagtacggaacnccctaagcctccgtgtatcgtgtcgctgctactacctaactttacgaaacggttcgggtacccagttaccgtaaggttccgaaggcggacgtaggtggtactcgtcggacacgtagtactttccacttctaccaaccatcgacncgacgcctgcacgtcctagtacgtactttacacttaactttattactcgtactaactaagttactaacgtacttacccgtcggtaccgtcgacggacggacgtagggtaacgaaactaccgaaagtactcgtacggtactcgctacgtc

SEQ ID NO: 165733 - DNA, 653 bp, Homo sapiens
  misc_feature: GYAE6OF01DKZM3.15.67.G01.1.454.CMB.1.raw
  modified_base (213)..(213): a, c, t, g, unknown or other
  misc_feature (213)..(213): n is a, c, g, or t
  modified_base (229)..(229): a, c, t, g, unknown or other
  misc_feature (229)..(229): n is a, c, g, or t
  modified_base (462)..(462): a, c, t, g, unknown or other
  misc_feature (462)..(462): n is a, c, g, or t
tcagtctacgtagccacgaccggtgctcgatttagagtatacatattgggtttgggggcaggagtcagacccactcagtacacagcatggacatgagggtccccgctcagctcctgggctcctgctgctctggctcccaggtgccagatgtgccatccagatcgacccagtctccatcctcctgtctgcatctgtaggagacagagtcaaccntccacttcggccgganaaggtcaggactattagaactgtacttagggttgtactcgaagacaaggaaacgtaccggggaaaaccgtaccccctaaggccttacccgtagtacgtccgttgtcggcttcgctacgttaccctactttaacggaaggttccggggtacccaagtacgtaacgggttcgacggtaccggtacgtaaggtcgggtaacttcggtacggacaacgtacggtatttcccgacctntacccaacgtatacgacgactccggacctggacacggtaccgtagaacttacgttacaacgtttaattcgtaactacgttactaacgtaatacttaactacgttacccggacgtacggttccggacgtaacgggactaagggttgaaactacggaaacgttacgtgggtacgtacgctaccgtacttacgg

SEQ ID NO: 165734 - DNA, 554 bp, Homo sapiens
  misc_feature: GYAE6OF01B03EU.15.67.G01.1.454.CMB.1.raw
  modified_base (225)..(225): a, c, t, g, unknown or other
  misc_feature (225)..(225): n is a, c, g, or t
  modified_base (275)..(275): a, c, t, g, unknown or other
  misc_feature (275)..(275): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccggnaagtcaggacattagaactgacttaggtggtatcagcagaatccgggaancccctaagctctgatctgtgctgcatcctactttaacaaaggtcgggtaccatcgtaaggttcagcgcagtgatcgtgctacagtatttacactctcaccatcagcagcctgcagtcctagaacgtacttacgactaactttactacttcgtacttaacaattacttaactaacgttacccgtacggtaccgttccggaccggtaacggggaaccgtaagggtacggtaaactaccggtaaaacgacgttacgggtacggtacctcgtaccaccttacg

SEQ ID NO: 165735 - DNA, 737 bp, Homo sapiens
  misc_feature: GYAE6OF01CQZXA.15.67.G01.1.454.CMB.1.raw
  modified_base (287)..(287): a, c, t, g, unknown or other
  misc_feature (287)..(287): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttcggccgggcaagtcaggactattagaactgacttaggttggtatcagacaagaacgtaccgggaaacncccctaagcctcgtgactcgtggtcgctgctactcctaactttaacgaacggttccgggtacctagtacgtaaggttcgacggcggtacgtaggtcggactcggtggacctagtaacgttactttaccgtaccttactaccctaacctacgtaccgaacggtcctaacgcccgttaggaccgtaccggttaccctaagggttaaaccttacgttttaccggaacctttaaacttttaaccgtttaacgttaccggtttaaccttaaaccgtaaaggtttaacccttttaaacccggtaaccgttttaaccccgggttaaccgggtttaccggttacccggggtaaaccgggtaccgggtaaaacccggtaaggggtaaaccggtaaaacgtaaaccggtaaaaccggtacgttacgggtaacggtacctacggaaccctaccgttaaccg

SEQ ID NO: 165736 - DNA, 814 bp, Homo sapiens
  misc_feature: GYAE6OF01BVZJS.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagacgtaccacctaatcgtaccgttcgggacccgggactaaacggttccgaagggtaacctaagtttaacggaaaccgttaggtaaccgttttaaggggttaggtaacttacgaagaccgaaacggtaaaaacggttacccgggggaaaacctacccccgtaaaggcccttaccgtagtactcgtgtcgtctacgactaacttacctaaacgtttaacgaacgggtcgggtacctaagtaccgtaaggtacgacggtcggactaggtagtacgtcgtaggaccacgtagtactttccacttacctaacaaccgtaatcgaacgaccgaacgtcccgtagaccctaagtacccgttaagtaaaccgttcgtttaaccggaacctttaaacgttttaaccgttacgtaccggttaaaccttaaaagtaaacggtttaaccctttaaaccttaacccggttaaccccggtacgggttaaccggtttaccccggggaaaccgggaaacgggggtaaaccgtaaaaggggttaaacgtaaaaaccggtaacccgaaaaacggtaaccggttgggtaaacccgggtcttaaacccgggaccttaaaccgttacccgg

SEQ ID NO: 165737 - DNA, 736 bp, Homo sapiens
  misc_feature: GYAE6OF01DDS6Z.15.67.G01.1.454.CMB.1.raw
  modified_base (208)..(208): a, c, t, g, unknown or other
  misc_feature (208)..(208): n is a, c, g, or t
  modified_base (241)..(241): a, c, t, g, unknown or other
  misc_feature (241)..(241): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggcctcccaggtgccagatgtgccatccagatgaccctagtcctccatccctccctgtctgctatcgtagtagganacgagtacgtccaccatcacgttcggccggganaaggtcaggtacattagaactgacttaggttgtatcgagacaaggaaacgtaccggggaaactacccccgtaagccttaccgtaggtacttccgtaggtcgacgttgaccctacttacccctaaacgtttaacggaaacgggttccggggtaaccctagtacgtaacgggttcgacgggacggccggaggttcggacgttcgtacggtactacgaacggtttacttacctacctacctaccacctaactacgtacgacgtacgtccgtacgaccgtaccgaccgtacgtaacgttacgtttacgtaacccgttaactttaacgttaacttacggtaccttaaacgtaaacgttacttaacctaacccgtttacccggtaccgggttacccggtaccggtccgggtaaaccggggaacgttaaacgggtaaggtaaaccttacccgtaaaacggtaccgttacgggtacggtaccgtaccgtccgtaacccgtacg

SEQ ID NO: 165738 - DNA, 811 bp, Homo sapiens
  misc_feature: GYAE6OF01BKKRY.15.67.G01.1.454.CMB.1.raw
  modified_base (234)..(234): a, c, t, g, unknown or other
  misc_feature (234)..(234): n is a, c, g, or t
tcagtctacgtagccacgaccggtgctcgatttagagtatacatattgggtttgggggcaggagtcagacccactcagtacacagcatggacatgaggtccccgctcagctcctggggctcctgctgctctggctcccaggtcgccagatgtgccatccagatcgaccctagtcctccatccctccctgtctgctatcgtgtagagacagactcactatctacgttggccgganaagtcaggactaagttagaacgtgtacgttagggttacgtatacgacgtacgaaggtaaacggttacccgggaaacgtacccccgttaaaggtcccttaccgtaggtacctttcgttcgggtacggttacctacggtaccttaaccctttaaccccgtttaaacggttttaaaaccggtaaaccggggttccgggggttaacccctaaggtaccggttaaacgggtttccggaaacgggtccgggtacgtaaacggggttcgaaccgttacggtacggaaccgttacgaacggttttaacttccgtaccccttacgttaacctaaccgacttaccggacgtacgtacggtcctacgacgtacgtaccgtaggtaacttccgttaaccgtaacttaacgtttacgttaacttccggttaacctaagtaacgttaacgtttaaccgttaaaccttcccgggttaaccggttaccgggtacccggtaaccgggtaaacgggtaacccgtaaggggtaacgtaaaaccgaacgttaaaaccggtacggttcgggtacgtacgtacgacccgttacccgtag

SEQ ID NO: 165739 - DNA, 698 bp, Homo sapiens
  misc_feature: GYAE6OF01EL477.15.67.G01.1.454.CMB.1.raw
  modified_base (293)..(293): a, c, t, g, unknown or other
  misc_feature (293)..(293): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatcgacccagtctccattccctccctgtctgcatctggtaggagacgagacgtcaccatcgacgttcggccggcaagtcaggactatagactgtacttggttgtatacagacaaggaacgtaccgggaaacnccctaagcctacgtgatcgtgtcgctcgactacttaccttaactttaacggaacgggtccggtaaccctagttaacggtaacggttccgaaggtcggtacgtaaggtggtaacgtcgtacggactagtacgtttacctttaccgaccttccgtaccaacctacgtcaacgtaccgtacgtcccctagtcccaagggtaccctaagggtacttacgtttaccaacgtttaacttttaacgttccgttactaaccgttaacgtaaacgtttaacctttaaaccttaaccgtttaccccggtacgggttaacccggttaccgggtacgggtaaaccgggtaacggtaaagggttaacggtaaaacttaaccgaaacgttacgtcgggtacgtacgacgtaccacttcg

SEQ ID NO: 165740 - DNA, 830 bp, Homo sapiens
  misc_feature: GYAE6OF01EWYQZ.15.67.G01.1.454.CMB.1.raw
  modified_base (130)..(130): a, c, t, g, unknown or other
  misc_feature (130)..(130): n is a, c, g, or t
tcagtctacgtagccacgaccggtgctcgatttagagtatacatattgggtttgggggcaggagtcagacccactcagtacacagcatggacatgagggtcccgctcagctcctggggctcctgctgctntggctcccaggtgccagatgtgccatccagatgacccagtcctccatcctccctgtctgcatcgtagtaggacacaggacgtaccaccatccacgtttcggaccggggacaaaggtccaggaactaattaagaactgaaccgtttaggttaggtaactcgacgtaccgaaggtaaacgtacccgggggaaaactcccccgtaaggtccttaccgtagactttcgtgtcgtctaggtctacgtaccctaactttaacgaaacggttcggggtaccctagtacgtaaggttacgacggtacggtacgtaggttggtaactcggtacggtaccaacggtaacgttaacttttaccaaccgtttcctacctaaccctaacgttacccgacgaccgtacgtaccgtcggtaaccgtaccggtaccgttaacgtaaacggtttacttttaccggaaccttttaaactttaactttacccggttacgttaaaccgttaacgttaaacgtttaaaccgtttaacccgttaaacggtttacccccggttaacgggtaaccccgggtttaacccgggtaacccggggtaaacgggggttaaaccccggttaaagggggtaacggttaaaacccgtaaaccgggtaaaacccgttaaccgggtacgggttaccggtaacccggttaacgacccgttaacccgtttaaccgg

SEQ ID NO: 165741 - DNA, 610 bp, Homo sapiens
  misc_feature: GYAE6OF01CRCME.15.67.G01.1.454.CMB.1.raw
  modified_base (371)..(371): a, c, t, g, unknown or other
  misc_feature (371)..(371): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatccctccctgtctgcatctgtaggagacagagtcaccatcacgttgccgggcaagtcaggacattagaactgacttaggttggtatcagacaagaaacgtaccggggaaagcccctaagcctacctgatctgtgctgcatcctactttaacgaaaggtcgggtaccagtacgaaggttcagcggcaggtgatcgnggacacagtacttcactctacaccatcgacgcagcctgccacgcctaggaacttactttccgacttaactttaagttactacgttaacctaacgaagttaacttaacctaacgtttaccccgtacgggttaaccgttccgggaaccgtaacgggggtaacctaaaggggttacggaaaacgttaaccgaaaaaccggtacgttaggttaccgggtacttaacgggcctaaccgttaccg

SEQ ID NO: 165742 - DNA, 791 bp, Homo sapiens
  misc_feature: GYAE6OF01DWCHI.15.67.G01.1.454.CMB.1.raw
  modified_base (206)..(206): a, c, t, g, unknown or other
  misc_feature (206)..(206): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtcgccagatgtcgccatccagatcgacccagtctccatccctccctgtctgctatctgtagganacgagacgtcacatcacgttcggccggacaagtcgaaggactaagttaacgaacttaggtacgtttagggttaggtatcgaagacaaaggtaaccggtaccggggaaacccaccccgtaagccttccgtagtacgttccgtggtcgtctcgacctacttacctaacgtttaacgtaacgggtccgggtaacctacgtaacgtacggtacgacgggtccggaacgtggtaggacgttcggtaggaccgtaacgttacgttactttcctacctacttacccaacttacgtactacggaccttaccgcccgtagacccgtaacgtccgttaacgtaagtttccggttttaccttaaatttaacgttttacgttaaccggttacgtttaaccctaaagtttaaaccgttaacctttaacccggttaacccttttaaacccgggccgggttttaaacccgggtaccccggggtaaacgggtaaaccccgggggtaaaccgttaaaagggtaacggttaaaaaccccttaacggtaaaacccgggttacttacgggtaccggtaccgtacccgaaccgttaccgttaaccg

SEQ ID NO: 165743 - DNA, 634 bp, Homo sapiens
  misc_feature: GYAE6OF01CXLVP.15.67.G01.1.454.CMB.1.raw
  modified_base (310)..(310): a, c, t, g, unknown or other
  misc_feature (310)..(310): n is a, c, g, or t
  modified_base (423)..(423): a, c, t, g, unknown or other
  misc_feature (423)..(423): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatccctccctgtctgcatctgtaggagacagagtcaccatcacttggccgggcaagtcaggacattagaactgacttaggttgtatcagacaagaactaccgggaaagcccctaagctcctgactcctggttacnctgactatcctaacgtttacaaaggtcggggtacccagtacgtaaggttcgacgcggtacgagtggattcgtggacctacgaagttactttacgaaccttcctaccacctacncgtaacgcaacgccctagctacgcctagtaagttactttcgaacttaactttatttacctacgttaccttaacgtaacgttatttaaaccgtacctttaacccggtacgggttaccggttaccggaccgggtaacggggaaccgtaaggggtaaccgtaaacggtaaccgaaaacggtaccgttaggacggtactaccgccgtaacttacg

SEQ ID NO: 165744 - DNA, 675 bp, Homo sapiens
  misc_feature: GYAE6OF01DH67G.15.67.G01.1.454.CMB.1.raw
  modified_base (200)..(200): a, c, t, g, unknown or other
  misc_feature (200)..(200): n is a, c, g, or t
  modified_base (231)..(231): a, c, t, g, unknown or other
  misc_feature (231)..(231): n is a, c, g, or t
  modified_base (630)..(630): a, c, t, g, unknown or other
  misc_feature (630)..(630): n is a, c, g, or t
  modified_base (664)..(664): a, c, t, g, unknown or other
  misc_feature (664)..(664): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctcctgtctgcatcgtgtaggngaccagagtcaccatccacttggacccgggnaaagtcaaggactagttaagactgactttaggtggtatacagacgaagaaacgtacccgggaaacgtcccctaaaggcccttccgtagacttcgtcgtgtctacgctaacttccctaactttaacggaaaggttcgggtaacccagttaccgtaaaggttcacggcgtacgaagtcggatcgtaggactactaagtactttaccgacctctaccgaacctattccgagactcgtacccgtgaccgtacgacccgttaagtaaacggtttcgtttaacccgaactttaacttttactaccgttaacgttactaaacgtaacgttaacctttaaccgtaaccgtttacccgcgggtttaccggtccgggtaacccggaacggggtaactaacggggtaaanaaccgtaaccgtaaacggcgttggacctgtaccncgtaacttccg

SEQ ID NO: 165745 - DNA, 617 bp, Homo sapiens
  misc_feature: GYAE6OF01EE4XQ.15.67.G01.1.454.CMB.1.raw
  modified_base (201)..(201): a, c, t, g, unknown or other
  misc_feature (201)..(201): n is a, c, g, or t
  modified_base (228)..(228): a, c, t, g, unknown or other
  misc_feature (228)..(228): n is a, c, g, or t
  modified_base (402)..(402): a, c, t, g, unknown or other
  misc_feature (402)..(402): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatatgccatccagatgacccagtctccatcctccctgtctgcatctgtagganacagagtcaccatcacgttcgccgganaagtcaggactattagaactgtacgttaggttggtatcagacaaggaaacgtaccgggaaacgaccccgtaaagccttaccgtagacgttcgtggtcgctcgctaactccctaacgtttaaccgaaaggtcgggtaccctagtacgaaggttcgagcggacgtaggtgactcgnggacactagttacttcactctcaacctatcacgactacgtcctgaccacgtaccgtagaacgtttatttaccgaacttaacttacttactacgtaactaacgtaactaacttaactaaccgttacccgtacggtaccggttccgaacggtaacgggtaaccgaagggtaacgaaacgtaacaaacgtacgttggacggtccagacccgtagtacg

SEQ ID NO: 165746 - DNA, 841 bp, Homo sapiens
  misc_feature: GYAE6OF01D3O5V.15.67.G01.1.454.CMB.1.raw
tcagtctacgtagccacgaccggtgctcgatttagagtatacatattgggtttgggggcaggagtcagacccactcagtacacagcatggacatggacgggtccccgctcagctccgtggggctcctgctgctctggcctcccgaggtcgccagatgtcgccatccagtatcgaccctagtcctccacttccctccgtgtctcgctagtcgtaggtacggacgacgagacgtaccacctataccgtacggttcgggaccggactaacggtacaaggtactaagttaacggaacgttagggttaacgttttagggttacggtactaccggaagtaaccggtaaaaggtaaaccccggtacccggggtaaaacccctccccgttaaaggccctttaccggtaggtacttcgtcggtaccgtcctacgtacctacttaacccttaaggttaacgggtacgggtccggtactagtaacggtacgtcgacggtcgtaagtgtagtactcggactacgacttacgttctttaccgcttacccgactactacgtcacggtacctacggtccgacgtacgtacggtacgtaacggttaacttacccttaacggtaaaccttttaacgtttcgtttaaaccgtacggtaaaacctttaaacgggtaccgttttaaacctttaaacccgttaaccccggggttcccggtaacgggggttaacccggacccggggtaaacggggtaacccggtaaaacgggttaaccggtaaacgttaaaaaccgaaccggttaaacggttcccggggtagttaaccccggaccgttacccgtaaacccgttaagttccggg

SEQ ID NO: 165747 - DNA, 664 bp, Homo sapiens
  misc_feature: GYAE6OF01BL7CA.15.67.G01.1.454.CMB.1.raw
  modified_base (442)..(442): a, c, t, g, unknown or other
  misc_feature (442)..(442): n is a, c, g, or t
tcagtctacgtagccacgaccggtgctcgatttagagtatacatattgggtttgggggcaggagtcagacccactcagtacacagcatggacatgaggtcccgctcagctcctggggctcctgctgctctggctcccaggtgccagatgtgccatccagatgacccagtctccactcctcctgtctgcatcgtgtaggagacagacgtcaccatccacgttcggccgggacaagtcgaggacattagaactgtacttaggttgtatcagcaaaggaaacgtaccgggaaaccgtccccgtaagtcctaccgtgactcgtgtgactgcctaactccctaactttaacgaaacggttccgggtacctaagacgttaaggtcgacgcggcgtagtcggtatcgtcgacacgtagtacttcactccacactactcacgccacgccngcctacgtaccgtagtaacgttacgttacgtaaccttaactttacttaccgtataccgttaaactaacgttaaccttaaccgttaaccttacccgtaccgggggttaaccgtaccgggtaacccggtaacgggggaacccttaaaggggtaaccggttaaaactaacccggtaaaaccgtacggttacggacgttaccgtaccggaccctaacgttaacccg

SEQ ID NO: 165748 - DNA, 645 bp, Homo sapiens
  misc_feature: GYAE6OF01BMKYB.15.67.G01.1.454.CMB.1.raw
  modified_base (477)..(477): a, c, t, g, unknown or other
  misc_feature (477)..(477): n is a, c, g, or t
  modified_base (521)..(521): a, c, t, g, unknown or other
  misc_feature (521)..(521): n is a, c, g, or t
  modified_base (630)..(630): a, c, t, g, unknown or other
  misc_feature (630)..(630): n is a, c, g, or t
tcagtctacgtagccacgaccggtgctcgatttagagtatacatattgggtttgggggcaggagtcagacccactcagtacacagcatggacatgaggtccccgctcagctcctgggctcctgctgctctggctccaggtgccagatgtcgccatccagatgacccagtctccatcctccgtgtctgcatctgtagagacagtagtcaccatcacttcggccggacaagtccaggtaccattagaacgtgtacgttaggttggtatccgagacaaggtaaacgtaccgggtaacgccccgtaaggccttacccggtagacgtcttggtcgcgtgtacctacttaccctaacgtttaacgtaaacgggtccggggtaccctaagtaccgtaaacggttccgaacggcggcgtaaggtcggaacttcgaggacgtactaagtacttcgtaacttcacctacagtcaacgcgacgtaccncgacgtcgaccgtagtaacgtacttttcaactttaaaccgtttnttaacctcggtttaacaacgtaaattacttaacctaacgtcccgtagaaccggttcggaacgtacgggaccctagggaacgtaacaacggaactacggttcacgttccncgtactccgttaacg

SEQ ID NO: 165749 - DNA, 689 bp, Homo sapiens
  misc_feature: GYAE6OF01EJ988.15.67.G01.1.454.CMB.1.raw
  modified_base (355)..(355): a, c, t, g, unknown or other
  misc_feature (355)..(355): n is a, c, g, or t
  modified_base (370)..(370): a, c, t, g, unknown or other
  misc_feature (370)..(370): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggcctcccaggtgccagatgtcgccatccagatcgacccagtcctccatccctcctgtctgctactcgtagtaggacgacgagagtccacctatccgtacgttcggaccggacgtaacgtcgaaggactaagttacgaactggttacgtttagggttcgtatacgaagacgaaacggtaaaccggtaccccggggtaaacctccccgtaagtcccgttaccgngtaacgttcgtcggngtaccttgaccctacttaccttaaacgttaaccggaagggttccgtaacctaagtaccggtaaggttcgaacgggccggtatacggtaggtacctcggtaggaactaacggttacgttaccttaccgaccttaccgtacctacgtactaccgacggacctacgtccgtacgaccgtacgtacgtagtacgttacgttacacgttactttactagtacgtactaagtacttaacgtacctacgttccgacgttaccggtcgaacggcggtaacgtaaggacgtaaacgaacgtaagtcggtcacggtcctacgcctcgta

SEQ ID NO: 165750 - DNA, 673 bp, Homo sapiens
  misc_feature: GYAE6OF01DZPTB.15.67.G01.1.454.CMB.1.raw
  modified_base (667)..(667): a, c, t, g, unknown or other
  misc_feature (667)..(667): n is a, c, g, or t
tcagtctacgtagccacgaccggtgctcgatttagagtatacatattgggtttgggggcaggagtcagacccactcagtacacagcatggacatgaggtcccgctcagctcctggggctcctgctgctctggcctcccaggtgccagatgtgccatccaagatcgacccagtctccatcctccctgtcctgctatcgtaggtaggagacagacgtccaccactcacgttcggccgggactaacggtcaggactattaacgaacttcgtacgttaggttggtactcgaagacaacggaaacgtcccggggaaaccgtcccccgtaagtccttaccgtgacttcgtcgtgcgtcgactacttccctaacgtttaacggtaacggttccgggtaccctagtacgtaacggttacgaacggtcggtactaggtacggacttccgtacggaccgtaacgtagttactttaccacttcctaccaccactccacgtacgacgtccagtacctacggtaccgtagaaccgttacgttaccacttaacgttacttacgttacgtaacgttaacaacgttacttaacgtaccttacccggtaccggttacgtccggaccgtacgggaaacgtaaggtaacgtaaacaccgtaaacgtagttcgacgacgtacgaccncgtaac

SEQ ID NO: 165751 - DNA, 615 bp, Homo sapiens
  misc_feature: GYAE6OF01C2PTH.15.67.G01.1.454.CMB.1.raw
  modified_base (202)..(202): a, c, t, g, unknown or other
  misc_feature (202)..(202): n is a, c, g, or t
  modified_base (269)..(269): a, c, t, g, unknown or other
  misc_feature (269)..(269): n is a, c, g, or t
  modified_base (292)..(292): a, c, t, g, unknown or other
  misc_feature (292)..(292): n is a, c, g, or t
tcagtctacgtagccacgaccggtgctcgatttagagtatacatattgggtttgggggcaggagtcagacccactcagtacacagcatggacatgaggtccccgctcagctcctgggctcctgctgctctggctcccaggtgccagatgtgccatccagatcgacccagtctccatccctccctgtctgcatctggtagganacagacgtccaccatcacgttcggccggacaagtcaggactattagaactgtacgtttaggttgtancagcgaagaacgtaccgggaacncccctaagctacctgactcgtgtcgctgcctactacccttaacgtttaacgaaacgggtccgggtacccaagttacgtaaacgggttccaggccggacgtaggtcgtactcgtaggactacgtagtactttacacctcctacacctagtcagctacgcctagcacgtcctagtaacttacttacacttactttacgttactacggtacctaaagtaacttacttaacctaacgttcccccggtaggtaccggtccggacggaacgggaaccgtaaggtacggaaactacgaaacgtacggtgtacggactcgaccgtacctag

SEQ ID NO: 165752 - DNA, 727 bp, Homo sapiens
  misc_feature: GYAE6OF01BJTAR.15.67.G01.1.454.CMB.1.raw
  modified_base (343)..(343): a, c, t, g, unknown or other
  misc_feature (343)..(343): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggcctcccaggtgccagatgtgccatccagatgacccagtcctccactcctccctgtctgcatcgtgtaggagacagagtaccacctactcacgttcggacccgggctaaggtcgaacggactaattaacgaacgtgtacgtttagggttgtatacagacaaggtaaacgtaccgggaacgtaccccgtaagtcctcctagactcgtgtcncgtcgctactacctaacttacgaacggtcggtacctagtacgtaaggttcgaggtccgactaggtacgtacgtcgtgactacgtagttacttccaccttacctaccaacgtactacgaccgcgtacccgccgttacgaccgtccggtacgttaacgtaacggtttaccgttaaccgtaacctttaaacgttttacctttaacgttcggttaaacccttaacggtaacgtttaacttaacccgttaaccggtaaccccgttaccggggttaacccgttaccgggaaccggggtaaacccggtaaagggttaaccggggtaaggtaaacccgtaaaccggtaaacggtaaccggtggttacggacccgtacacccgtcgttacccg

SEQ ID NO: 165753 - DNA, 768 bp, Homo sapiens
  misc_feature: GYAE6OF01BFRTU.15.67.G01.1.454.CMB.1.raw
  modified_base (209)..(209): a, c, t, g, unknown or other
  misc_feature (209)..(209): n is a, c, g, or t
  modified_base (232)..(232): a, c, t, g, unknown or other
  misc_feature (232)..(232): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgcccatccagatcgacccagtctccatccctccctgtctgcatctgtaggagacagngtccaccatcacgttcgccgggnaagtcaaggacattaagaactgtacgttaggttgtactcgacgtacaaggtaaaacgtaccggggaaaccgtcccccgtaaagtccgttaccgtagacttccgtaggtcgtactcgacctaacttcccgttaacgttttaacgaaacggttccggggtacccaagttacgtaaggttccagggccgcgtagtcggatcgtaggaccagtacgtactttccgactacctccgaacctagttccgaacgtaccgacgtccctacgtaccgacggtacccgtaaggtaacgtttacgtttaccgaacctttaaacctttacgtttaaccgtacgttaaccgttaaccgtaaacgtttaacctttaaacctaacccggtttaacccccgtacgggtttaacccggttcccgggaaccggttaaacggggtaaccccgggtaaaagggtttaaccggtaaaaccgttaaacccggtaaaacccggttaacggttaccgggttaccggtaacctacccgggtaaccgtaaccccgttaccgg

SEQ ID NO: 165754 - DNA, 841 bp, Homo sapiens
  misc_feature: GYAE6OF01APYAJ.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggcctcccaggtcgccagatgtcgccatccagactcgacccagtcctccactcccgtccctgtcctcgacattcgtaggtaggacaacgagtacgtccacctagttaccaccggttcggacccgggacgtaaacggtacgaacgggtaaccttaagtttaacggtaaccgttaggttaaccggttttaaggggttttacgggtaacttaccggaaggtaaccgtaaaacggtaaaccggtaaccccggggtaaaacccgtacccccttaagtccccttaccgttacgtacgttccgttggtacgccgtacgtacctaaccttacccgttaacgtttaacggaaccgggttccggtaaccctaggttaaccgtacgggttcgaccgggtccggtagtacggttacggtacctcgggtaggtaaccaacggttactttacttaccgtacccttaccgtaacctaccgtaactcccggtacgacgtaccgtacgtaccgaccgtaacgtaccgttaaggtaaccttaccgttaacgttaaccgttaactttacggtttaaccttacggttaactaaacgtaacgtttaccttaaccgtaccccgttacccggttacgggtaccgttacccgggaaccgggtaacgggtacgttaaggaacgtaacgtaacccgtaacggttacgacggtacggacaccggttaccacgttcg

SEQ ID NO: 165755 - DNA, 681 bp, Homo sapiens
  misc_feature: GYAE6OF01DB2UU.15.67.G01.1.454.CMB.1.raw
  modified_base (229)..(229): a, c, t, g, unknown or other
  misc_feature (229)..(229): n is a, c, g, or t
  modified_base (295)..(295): a, c, t, g, unknown or other
  misc_feature (295)..(295): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatcgtgtaggagacagagtcaccatcacttcggccgggnaagtcgaggactattagaactgtaacgttaggttggtatcgagacaaggaaactaccggggaaacncccctaagcctccgtgactcgtgtcgctcgactactcctaacgtttaacgaaaggttccggggtaccctaatcgtaaaggttcgaggcggacgaggtacgcgtcgtggctagagtactttcaccttcctacaacctatacgacgacgtacgtcccgtgaccgtaacggtcccgtagtaacgtttactttaccgaacctttaaacgtttaactttaaccgtacgtttaacctaacggtaaacgttaacttttaacctaaccgtttacccggtaccgggttaaccggtccccgggtaacgggaaacggggtaaaccgtaaggggttaacggaaaaccttaaccgtaaaacggtacggttcggtacggtacgtaccgaacctcgttacg

SEQ ID NO: 165756 - DNA, 688 bp, Homo sapiens
  misc_feature: GYAE6OF01AM28W.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggttgccagatgtgccatccagatgacccagtctccatcctccctgtctgcatcgtgtaggagacagagtccacatcacttggccggcaagtcaggacattagaactgacttaggttgtatcgagacaagaaacgtaccggaaacgaccccgtaaggcctcctagatcgtgtcgctacgacactacctaacgtttaacgaacggtccgggtaccctagtacgaacggttcgacggcggacgtaggtcggtacgtacgtcggacctacgtacgtaacgtttcaacctacctaccaacccgtaactacccgacgtaccgacgtcccgtagaccgtacgtaccgaagtaacgttacgtttacgaaccttaacgtttaacgtacgttacgtaactaaacgtaacgttaacttaaccgtaaccgtttaccccggtacgggtaccggtttaccgggaaccgggtaacggggtaacccgtaaaggggttaacgaaacgttaaacccgtaaaacgtacggttaggtaccggtaccgtacggacccgtaacgtaccg

SEQ ID NO: 165757 - DNA, 675 bp, Homo sapiens
  misc_feature: GYAE6OF01AP8ST.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgaccccagtctccatcctccctgtctgcatctgtaggagacagagtcaccatcacgttcggccgggcaagtcaggacattagaactgacttaggttgtatcagacaagaacgtaccgggaacgcccctaagcctcctgactcgtgtgctcgactacgtacctaactttaacgaacggttccggggtacccagtacgtaacggttcacggcggacgtagtggatcgtacggacaacgtacgtactttaccgaaccttcctactacctatcacgacacgtccacgccgacgtaccgtagtaacgtcttttacgacttaacgtttacttaaccgttacggtttaactaaacgtacgttaaacttttaaccgtaaacccgtttacccggttaccgggtaaccgtttacccgggaacccgggtaaccggggaaaccgtaaacggggtaacggtaaaccttaacccggtaaaacggtaccgttacggaccggtacgtaccggaccttaccgttaccgg

SEQ ID NO: 165758 - DNA, 748 bp, Homo sapiens
  misc_feature: GYAE6OF01B0IEI.15.67.G01.1.454.CMB.1.raw
tcagtctacgtagccacgaccggtgctcgatttagagtatacatattgggtttgggggcaggagtcagacccactcagtacacagcatggacatgaggtcccgctcagctcctggggctcctgctgctctggctcccaggtgccagatgtgccatccagatcgacccagtcctccatccctcctgtctgctatcgtgtaggagacagacgtcaccatcacgttcggccggacaagtcgaggactattaacgaactgtacgtttagggttagtatcgagacaaggtaaaccgtccgggaaactccccgtaagcctccgtagacgttcgtagtcgactgacctaacttacccgaacgtttaacggaacggtccgggttacccaagtaccgtaacggttcacgggtcgtacgtaggtcggtactcggtacggaccaacgtagttacttcctaccgtcctaccgacctaactaccgacgtaccgtaacgtccgtacgaactaccggtaccgtaaggtaacgtttaccgtttaaccggtaacctttaaacgtttacgtttaaccgttaccggttaacttaaaccggttaaacgtttaacccgtttaacccgttaaccggttttaacccggtacgggttaccggttacccggtaaccggggtaaacgggtaacccggtaaagggttaacgtaaaaccgtaccgggtaaaaacgtcggttacgggacgttaccgaccggtacctaaccggttacg

SEQ ID NO: 165759 - DNA, 707 bp, Homo sapiens
  misc_feature: GYAE6OF01DD94A.15.67.G01.1.454.CMB.1.raw
  modified_base (202)..(202): a, c, t, g, unknown or other
  misc_feature (202)..(202): n is a, c, g, or t
  modified_base (230)..(230): a, c, t, g, unknown or other
  misc_feature (230)..(230): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggcctcccaggtgccagatgtgccatccagatcgaccagtctccatcctccctgtctgcatctgtagganacagagtcaccatcacgttcggccgggnaagtcaggactaattagaactgtacgttaggttgtatcgaagacaagaaacgtaccgggaaacgtccccgtaaacgctccgtagacttcgtggtacgctgactacgtaccctaacgtttaacgaagggttacggtaccctaagttacgtaacggttcacggacgacgtacggtagtacgttcgtaggtactaacgtacggttactttacctaacctcctacctaacctactaaccgacgtaccgtaacgtccgtacgaccgtaaccgtacccgttaacgggtaaactttacgtttaccccgtaactttaaacgtttacttaaccgtttacgttaacccgtaagtaaacgttaacctttaaccgttaaccgtttaacccggttaccgggtaaccggtccggtaccgggaacgggtaacccgtaagggtaacgtaaacgtaacggtaaacgacgttaggacgtgtaccgacgacctacg

SEQ ID NO: 165760 - DNA, 858 bp, Homo sapiens
  misc_feature: GYAE6OF01DO9NL.15.67.G01.1.454.CMB.1.raw
  modified_base (308)..(308): a, c, t, g, unknown or other
  misc_feature (308)..(308): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggcctcccgaggtcgccagatgtcgccatccagactcgaaccctagtcctccacttccctcctgtctgctactcgtggtaaggacgacgagtacgtaccaactactcgtacgttcggaccgggtataacgtcgaacggactaagttacgaacgttggtaacgtttagggttagtanacgagacgaaaggaaacggtaccccgggtaaacctaccccttacgtccttacgttagtacgttccgtgggtccgtcctacgtacctaacttaccccgttaaaacgtttaaacggaacgggggttccggtaaccctagttaacgggtaaacgggttccggaacgggtccggtacggtacggttacggtaccgttcgggacgaaccgttaagttaacgtttcctttaacccacccttaccgtaaccctaacgtactaaccggaacgaccgtaccggtaccttccggggaacctaccggtaaccgttaaagtaccggtttaacctttaccgtaactttaacttttaacggtacctttaccgttaaacctaaaggtaaccctttaaacttaacccgttaacccggttcccgggttaaccccgggtaacgggtaccccgggttaaaccggggaaccggggtttaaaacgaaaggggtttaacccaaaacggggttaaaccctaacgggttacgggttacgggtcccgtaacggtacccctacgtaacgttacccg

SEQ ID NO: 165761 - DNA, 738 bp, Homo sapiens
  misc_feature: GYAE6OF01APFPM.15.67.G01.1.454.CMB.1.raw
  modified_base (171)..(171): a, c, t, g, unknown or other
  misc_feature (171)..(171): n is a, c, g, or t
  modified_base (199)..(199): a, c, t, g, unknown or other
  misc_feature (199)..(199): n is a, c, g, or t
tcagtctacgtagccacgaccggtgctcgatttagagtatacatattgggtttgggggcaggagtcagacccactcagtacacagcatggacatgaggtcccgctcagctcctgggctcctgctgctctggctcccaggtgccagatgtgccatccagatgacccagtccnccatcctcctgtctgcatcgtgtagganacagtacgtcaccatccacgttcggaccgggacagtcaggacattaacgaactggtacgttaggttgtactacgacgacgaggaaacgtacccgggaaacgtacccccgtaagcctaccgtagacttcgtagtcgtctagcctactacctaacgtttaacgaaacggttccgggtaccctagtaccgtaacggttccgaacggcgggtacgtaacggtcggtaaccgttcggtacggtacccgtaacgtaacggttacttttacccgaacgttacccttaccgaaccctactaccgacgtacctaacgcccgtcgaccgtaaccgtccgtaacgtaacgttaccttacggtacctttaaacgtttacttaacgttcgttaaccgtaacgtaacttaacgttaccttaaaccgtttacccggtacgggttacccgttaccggggaacccgtacggggtaaacccgtaacgggtaacggaaaacgttacccggaaaacgttacgttacggtacggtacctcgggtaaccctaacttaccgg

SEQ ID NO: 165762 - DNA, 628 bp, Homo sapiens
  misc_feature: GYAE6OF01A1OZO.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttggccggcaagtcaggacattagaactgacttaggttggtatcagcagaaataccgggaaacgaccctaagctcctgtatctgtgctgcatcctacttaacaaagttcggggtaccctagtactaacggttcaggcggctaggtacggtatcgtggacacgtagtactttcacttcctaccaacctatacaacgaccacgtccgtacgcacgtccgtagtaacgtactttcgacctaactttacttaccgttagtacttaacgaaagttacttaaccgtaaccttacccgtacggttacccggttccgggtaaccggtaacggggtaaacccgttaagggtaacggttaaaacgtaacccgtaaaaggtacccgttagggtacggtacgtaccggtactacccgttaacg

SEQ ID NO: 165763 - DNA, 625 bp, Homo sapiens
  misc_feature: GYAE6OF01DXB4M.15.67.G01.1.454.CMB.1.raw
  modified_base (280)..(280): a, c, t, g, unknown or other
  misc_feature (280)..(280): n is a, c, g, or t
  modified_base (465)..(465): a, c, t, g, unknown or other
  misc_feature (465)..(465): n is a, c, g, or t
  modified_base (616)..(616): a, c, t, g, unknown or other
  misc_feature (616)..(616): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatccctccctgtctgcatcgtgtaggacgacgagacgtccaccatacctacgttcggccgggacaacgtcgaggactaagttagaacgtgtacgttaggttgtancagacaagtaaacgtaccgggtaaccgacccgtaagtccttccgtagtacttcgtggtcgcgtacgtactactacccttaacgtttaaccggtaaggtccgggtacctaagtacgtaacggtcgacggtcggtacgtaggttacgagtcgtaggaccaacgtattcttaccacttcctaccactntacgacgacacgtccgtagctacgtacgtagtaactttcttactacgttaactttagttctacgttacctaagtacttaactaactaccgttccgtaccgtcgtcgaccggacgtaacgtaggtaactagtacgaagtacgtggtacgacncgtctatcg

SEQ ID NO: 165764 - DNA, 627 bp, Homo sapiens
  misc_feature: GYAE6OF01BY4LK.15.67.G01.1.454.CMB.1.raw
  modified_base (298)..(298): a, c, t, g, unknown or other
  misc_feature (298)..(298): n is a, c, g, or t
  modified_base (353)..(353): a, c, t, g, unknown or other
  misc_feature (353)..(353): n is a, c, g, or t
  modified_base (583)..(583): a, c, t, g, unknown or other
  misc_feature (583)..(583): n is a, c, g, or t
tcagtctacgtagccacgaccggtgctcgatttagagtatacatattgggtttgggggcaggagtcagacccactcagtacacagcatggacatgacgggtccccgctcagctccgtggggctcctgctgctctggcctcccgaggtcgaccagatgtcgccatccagatcgacccagtcctccactcctccctgtctgctattcgtaggtagggacgactagacgtaccacctatctacgttcggaccgggataaacggtcgaaggactagttaagaacgtgtaacgttaggtgtancgagtacaagaaacgtaccggaaactccccgtaagtcctcgtagtactcgtgtcnctgactatacctacgttaagaacggtcggtaccagtaacgtaggtacgacgtcgacgtaggtgtacgtcgacgtacaagtagtacgttacacgtctacacgtatactacgactacgcgtacgcgacgtacgtagaagttacgtactaacttaacgtactacgtaccgaactaagtcaagttaataacgtaactcggttaacgttacgggaacggtaacggaacgtaaggngaaacgtacgaacgtaaacgtcgttacgagtactacgtataacg

SEQ ID NO: 165765 - DNA, 638 bp, Homo sapiens
  misc_feature: GYAE6OF01AIL2Z.15.67.G01.1.454.CMB.1.raw
  modified_base (240)..(240): a, c, t, g, unknown or other
  misc_feature (240)..(240): n is a, c, g, or t
  modified_base (363)..(363): a, c, t, g, unknown or other
  misc_feature (363)..(363): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgctatctgtaggagacagagtcaccatccacgttgccgggacaagtcagganacttagaactgtacttaggttgtatcagcaagaaacggtaccggaaacgccccgtaagcctccgtagctctgtgctgccatcctaactttaacaagtcgggaccctatacgaggttcagcganacgtggactcgtggacacgagttacttcacctcttacaccactcgaacgcctaacgccctagaccgtacgtccctaagggtaacttaacgtttacgaaccttaacttttactttaaccgttcgtaacttaacgtaacttaactttaaccctaaaccgtttacccggttaccggttaccggtttaccgggacccggtaacgggggtaaaccctaagggtaacggtaaacgtaccgtaaaacgtacgttacggtaggacctacgcgtaaccttaacg

SEQ ID NO: 165766 - DNA, 660 bp, Homo sapiens
  misc_feature: GYAE6OF01ACZFC.15.67.G01.1.454.CMB.1.raw
  modified_base (208)..(208): a, c, t, g, unknown or other
  misc_feature (208)..(208): n is a, c, g, or t
  modified_base (650)..(650): a, c, t, g, unknown or other
  misc_feature (650)..(650): n is a, c, g, or t
tcagtctacgtagccacgaccggtgctcgatttagagtatacatattgggtttgggggcaggagtcagacccactcagtacacagcatggacatgagggtcccgctcagctcctggggctcctgctgctctggctcccaggtgccagatgtcgccatccagatcgacccagtctccactccctccctgtcctgcatcgtaggtagganacagcgtaccaccatccacgttcggccggacaaggtccaaggactattacgacgtgtacgtttaggtggtactcacggactaaggtaaccggtacccggaaaaccgtcccgttaaacgcctcgtcgaacttcgtagacgtctcgactacttacctaacgtttaacggaacgggtttcggaccctagtacgtaacggtcacggcggtcaaggttgacttggaccggataccgtagttaccttactacctacctaccgtacctactacgacgacacgtaccgtacgtacgtacgtacgtacgtaacttacgttacgtacttaacttacttactacgtactaactaacgttaacttaacctaccgtaccgttcgtaccggtaccggaccggaacggtacggtaaggtaacgtaacgaacgtaacgtaacgtcgtagtacgctacnccggggttac

SEQ ID NO: 165767 - DNA, 775 bp, Homo sapiens
  misc_feature: GYAE6OF01AJ54F.15.67.G01.1.454.CMB.1.raw
  modified_base (205)..(205): a, c, t, g, unknown or other
  misc_feature (205)..(205): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatccctccctgtctgctatcgtagtagganacagacgtcaccatccacgttcggcccgggacaacgtcgaggactaagttaagaaccttgtaaccgtttagggttggttactaccgaaggactaaggtaaacgtaccgggaaaccgccccgtaagtcctcctagtattcgtgtcgcctggccctataccccttaacgtttaacgtaacgggttccggggaccctagttaccgtaaggttccgaggccggtacgtaacggtgggacctcgtacggacctaacgtacgttaccgtttaccctacttccctaccgtaacctaacgtacccgtaacgggaccgtaaccgtccgttacggacctaccggtaccgttaggaaccgtttacgttacccgtaaccttaacgtttttaaccgttaccgttaaccgttacgttaaaacccggtattaaacctttaaacccgtaacccgtttaccccggttacgggttacccggtacccgggtaaccgggtaacccggggtaacgttacggggtaaacggtaaaccgtaaaccggtaaacggttaccgtagggttaccgttacgacgtccctacgttaacg

SEQ ID NO: 165768 - DNA, 662 bp, Homo sapiens
  misc_feature: GYAE6OF01A0WST.15.67.G01.1.454.CMB.1.raw
  modified_base (436)..(436): a, c, t, g, unknown or other
  misc_feature (436)..(436): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtcctccatcctccctgtctgcatctgtaggagacaggactaccacatcacgttcggccggacgaacgtcgaaggactagttaagacgtagtacgttaggttgtatcgagacgaagaacgtaccgggaaccacccgtaagctcgtacgtactcgtgtcgctgctactacctaacttacgaacggtcggacctacgtacgtaacgttcgaggcgcgtagtgactcgtacggctaacgtacttcgttacctacctaccgtacaaccctntaccgacgcctacgtcgtcgacgtcggtacctaggtaacttacgttaccgtaacttaacgtttacttacgttaactaactaacgtaattaactttaaccgtaacccgttcccggtaacggttacccggttaccgggaaccggtaacggggaaacgtaacgggtaagttaaaaccaaccggtaaaacggtacgtttacgggacgacgttaacccgctaccgttaccg

SEQ ID NO: 165769 - DNA, 719 bp, Homo sapiens
  misc_feature: GYAE6OF01AJ8GM.15.67.G01.1.454.CMB.1.raw
  modified_base (230)..(230): a, c, t, g, unknown or other
  misc_feature (230)..(230): n is a, c, g, or t
tcagtctacgtagccacgaccggtgctcgatttagagtatacatattgtgtttgggggcgaggagtcagacccactcagtacacagcatggacatgagggtccccgctcagctcctggggctcctgctgctctggctcccaggtgccagatgtgccatccagatgacccagtctaccatccctcctgtactgacatctgtagagacagatcaaccatcacgttgccgganaagtcaggactagtaagaactgtacgttaggttgtactcagtcaaaggaacgtaccgggaaacacccgtaagcctacgtagtactcttaggtctaccgtgacctaaccttacccgttaaacgttttaaccggaaacgggtacccggggttcccaaaacgtttcggtaaacggggttcccaagggtcccgggaagttaacggggtacgtacgtaccgtcggaacctagtaacgtactttaccgacttcgtaaccgacctatacgaacggactaacggtccacgtactacgtacgtaagtaaacgttcgttacgaaccttaatttaccttaacgtcgttaaataacgtaaacgtaacttaaccttaaccggttacccgtagggtacccggttcgtaaccgggaacccggggttaacgaaagggtacggaaaaccttaaaactaaaccgggttacgtacggttaaccgggtctacccgggtaactaaacccg

SEQ ID NO: 165770 - DNA, 566 bp, Homo sapiens
  misc_feature: GYAE6OF01A5CYI.15.67.G01.1.454.CMB.1.raw
  modified_base (201)..(201): a, c, t, g, unknown or other
  misc_feature (201)..(201): n is a, c, g, or t
  modified_base (379)..(379): a, c, t, g, unknown or other
  misc_feature (379)..(379): n is a, c, g, or t
  modified_base (411)..(411): a, c, t, g, unknown or other
  misc_feature (411)..(411): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtagganacagagtcaccatcacttggccggcaagtcaggacattagaactgacttaggttggtatcagcagaaatccggaaacgcccctaagctcctgatctagtgctgcactacctacttttaacgaaaggttcggggtacccagtaccgtaaggttccagcggcaggtggactcgtggacanagtactttcactctacaccatcagtcagtccngaccagcctagacgtatttcgacttaacttattacctcgtactaactaagtacttaacctaacttacccgtacggttaccgttaccggaccgacggggtaaccgaagggtaacgtaaactaccgaaaacgtacgtggtacgactcgcctcgtaac

SEQ ID NO: 165771 - DNA, 574 bp, Homo sapiens
  misc_feature: GYAE6OF01B6M59.15.67.G01.1.454.CMB.1.raw
  modified_base (562)..(562): a, c, t, g, unknown or other
  misc_feature (562)..(562): n is a, c, g, or t
  modified_base (569)..(569): a, c, t, g, unknown or other
  misc_feature (569)..(569): n is a, c, g, or t
tcagtctacgtagccacgaccggtgctcgatttagagtatacatattgggtttgggggcaggagtcagacccactcagtacacagcatggacatgagggtccccgctcagctcctgggggctcctgctgctctggctcccaggtgccagatgtgccatccagatgacccagtctccatcctccctgtctgcatctgtaggagacagagtcaccatcacttggccggcaagtcaggacattagaactgactttaggttggtatacagacaagaaacgtaccgggaaacgcccctaagcctcctgtacttcgtgtgctgctactcctactttaacgaaggtcgggtacctagtacgtaaggttcgacgtcggctaggtggacttcgtcggacacgtacgttactttcaccttcctacaccactcacgcacgcctgacctacgtctaggaatactttacgaaccttaactttacttactcgttactaacgaatacttaactacttacccgcggtacgtccgacgacgggtacaaggtacggtaaactacgaaacgacgtcgtcgntagaccngtacg

SEQ ID NO: 165772 - DNA, 716 bp, Homo sapiens
  misc_feature: GYAE6OF01DPREG.15.67.G01.1.454.CMB.1.raw
  modified_base (201)..(201): a, c, t, g, unknown or other
  misc_feature (201)..(201): n is a, c, g, or t
  modified_base (235)..(235): a, c, t, g, unknown or other
  misc_feature (235)..(235): n is a, c, g, or t
tcagtctacgtagccacgaccggtgctcgatttagagtatacatattgggtttgggggcaggagtcagacccactcagtacacagcatggacatgagggtcccgctcagctcctggggctcctgctgctctggctcccaggtgccagatgtgccatccagatcgacccagtctccatccctcctgtctgcatctgtagganacagcgtccaaccatcctacgttcggcccggganaacgtcgaagtactaattacgaactcggtacgtttaggttaggtactcgagacaagtaaacgtaccgggaacgtacccctaagtcctaccgtagtactccgtgtcgtcgtcgactacgtcctacgttaacgaacggtcgggtaccctagtacgtaggtcgacgtcggacgtaggtagtacgtcgtacgactacgtacgttacttaccgtacctctacctaacacttacgacgtacgtacgtaccgtcgacgaacgtccgtaatacggttacttacggtaaacctttaagtttaccttacgttacttaccgttaaactaacgttaacttaaccgttaaccgtacccggttccggttaaccggtccgggtaacccgggtaacgggtaaaccggttaagggtaaccggaaaaccgtttaccggaaaaacccgttacgggtaaccgttacgggacccggttacgaaccccggttacctttaaccg

SEQ ID NO: 165773 - DNA, 634 bp, Homo sapiens
  misc_feature: GYAE6OF01AQ07Z.15.67.G01.1.454.CMB.1.raw
  modified_base (406)..(406): a, c, t, g, unknown or other
  misc_feature (406)..(406): n is a, c, g, or t
  modified_base (438)..(438): a, c, t, g, unknown or other
  misc_feature (438)..(438): n is a, c, g, or t
  modified_base (443)..(443): a, c, t, g, unknown or other
  misc_feature (443)..(443): n is a, c, g, or t
tcagtctacgtagccacgaccggtgctcgatttagagtatacatattgggtttgggggcaggagtcagaccccactcagtacacagcatggacatgagggtccccgctcagctcctggggctcctgctgctctggctcccaggtgccagatgtgccatccagatgacccagtctccatccctccctgtatgctatctggtaggagacagtacgtccaccatccacgttcggccgggcaaggtccaaggtacaattacgaactgtaactttagggttaggtatacgagacaacgtaaacgtacccgggaaacgtacccccgtaagtcctccgtagtactcgtgtcgctagacctacttacctacgtttaacgaacggtcggtaccctagtacgtaacgtcgagcggngagtgactcgtagacacgtagtacttcactcnctacnctcagtacgcgtcctagacctacgcgtagtaacgttacgttacgacttaacttacttacgtacgttactaactaacgttacttaaccttaacccgttaccgtcgggttaccgtaccgaccgggtaaacgggtaccgtaagggttaacgtaaacgtaccgaaacgtacgtgttacgacgttcgacctcgtac

SEQ ID NO: 165774 - DNA, 808 bp, Homo sapiens
  misc_feature: GYAE6OF01C6HP1.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccagtgccagatgtgccatccagatgacccagtctccatcctccctgtctgctagtcgtaggtaggacgacgagacgtaccacctatccgtacgttcgggaccggactaacggtcgacggtaactaagttaacgaaccgttaggttaaccggttttaagggttgtactacgaacggacaaacggtaaacggtaccccgggtaaacgtaccccgtaagtccgtacgtgtacttccgtgtacggtctacgactacttaccgttaacgttacgtaacggtccggtacctagtacgtaagtcgaacgcggacgtaggtacgctcggtagacacgttagttccgtttaccaccgttaccaccgtaactacgtacgaaccggtacgtaccggtccgttacgacgtaccgtaccgttaagtaaccgtttacgtttaacccaacctttaacgtttactttaaccggtagtttaaccccgtaaaggttaaacttaaacccgtttaaaccgtaacccgtttaccccgggtaacggtttaccccgggtaccggggtaacccgggtaaaacgggaacccgggttaaaggggtaaaccttaaaaccggaaacccgggttaaaaacgttcccggggttaggttaacccggtaccgttaacccgtaacccgttccggttaacccgg

SEQ ID NO: 165775 - DNA, 649 bp, Homo sapiens
  misc_feature: GYAE6OF01EDKD9.15.67.G01.1.454.CMB.1.raw
  modified_base (199)..(199): a, c, t, g, unknown or other
  misc_feature (199)..(199): n is a, c, g, or t
  modified_base (258)..(258): a, c, t, g, unknown or other
  misc_feature (258)..(258): n is a, c, g, or t
  modified_base (276)..(276): a, c, t, g, unknown or other
  misc_feature (276)..(276): n is a, c, g, or t
  modified_base (318)..(318): a, c, t, g, unknown or other
  misc_feature (318)..(318): n is a, c, g, or t
tcagtctacgtagccacgaccggtgctcgatttagagtatacatattgggtttgggggcaggagtcagacccactcagtacacagcatggacatgagggtcccgctcagctcctggggctcctgctgctctggctcccaggtgccagatgtgccatccagatgacccagtctccatcctcctgtctgcatctgtagganacagagtcaccatcacttgccgggcaagtcaggacattagaactgacttaggttgtatnagcagaaatccggaaacnccctaagctcctgatctagtcgctgacactcctaacgtttanaaacggtcgggtaccatacgaaggttcaggcggacgagtggaactcgtaggacaacctaggttactttacaccttcctaccaacctattaccgaggacctacgtaccgttcgacgtacgtcccgtaagtaacgtacgttttaccgaacctaaacttttacttaaccgtcgtttaaccgtaaagttaaacgtacctttaaacgtaacccgtttaacccgtaccgggtaaccgttaccgggaacccgtaaacgggggtaaccgaaagggttaacggaaacgttaaaccgaaaacggttaaacgtcggtacggacgttacgtaccgaacctacg

SEQ ID NO: 165776 - DNA, 688 bp, Homo sapiens
  misc_feature: GYAE6OF01DPFVM.15.67.G01.1.454.CMB.1.raw
  modified_base (201)..(201): a, c, t, g, unknown or other
  misc_feature (201)..(201): n is a, c, g, or t
  modified_base (308)..(308): a, c, t, g, unknown or other
  misc_feature (308)..(308): n is a, c, g, or t
tcagtctacgtagccacgaccggtgctcgatttagagtatacatattgggtttgggggcaggagtcagacccactcagtacacagcatggacatgaggtccccgctcagctcctggggctcctgctgctctggctcccaggtgccagatgtgccatccagatgacccagtctccatccctcctgtcctgcatctgtagganacagagtcaacatcacgttcgccgggacaagtcgaggacattagaacttgacttaggttaggtatcagcaagaaagtccgggaaactcccctaaagctaccgtgatntcgtgctagctactacctacgttacaaggtcggggtaccctatacgaacgttcgacggcggtactaggtggatcgtaggactaacggattactttacactccttaccacctatacgtacgaccagtccccgtagtccgtaacgtccctaggtaaaccggtttctttacccggtaactttaaacctttaacggtttaaccttacggttaacccttacgtaaaacgtttactttaaacccgttaacctttaaccccggtcccggggttaaaccgtcccggggtaaccgggtaacgggggaacccgttaaaggggtaggtaaaaccgttaaaccgaaaacggttaccgtaggtaccgggtataaccggacctaccgttaaacg

SEQ ID NO: 165777 - DNA, 745 bp, Homo sapiens
  misc_feature: GYAE6OF01B3I27.15.67.G01.1.454.CMB.1.raw
  modified_base (310)..(310): a, c, t, g, unknown or other
  misc_feature (310)..(310): n is a, c, g, or t
tcagtctacgtagccacgaccggtgctcgatttagagtatacatattgggtttgggggcaggagtcagacccactcagtacacagcatggacatgaggtccccgctcagctcctggggctcctgctgctctggctcccaggtgccagatgtcgccatccagatcgacccagtctcatccctcctgtctgctatcgtgtagagacagtacgtcactactcacgttcggccgggtacaagtcgaggactaagttaacgaacgttgtaacgtttaggttgtatcgaagacaaggaaaccgtaccgggaaaccncccgtagccctaccgtagacgttcgtgtcgtcgtcgtacaccttaccgtaacgtttaacgaacgggttaccggtaccctagtacgtaggttccgacggtccggacgtaggtcggtactcggtagacctacgtagttaccttcctaccttcctaccacctacgtacgaacgtaccgacgtcgtacgaccgacgtaccgtagtaaccgtttacgttaccgtaactttaacgtttacgtttaaccgttacggttaaccttaacgaaacgttttaacgttaaaccgttaacccgttaacccggttacccggttaacccgggtttacccggaaccggggttaacgggtaaaccggtaagggtaaacggtaaaaccgttaaccggtaaaccggttaacggtcgggttaacgacccggttaactcccggtaaccttaaccgg

SEQ ID NO: 165778 - DNA, 708 bp, Homo sapiens
  misc_feature: GYAE6OF01A8357.15.67.G01.1.454.CMB.1.raw
  modified_base (699)..(699): a, c, t, g, unknown or other
  misc_feature (699)..(699): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtcctccatccctcctgtctgcatctggtaggagacagagtccaccatccacgttggccgggtacaacggtcaggtacaattagaactgtacgtttaggttgtatacgagacaacggtaaacgtaccgggaaaccgcccctaaggtcctccgtagtacttcgtagtggtacctgacctacttaccctaacgtttaacgaacggttccggggtacctagtacgtaacggtcgacggcggtcgaggtggtactcgtaggacctagtacgttacttcctaccttctaccgaacctataccgaagtaaccgtccgaggaccctacggtacccgtaagtaacggttcgtttaccgtaaccttaactttaacgttaccgttaacgttaactaacgtaaagttaacctttaaccgttaaccgtttacccggtaccggtaacccgggttaccggaccggggtaaacgggtaccggtaaacgggtagtaaaaccgtaccgaaacggttaccggtaggtccggtagccgaccgttacccngtttacccg

SEQ ID NO: 165779 - DNA, 660 bp, Homo sapiens
  misc_feature: GYAE6OF01DACEW.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacgttgccgggcaagtcaggactattagaactgactttaggttggtatcgagacaagaaacgtaccgggaacgacccctaagcctcctgactcgtgtcgctcgcactcctaactttaacgaaaggtccggtccagtacgtaaggttcgaggcggtacgaggtacggagttcgtcgggacctaacgacggttactttaccaccgttcctacccaacctacgtctacgaccacgtccctacggactacgtacgtacggtaacgtctttacgtaacttaactttatttaactagttacctaactaacggttaacttaacctaccgttacccggtaccggtaccgggttacccggaaccggtaacggggtaaccggtaaagggtaacggtaaaactaacccgtaaaacgtacgttacgggtacgtcgtaacgtcccgtaacttacccgg

SEQ ID NO: 165780 - DNA, 756 bp, Homo sapiens
  misc_feature: GYAE6OF01CL7Y2.15.67.G01.1.454.CMB.1.raw
  modified_base (131)..(131): a, c, t, g, unknown or other
  misc_feature (131)..(131): n is a, c, g, or t
  modified_base (207)..(207): a, c, t, g, unknown or other
  misc_feature (207)..(207): n is a, c, g, or t
  modified_base (394)..(394): a, c, t, g, unknown or other
  misc_feature (394)..(394): n is a, c, g, or t
tcagtctacgtagccacgaccggtgctcgatttagagtatacatattgggtttgggggcaggagtcagacccactcagtacacagcatggacatgacggtcccgctcagctccgtgggctcctgctgctcnggcctcccgaggtcgccagatgcgccatccagatcgacccagtcctccatcccgtcctgtcctgctatcgtgaggngacagatcaacctagtcacgttggacccgggactaaggtcgaacggtaacctaagtttaacggaaacttcggtaacggttttaagggttacggttaactacccgaaggaaccgaaaggtaaaaccggtacccgggggaaaaccttcccccgaaagtcccgtacctaggtaacttccgtggtaaccgngttcgaacctcgtttacctaaggttttaaaccgaagggttccggaacctagtacgtaaacgggttcaacggggcgaactggtaacgtctaggtaggaccctaagtagttctttaccactttaccacgtaccacgtcgaacgtacaacggtcacgacgtactcccgaagtaccgttactaccggtaattaacggttaactaccggttactaaccgtaactaacgtaacttaaccgtaccgtttacccgacggtaccggttaccggaccggtaacgggtaaaccggtaaggaaacggttaaacctaaacgggtaaaccgtaaccggttaacggttcggaacgttcccaaaccgtcttaacccgg

SEQ ID NO: 165781 - DNA, 822 bp, Homo sapiens
  misc_feature: GYAE6OF01CWTYD.15.67.G01.1.454.CMB.1.raw
  modified_base (804)..(804): a, c, t, g, unknown or other
  misc_feature (804)..(804): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccgagtgccagatgtcgccatccagatcgacccagtctccactccctccctgtctgctatcgtggtagacgacagatccacctactaccacgttcggccgggacaacggtcgaaggaactagttaacgaacttgtacgttttagggttgtactcgaacgtacgaaaggtaaaccggtaccccgggaaaacctcccccgtaaacgtccttacccgtagtacgttcgttggttcgtacctcgtaccttacctttaacccgttaaaccggtttaaacggtaaacggggttccgggttaaccctaacgttaacccgggttaacgggttaccgagggtcccgggtaacgtacggttacgggtaccgtaccggtacggaccctaaacgttacgtttaccctttaaccctacccttccccgtaacctaacctacgtaccgtaccgacgtcccgtccgtcgaccgtaacgtcccggtaagttaacgtttaccgttccgaacttttaaccttacgtttaccgtacttaaccgtaactaacgttttaacccttaaccgttaccgtttaccccggttaccggttacccgggtaccgggtaaccgggtaacgggtaaaccggtaagggttaaaacggtaaaccgtaaaccgtaaacgtacgggtacggtacccggttanacccgacctacgtttacg

SEQ ID NO: 165782 - DNA, 739 bp, Homo sapiens
  misc_feature: GYAE6OF01EBGWE.15.67.G01.1.454.CMB.1.raw
  modified_base (726)..(726): a, c, t, g, unknown or other
  misc_feature (726)..(726): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatcgacccagtcctccatccctccctgtctgctatcgtagtaggagacagacgtccacctatctacgttcggcccggacaacggtcgaaggaactaagtttaacggaacgttacggtaacgtttagggttagttatacgaaggactaaaggaaaccggtaacccggggtaaaccaccccgtaagtccgttacccgtagtaacttcgtgtcgtctcgacctaacttacccgttaacgttaacgtaaacgggtccggtacctaaggtaccgtaaggttcgacggtcggtacgtaggtacgtcgtacgtacggaactacgtaagttactttccgacgttccctacactactacacgacgtaccgccgtacgacgttaccgtacgtacggtaacgttctttaacgtattttaactttacgttaccttacgttaactaacgtaaattaacgttaaccttaacccggttccggtaccgggttaacccggttaccggtaacgggaaacccgggtaacgtaaagggtaacgtaaacgtaacccggtaaagtaaccgttggtacgacgttaccncctaacgttaccg

SEQ ID NO: 165783 - DNA, 742 bp, Homo sapiens
  misc_feature: GYAE6OF01CALMI.15.67.G01.1.454.CMB.1.raw
  modified_base (163)..(163): a, c, t, g, unknown or other
  misc_feature (163)..(163): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtcgccatccagntcgacccagtcctccatccctccctgtctgctactcgtaggtaaggacacagtacgtccaacctataccaccgttcggaccggggtactaacggcgaacggaactagttaacgtaacgtcgtaacgtttagggttaggtactacgagtacgaacgaaacggtacccggaaacgtaccccgtaacgtccctaccgtacgtacgttaccctgggtctaccgtacgacctacgttaacccttaacggttaacgtaacgggtaccggggtacctagttaacgtaacgggttaccgaggtacgggtacgtacggttaggaactcggtacgacgacgtaacgttcctttaccactacccgttaccgactaccgtacgacgcctaccgccgttagaccgtacgtcctaagtaacgtttctacgtaactaactttcgtactacgtactaacgtaattaaccttaacctacgttcccggacggttacccggtacggaaccgggtaaccgggtaacgtaagggaaccgttaaaccggaaaccgtaacccggtaagtagggacctaaccggccaaacttaaccggtaccg

SEQ ID NO: 165784 - DNA, 844 bp, Homo sapiens
  misc_feature: GYAE6OF01CZHDS.15.67.G01.1.454.CMB.1.raw
  modified_base (390)..(390): a, c, t, g, unknown or other
  misc_feature (390)..(390): n is a, c, g, or t
  modified_base (462)..(462): a, c, t, g, unknown or other
  misc_feature (462)..(462): n is a, c, g, or t
tcagtctacgtagccacgaccggtgctcgatttagagtatacatattgggtttgggggcaggagtcagacccactcagtacacagcatggacatgagggtccccgctcagctccgtggggctcctgctgcctctggcctcccgaggtcgccagagtgtcgccataccgagtactccgaaccctgtcctaccactccctccgtgtcctcgtctagttcgttaggaaggacgtaacacggtacgtacccaacctagtccgacggttcggccggtataaggtcgaacggtactaagttacgtaaccgtgttaacggtttaggtacgtacacggtagaacgtaacggaaaccggacccggtaacctacccggtatccgtaccgtgtactcggtntaccgtcacgtacttacgtaccgttaacgtaacggtaggtacccgctacgaagggtccgagcgggagtacgnggtacggtacttcggaacggtacctaagttcgttacgttaccctagtacccgtaccgtaacgtcccgaataccggtaaccggtccgtaacggtcctacgtaaccgggtaccgttagttaacccgttacgttaacccgttaacgtttaacctttaccggttaaccgtttagtaaacccgtaaacggtttaacttaacccggtttaaacccgttaccccgggtttccccgggttaacccggttacccggggtaaacccgggttaacccgggaaaacccgggggtttacggaaaacgggttaaaccgtaacccgttaaaccccgggtaaagggttccggttaccgggtacctaacccgggtactacccggttaaacgttccccgg

SEQ ID NO: 165785 - DNA, 585 bp, Homo sapiens
  misc_feature: GYAE6OF01A37K8.15.67.G01.1.454.CMB.1.raw
  modified_base (297)..(297): a, c, t, g, unknown or other
  misc_feature (297)..(297): n is a, c, g, or t
  modified_base (377)..(377): a, c, t, g, unknown or other
  misc_feature (377)..(377): n is a, c, g, or t
  modified_base (384)..(384): a, c, t, g, unknown or other
  misc_feature (384)..(384): n is a, c, g, or t
  modified_base (388)..(388): a, c, t, g, unknown or other
  misc_feature (388)..(388): n is a, c, g, or t
  modified_base (406)..(406): a, c, t, g, unknown or other
  misc_feature (406)..(406): n is a, c, g, or t
  modified_base (562)..(562): a, c, t, g, unknown or other
  misc_feature (562)..(562): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatcgacccagtcctccatccctccctgtctgcattcgtgtaggacgacagacgtcaccatcgacgttggccgggacaagtcaggacattagaactgtacgttaggttgtatcagacgagaaacgtaccgggaaacnccccgtaagccttaccgtgtactcgtagtcgctgactactcctaacgttacgaacggtcggtaccagtcgagtcgagcgntagtcgntcgngacagagtacttcactcncacatacagcacgctacgactcgcgtagacttcttacgaacctttaacttcgtactctaactaataacttactaactaccgttcccgtaggtccgttaccggacggacgggtaacgtaagggtaacgtaaactaaccggtaaacgtacgttacggnggtaacctggacctacgttaccg

SEQ ID NO: 165786 - DNA, 657 bp, Homo sapiens
  misc_feature: GYAE6OF01CAOYI.15.67.G01.1.454.CMB.1.raw
tcagtctacgtagccacgaccggtgctcgatttagagtatacatattgggtttgggggcaggagtcagcccactcagtacacagcatggacatgagggtccccgctcagctcctggggctcctgctgctctggctcccaggtgccagatgtgccatccagatgacccagtctccatccctccctgtctgcactcgtggtaggacgacagacgtaccaccatccacgttcggaccggacaacgtcgaaggactattaacgaactgtaacgttagggttgtatcagacaacgtaaacgtaccggggaaactaccccgtaagcctcctagtactctaggtcgcctacgactacttaccctaacgtttaaccgaacgggtccggtaccctagtacgtaagggttcaggcttacgacgtaggtagtacgtcgtaggcctaacgtagtacttacctactcctaccactacacgagcctacgtcctacgcgtaccgtacgtacgtaacgttcttaccgacttaaacttcttaccgtctactaactaacgtacttaacgtaaccttaccggtaccgtacggtaccgggtaccggtacgggtaacgaacgggtacggaaacgttaaccgaaacggtaacgtacggtacgcgtcgtaacccgtaacg

SEQ ID NO: 165787 - DNA, 678 bp, Homo sapiens
  misc_feature: GYAE6OF01A35S5.15.67.G01.1.454.CMB.1.raw
  modified_base (204)..(204): a, c, t, g, unknown or other
  misc_feature (204)..(204): n is a, c, g, or t
  modified_base (230)..(230): a, c, t, g, unknown or other
  misc_feature (230)..(230): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtcctccatccctccctgtctgctatctgtagganacagagtcaccatcacttggccggtnaagtcaggacattagaactgacgttaggttggtatacagacaagaaacgtaccggggaaacgtccccctaaaggccctacgtcgaatccgtgtcggtactgtactactacctacgtttaacgaaacgggttccggggtacccagttacgtaacggttaccgacgtcggactacggtaggacttcggtacggactaaccggattacttacctactaccttaccaacctactacgacgtacgtacgtcccgtacggtacacgtaccctaaggtaaccgttacgtttaccgaaccttaactttaacgttaccttaggttaccctaaacgttaagtaacttaactaaccgttacccgtaccgggttacgttacccggaaccgggtaacgggaacccgtaagggtaacgaaacgttaccgaaaagtaccgtaggtacgcgtacgccgtactac

SEQ ID NO: 165788 - DNA, 592 bp, Homo sapiens
  misc_feature: GYAE6OF01ALH14.15.67.G01.1.454.CMB.1.raw
  modified_base (230)..(230): a, c, t, g, unknown or other
  misc_feature (230)..(230): n is a, c, g, or t
  modified_base (281)..(281): a, c, t, g, unknown or other
  misc_feature (281)..(281): n is a, c, g, or t
  modified_base (583)..(583): a, c, t, g, unknown or other
  misc_feature (583)..(583): n is a, c, g, or t
tcagtctacgtagccacgaccggtgctcgatttagagtatacatattgggtttgggggcaggagtcagacccactcagtacacagcatggacatgaggtccccgctcagctcctggggctcctgctgctctggctcccaggtgccagatgtcgccatccagatgacccagtcctccatcccttccctgtctgcatctcgtagacacagacgtcaccatcacttggccggntaagtcagacattagaactgacttggtgtatcagacagaacgtccggaacncccctaagctctgatctgtacgctgactctcctatttaaccgaaggttccggcctaatacgtaaggttcaggcgactaggtcgtatcgtaggcctaagtacgtactttcaccgttccacgtaccatccgagtaccacgcctcgactacgctagttacgtctttaccactttaacttattaccgtcttaaccgtaagttaacgttaccttaaccgtaacgtttccccggtacggtccgttacccggacggttaacgggacctaacggttaacggaacctaacgaaccttagtcgactcgtacncttacggtc

SEQ ID NO: 165789 - DNA, 688 bp, Homo sapiens
  misc_feature: GYAE6OF01DR8EX.15.67.G01.1.454.CMB.1.raw
  modified_base (292)..(292): a, c, t, g, unknown or other
  misc_feature (292)..(292): n is a, c, g, or t
tcagtctacgtagccacgaccggtgctcgatttagagtatacatattgggtttgggggcaggagtcagacccactcagtacacagcatggacatgaggtccccgctcagctcctggggctcctgctgctctggctcccaggtgccagatgtgccatccagatgacccagtctccatccctccctgtctgcatcgtgtaggagacagagtccacctatcacttcggccgggacaagtcaggactattacgaactgatttaggttgtactcagacaagtaacgtaccgggaacncccctaagcctcctgtactctgtcacttgacctactccctaacgtttaacgaacggttcggggtaccctaagtacgtaaacggttcgacggacggtacgtaggtgggtacgttcgtaggacctaacgtaacgtttacttcctaccttccgtaccaccgtataccgagtaccgagtcccgtgaccgtacgaccgtagtaacgttctttaccgaactttaacgttacttaccgtacgttactaactaagttaccttaaccgtaccgtttacccggtacggtaccggtttacccggaaccgggtaaccgggtaaaccgttaaggggtaacgtaaaaccgtaaaccgtaaaccggtaaccggttacggtaccgaaccgtacgaacccgttccttaaccgg

SEQ ID NO: 165790 - DNA, 671 bp, Homo sapiens
  misc_feature: GYAE6OF01A7XWG.15.67.G01.1.454.CMB.1.raw
  modified_base (399)..(399): a, c, t, g, unknown or other
  misc_feature (399)..(399): n is a, c, g, or t
  modified_base (437)..(437): a, c, t, g, unknown or other
  misc_feature (437)..(437): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatcgacccagtcctccatccctccctgtctgcacttctggtaaggagaccagacgtccaacctaatcaccttggccggcaagtcgaggacattacgaactgtacgtttagggttggtatcagacaaggaacgtaccgggaaacgcccctaagcctaccgtgactcgtacgtgctgcactaccgttaactttaacgaacggtccgggtacccagttaccgaaggttcgacgcggtacgnggtaggacgttacgtcggactacgtagtacgtttaccnccttacctaccgacctatcgaaccgtacaccgtccacgccgtaagtcctaagtaacgttagttacccgtacttaaccgttagttaactacgttaacgtaaaccgtaagttaaccttactaaccgttacccggttacgggtaccgtccgggtaaccgaaccggggttaaccgaaggtaacggtaaacgtaaccgaaacgtaacggttcggtaaccggtcaacgtccgtaacgtcg

SEQ ID NO: 165791 - DNA, 596 bp, Homo sapiens
  misc_feature: GYAE6OF01D1F7J.15.67.G01.1.454.CMB.1.raw
  modified_base (198)..(198): a, c, t, g, unknown or other
  misc_feature (198)..(198): n is a, c, g, or t
  modified_base (282)..(282): a, c, t, g, unknown or other
  misc_feature (282)..(282): n is a, c, g, or t
tcagtctacgtagccacgaccggtgctcgatttagagtatacatattgggtttgggggcaggagtcagacccactcagtacacagcatggacatgaggtcccgctcagctcctggggctcctgctgctctggctcccaggtgccagatgtgccatccagatgacccagtctccatcctcctgtctgcatctgtagganacagacgtcaccatcacttgccgggacaagtcaggacattagaactgtacttaggttgtatcagacaagaaacgtccggaaacnccctaagctaccgtgtatcgtgtcgctagacatcctaactttacgaaggtcgggtaccatcgaagtcagcggcagtgatgcggacagtagtattcactctaccactactcgagacgacgtcctgacgacgtacctagaacgttactttacgacttaactttagttactacgtactaacgtaagttaccttaaacgtaacctttacccggtacggtcccggttacgggacccggaacggggtaacccgtaaagggttacggaaaacgtaaccgtaaacgaaacggtttcggacgttacggccgactcccggttaa

SEQ ID NO: 165792 - DNA, 948 bp, Homo sapiens
  misc_feature: GYAE6OF01BH26H.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatcgtggtaggagacgagacgtccaacccattcctaccgtttcgggcccgggtacaaacggttccgaagggaacctaagttaaggtaaaccttaggtaaccgttttaggggttagggttaacttccgaaggaacaaacggtaaaacggttaacccccgggggaaaaaccggtaccccccgtttaaacggcccttacccgtacgtaacttccgtaggtcggtacgtcgtcctaacttaccccttaacgttttaaaccgtaaaacgggttccgggggtacccctaacgttaccggtaaacggttccggacggtacgggtaccgtaaggggttcggtacgtcggttacgggtccctaaaccgttaaggttaccgttttcctaacctttacccgttaccctaacccgtaacgttaaccgaacggtacccgaccggtacccgttcggaacctaccggttaaccgtaccggttaaacgttaacccggttttacctaacccgtttaaaaccgttttaccgttttaaccgttaacgtttaacccttaaaccggttaaacttaaacccgtttaaaccgttaaccccttttaacccccgggtaccgggtttaaccccggtttcccgggtaaccccggggtaaacgggggttaaaacccggtaaacgggggttaaaccggttaaaaacggttaacccgtaaaaaacccgggttaccgggttaacgggtacggttacccgtaccggaacccgttaacccggtttaacccg

SEQ ID NO: 165793 - DNA, 700 bp, Homo sapiens
  misc_feature: GYAE6OF01AHZG4.15.67.G01.1.454.CMB.1.raw
  modified_base (416)..(416): a, c, t, g, unknown or other
  misc_feature (416)..(416): n is a, c, g, or t
tcagtctacgtagccacgaccggtgctcgatttagagtatacatattgggtttgggggcaggagtcagacccactcagtacacagcatggacatgacgggtccccgctcagctcctggggctcctgctgctctggctcccgaggtgccagatgtgccatccagatcgacccagtcctccatcctccctgtctgctatcgtaggtaggacgacagtacgtccaccatccacgttcggccggataacggtcaggactagttaacgacttggtacgtttagggtagtactcgaagacgaaacgtaaacggtaccggaaaccgtaccccgtaagccttaccgagtctcgttgtcgctcactaccttaccttaacgttaacgaacgggttccggacctagtaccgtaggtcgacggacggngtaggtcgtacgtcggtacgactaacgtacgttacttccaaccttctaccacctagtaccgacgtacctaccggtccgtcggtaccgtaaccgtccgtaaaggttaaccgtttacggttaacccaaccgtttaacttttaccgtacgttacgtaacctaaacgtaactttaacccttaacgttacccgtcccggtaggtcccggtaccggacggtaccggtaacgtacgggtaataaaccgtaaccgtaacggttgtaacgttggaacccacgtacttcgtccg

SEQ ID NO: 165794 - DNA, 681 bp, Homo sapiens
  misc_feature: GYAE6OF01C6C8Y.15.67.G01.1.454.CMB.1.raw
  modified_base (321)..(321): a, c, t, g, unknown or other
  misc_feature (321)..(321): n is a, c, g, or t
  modified_base (666)..(666): a, c, t, g, unknown or other
  misc_feature (666)..(666): n is a, c, g, or t
  modified_base (673)..(673): a, c, t, g, unknown or other
  misc_feature (673)..(673): n is a, c, g, or t
tcagtctacgtagccacgaccggtgctcgatttagagtatacatattgggtttgggggcaggagtcagacccactcagtacacagcatggacatgaggtcccgctcagctcctggggctcctgctgctctggctcccgaggtgccagatgtcgaccactccaagactcgaccctagtcctccactccctccctgtctgctatcgtgtagagacagacgtccactatcacgttcggaccggtacaagtcgacggactaattacggacttgtacgttaggttgtatcaagacgaacgaaacgtaccgggaactaccccgtaanccgtacgtgtacgttcgtgtcgtcgtacgtactaccttaccgtaactttaacggaagggttccgggtaccttaagtaccggttaaaggtcgaacggtcgaagtcggtacgtagttcggacggtacgtactaacgttactttacctaccgtaccttaaccacgacgtacccgaaggctacccgcgtgaaccgttacggtaaccgtacaacgtttacgttacctacgtttaaccgtttattaccgtaacgttacctaacgtaacgttacttaacccgtacttacccggtaccggtaccgtaccggacggtacggaacgtaggtaataacgtaacaagtctacgggtntacgacncctagtcg

SEQ ID NO: 165795 - DNA, 730 bp, Homo sapiens
  misc_feature: GYAE6OF01ATF45.15.67.G01.1.454.CMB.1.raw
  modified_base (211)..(211): a, c, t, g, unknown or other
  misc_feature (211)..(211): n is a, c, g, or t
tcagtctacgtagccacgaccggtgctcgatttagagtatacatattgggtttgggggcaggagtcagacccactcagtacacagcatggacatgaggtccccgctcagctcctgggctcctgctgctctggctcccaggtcgccagatgtgccatccagatgacccagtctccatcctccctgtctgcatctgtaggagacagatcacancacgttcgccggacagtcgaggactagttagaactgtacgtttaggtggtactcgagacaacgtaaatccgggaaaccgtccctaacgtcctaccgttgaacgtttctacggtcgtcctgtacctacgttaccctaacgttttaaaccgaacggttcggggtaccctaacgtacggtaacggtcccacggcgggtactaaggttcggactccgttacggaccgtaaacgttaacggtaccttttacggtaccttacctacccgtaaccgtacgttaccgacgaccgtacgttaccgacgtccgtaacgtccgtaacggtactaacgtttccggaaacttaaaccgtttcgtttaaccgtacgttaacccgtaacgttaaacgtaacgtttaaacctaaccgttaccccgttacggaacgtttcccgggaacccggtagggtaaacccgttagggtaacggtaaaccgtaacgaaacgtaccgtacggggttacaaccggttcgaaccgtaccgttaccg

SEQ ID NO: 165796 - DNA, 815 bp, Homo sapiens
  misc_feature: GYAE6OF01CO15M.15.67.G01.1.454.CMB.1.raw
  modified_base (185)..(185): a, c, t, g, unknown or other
  misc_feature (185)..(185): n is a, c, g, or t
  modified_base (215)..(215): a, c, t, g, unknown or other
  misc_feature (215)..(215): n is a, c, g, or t
tcagtctacgtagccacgaccggtgctcgatttagagtatacatattggggtttggggggcagggagtcagacccactcagtacacagcatggacatgacgggtccccgctcagctcctggggctcctgctgctctggcctcccaggtgccagatgtcgccatccagatcgacccagtcctaccncttccctcctgtcctgctatcgtgtagganacgagacgtaccactataccacgttcggaccggacaacggtacgaggaactagttaacgacttacgttacggttaaggttcggtaactacaggacgaaacgtaacggtaaccggaacgaccccttaagtcctactacggtaactcgtcggtgtcgtacgtaccgtacttaccgttaacgtttaacggaacgggttccgggacccttaagtaacgtaacggggttccaagggtcccggtataacggtcgggtacttcgggtacggtaaccaacggttatttacctactcccgttaccaacctaccgtaacgtacccgacgtaacaccgtccgtacgtaccgaacggttaccgtaagggttaacttacgttaaccgttaaccttaacgttttaacgttaccgttaacgtaaacgttaaccgtaaactttaaccgtttaacccgttaccggttacccgggtaccgggtttaacccgggtaccggtaacccggggtaaaccgggtaaacgttaaaccggggtaaacggtaaaccggttaaaccaaaacgggtttacggtaaccgttacgggttaccgtaaccggttaccgtaacccccgtttag

SEQ ID NO: 165797 - DNA, 724 bp, Homo sapiens
  misc_feature: GYAE6OF01CJRDA.15.67.G01.1.454.CMB.1.raw
  modified_base (231)..(231): a, c, t, g, unknown or other
  misc_feature (231)..(231): n is a, c, g, or t
  modified_base (362)..(362): a, c, t, g, unknown or other
  misc_feature (362)..(362): n is a, c, g, or t
  modified_base (369)..(369): a, c, t, g, unknown or other
  misc_feature (369)..(369): n is a, c, g, or t
  modified_base (495)..(495): a, c, t, g, unknown or other
  misc_feature (495)..(495): n is a, c, g, or t
tcagtctacgtagccacgaccggtgctcgatttagagtatacatattgggtttgggggcaggagtcagacccactcagtacacagcatggacatgacgggtccccgctcagctccgtggggctcctgctgctctggcctcccgaggtcgccgagatgtcgccatccagacgtcgaccctagtcctaccactccctccgtgtctgctatcgtaggagagacagtacgacacntcgacgttcggaccggataacgcgaagtactataacggaaccgtggtactttagggtagtactagagaacgaacggtaaacggtaacccggggtaaacctaccccgtaatcctaccgtactgtccgtggtnaccgtanacctaacgttacctaacgtttaaaccggaaggtccggtaacacgttacggtaacggtacgaggtccggagtacggtcgtaaacgtcgacgtacaaacgtcgtacttacgactttacccaccaaccncgtacgaccgactaccggtagccgataaccgtcgttaagtaacgttccgtttaagtaacctttaattttaccgtacggtcctaaaagttaccgtaaattaaaccgtttacctaaccggttccggtacccggtacggtaccccgggtaagggtaacccgggaacggttaaaggaacgtaaacctaacggaaaccggttctaagggtccaaccgtcgtacccggtattacg

SEQ ID NO: 165798 - DNA, 958 bp, Homo sapiens
  misc_feature: GYAE6OF01DTETJ.15.67.G01.1.454.CMB.1.raw
tcagtctacgtagccacgaccggtgctcgatttagagtatacatattgggtttgggggcaggagtcagacccactcagtacacagcatggacatggaggtccccgctcagctcctggggctcctgctgctcgtggcctcccgaggtcgccaggatggtcgccatccgaagtactcgacccgtagtcctccattccctccgtagtctacgctactcgtagacggagacgtacgacgtacgacctactacgtaccgttcggcccggactaaggttaccggaacgaacttattaacggactaggtacgtttaggttcgaatacgacgtaacgaaacgtaacggtaccgtaaccggacccctaaggtcctacgtagtccgttcgttcgtctccgtctacccgtttaccggtaaacctttaacggtaaccccgggtaaggtttccccggggtaaaccttaacgggttaaccgtaacgggttaacggcggggtacccctagggtaaccggtattccgtacggttaacgacccgtttaaaggtacctttaaccggtttacaacccggttttaccaaccgtcccgttaaagtaccccgtaacggttacccgaacgtaccccgtttacggacccggtttaaaccgaaccgggtttaaacgggttacccgtttaaaccggggtttaacccctttaagtttaaaacccgtttttaacgggttccgttaaaccccgggtttttaaacaaaccgtttaaaccgtttaaccccgtttaaaaccgggttttaaccctaacccggggttaacccgggtttaccggggttaaccccgggtaaacccgggtaaaccccgggttaaccggggaaacgggtttaaacccgtaaaacggggaaaccccgtttaaacccggggtaacgttacggggtaaccctttaccgacccgggttaacttaacccgtttaaccgggg

SEQ ID NO: 165799 - DNA, 692 bp, Homo sapiens
  misc_feature: GYAE6OF01BW29Q.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacgttcggccgggcaagtcaggacattagaactgacttaggttggtatcgagacaagaaacgtaccggaaacgccccgtaagcctcctgatcgtgtgctgcactacctaactttaacgtaaacggtcggggtacccagtacgtaagggttcaggcggcgaggtggtatcgtggacacgtacgtactttacaccgttcctaccaactacttaccgaacgccacgccttcggacctaccggtccgttacggtaacgttacgttttaccgaactttaaactttacgtttaaccttacgttaaccttaacgtaaagttaacctttaaccctaaccgtttaaccccggtaccgggttaacccgggttaccgggtaacccgggtaacgggggtaaacccgtaaaggggttaaccggtaaaacgtaacccgtaaaacggtaacccgtaggggttacgaccgttacgtacccgtaaccgttaccg

SEQ ID NO: 165800 - DNA, 889 bp, Homo sapiens
  misc_feature: GYAE6OF01D8I7V.15.67.G01.1.454.CMB.1.raw
  modified_base (156)..(156): a, c, t, g, unknown or other
  misc_feature (156)..(156): n is a, c, g, or t
tcagtctacgtagccacgaccggtgctcgatttagagtatacatattggggtttgggggcaggagtcagacccactcagtacacagcatggacatggacgggtccccgctcagctccgtggggctctgctgctcgtggcctccgaggtcgaccagngtggtcgaccactaccgaagacgtccgaaccctgtccctaccctaccttccctcccgttggtcctcgtacctagttacggtagggtaaggaacgacgaacggtacctaccaaccgtacgttaccgtaccggtccgggaccgggtaactaacggtaccgaaacggtaacttaacgttaaccggtaaccgtttacggggttaaaccggttttgggggttactaacgaccggtaaacgggtaaccgtaaaaacgggtaacccgggtaaccccgggtaaaccccttacccggtaacgttccgttaccgtaacgtcggttccgtcgttcggctacgtaccttaccgttaaccgttaacggttaacggtaccgggtaccgtacctaagtaaccgggtaacgtcgggaccgcgggtacggtaggtcgtaacgtccgaaggtaacctacgttacttaccgtacctaccgtaccaaccgtacaacggtccgaaaccgtcgacccggtcgacgtaccgttaaccgtagttaaccgttacgttaccgttaaaccttacccttaaggttcccgttaaacttacgtaaaccgttaaacgttaaccgttaacccgtttaacggttaccccgttaccggggttcccgggaacgggttaaccggaacgggttaaaccgggtacgtaaaggtaacccggaaataacccgggtcgtaagggttccacgggactttaccgtcctggttaccg

SEQ ID NO: 165801 - DNA, 823 bp, Homo sapiens
  misc_feature: GYAE6OF01CDKL2.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggcctcccaggtcgccagatgtgcccatccagatcgacccagtcctcctactccctcctgtctgctatcgtggtaggagacgagtactccaaccatacctacgtcggaccgggacaagtcgaggaactaattaacggtaacttaggttaacggttttagggttaggtaactacgacgtaccgaaaaggtaaacccgggtaacccggggaaaccgtacccccgttaacgcccttaccgtaggtacttccgtggtcgtaccgtcgactaacccttaaccgtttaaccgttaaaccgggtaacgggtttccccgggtaaccctaacggttaaccggtaacgggttacgaacggggtccggacgttagggtacggtacgtaccgtacggaacctaacggtttaacttactttacccgtacccttaccgtacccctaaacgtctacccgaacgtacgtaccgtcccgtatacccgtacgaccgttaaagtaactttacggtacttaaccttaatttaaccttacgtaaccgtaactaaacgttaagttaaaccttaacccgtaaccgtttacccggtaccgggttaccgggttaccggaaacccgggacggggtaaaccgtaaagggttaaccggtaaaccgtaaaccgaaaccggtggttacggtacccggtacgtacgtaacctaccgttaccg

SEQ ID NO: 165802 - DNA, 661 bp, Homo sapiens
  misc_feature: GYAE6OF01BR90E.15.67.G01.1.454.CMB.1.raw
  modified_base (486)..(486): a, c, t, g, unknown or other
  misc_feature (486)..(486): n is a, c, g, or t
  modified_base (644)..(644): a, c, t, g, unknown or other
  misc_feature (644)..(644): n is a, c, g, or t
  modified_base (650)..(650): a, c, t, g, unknown or other
  misc_feature (650)..(650): n is a, c, g, or t
tcagtctacgtagccacgaccggtgctcgatttagagtatacatattggggtttgggggcaggagtcagacccactcagtacacagcatggacatgagggtccccgctcagctcctggggctcctgctgctctggcctcccgaggtcgaccagatgtcgccaatccagactcgacccagtcctccatcctccctgtactgctatgtgagagacaggtactcaaccatctacgttcgaccgggacaagtcgaaggtactagtacgaacgtgtacctttagggtcgtactaccgaagactaaaggaaaccgtaccggggaaactacccccgtaagctccctagacttcgtgttgacttgactactaacccgtatttaacggaaggttccgggtaccagtaccgtaaggtccgaagcggtactaggtggactccggtagacctaagtacgttactttaccatccctaacggacccttatacgtaacgcnccgacgttacgacacgttaaccgtagaacgtttacttaccgaacttaacggttctttaccgactaacgttaaccaaagttaacttaaccgtactaccccggtacgacgttccggacgggaaccgtaaccggagggttacaaactacgaaagtcgtcgngttacngcccgaatccg

SEQ ID NO: 165803 - DNA, 737 bp, Homo sapiens
  misc_feature: GYAE6OF01E1JJR.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatccctccctgtctgcatctggtaggagacagagtccaccatcacttcggccggcagtcaggacatagaactgacgttaggttgtatcagacaagaaacgtacccgggaaacgacccctaagccttaccgtgacttctgtcgcgtcgctactacctacctttaacgaaacggtccggggtacccagtacgtaaggttacacggacggcgaaggtgggtactcgttacggaccgtaacgtaacgttaatttcctaaccgttcccttaccgtaacccctaacttaacccgaaccggaccgtaacggccccctaggggtaccctacccggtacccggttaagtaaacggtttacccgttttaaccgaaccgttttaaaccttttacgttaaccgttaccgtttaacgttaaacttaacgttaactttaacgtaacccgtttacccgtaccgggttaccggttaccgggacccggtaacggggaaccggtaaagggtaaaccggtaaacttaaacccggaaaaccgtaacggttcgggtacggacttcccggaaccaccgttaccg

SEQ ID NO: 165804 - DNA, 708 bp, Homo sapiens
  misc_feature: GYAE6OF01B7A8F.15.67.G01.1.454.CMB.1.raw
  modified_base (144)..(144): a, c, t, g, unknown or other
  misc_feature (144)..(144): n is a, c, g, or t
  modified_base (262)..(262): a, c, t, g, unknown or other
  misc_feature (262)..(262): n is a, c, g, or t
  modified_base (514)..(514): a, c, t, g, unknown or other
  misc_feature (514)..(514): n is a, c, g, or t
tcagtctacgtagccacgaccggtgctcgatttagagtatacatattgggtttgggggcaggagtcagacccactcagtacacagcatggacatgaggtccccgctcagctccgtgggctcctgctgctctggctcccgaggtnccagatcgtcgaccatccagactcgaccctagtcctaccacgtcccttcctgtccgtgctagttcgtagacggacaacgtacgacgttaccaacctctacgaccgtcgggaccggtanaagtcgaacggtactaagttaacgacgttagtaacgtttaggtacgttacaacgtagaacgtaaacggtaaaccgtaccgggtaaaccaccccgtaagccttaccggtacgtacttcggtgtacgacgtagtaccttaacgtaccttaacggtaacgtagggttaccggacctaggttaaccggtaaggaccgacggtaccggagtaggtaggtcctaggaccgtacacggtacttactaccacgtctacanctaccgacgacctagtccgacgcgtacgtacgttagattaccctagtaccttaacgttcgtaactacgtacgtaacaacgttaactaccgtacgttacccggtacgtacggtacccgagggttaacggaaccgttaaggaaacgtaaccgtaataaccggtagtcccgtagttacccgactacccgttcgtacg

SEQ ID NO: 165805 - DNA, 895 bp, Homo sapiens
  misc_feature: GYAE6OF01EIC8Q.15.67.G01.1.454.CMB.1.raw
  modified_base (604)..(604): a, c, t, g, unknown or other
  misc_feature (604)..(604): n is a, c, g, or t
tcagtctacgtagccacgaccggtgctcgatttagagtatacatattgggtttggggggcagggagtcagacccactcagtacacagcatggacatggacgggtccccgctcagctcctggggctcctgctgctctcggcctcccgagggtcaccagatgtcgccactaccaagatacgaccctagtcctcctacctcccgttcccgtcgtcgtcgactacgttacggtaggtaacggaacgaacgacggacttacccgaacctactaccgtaacccggttccgggacccgggtaacgaacggtacgtaaacgggtacttaaacggttaacgaacgtttacggttaaccggtttagggggtttacttacgaacaaacggaacgggtaaaacggtaaaacccggggtaacccccggggtaaaaccctaccccgttaaggttccccgttaacccgtttgtaaaccgtttccggtaacggtccgtacggtttaaccggaacccttttaacccgttaaaccgttttaaaccggggttaaaacccgggttaaaccgggggttcccggttaacccaacgggttaaacggtaccggttaccgaaccggggnggttaacgtacggtcggtacctagggtacaactaggttactttaccctacgtcctaccactaccgtacgtacgacggtacctcgaccgtacgtaccgactacggtacgtacgtttaaccgtcctaacgtttaccttaacgtcgttaacacttacgtaacttaataccgttaaccgttccgtaccgggtacggtaccgggtaacgggtaaccgggtacgaagggttaacccgaaataaaccgggtaagtacccgggttacgtacggtacctaccgtcccgtaaacttcccgg

SEQ ID NO: 165806 - DNA, 756 bp, Homo sapiens
  misc_feature: GYAE6OF01A3GB2.15.67.G01.1.454.CMB.1.raw
  modified_base (219)..(219): a, c, t, g, unknown or other
  misc_feature (219)..(219): n is a, c, g, or t
  modified_base (533)..(533): a, c, t, g, unknown or other
  misc_feature (533)..(533): n is a, c, g, or t
tcagtctacgtagccacgaccggtgctcgatttagagtatacatattgggtttgggggcaggagtcagacccactcagtacacagcatggacatggagggtccccgctcagctccgtggggcctcctgctgctctcggcctcccgaggtcgccagatcggtcgcccactaccagtactccgacccctagttcctccctactcccttccctgtctcgctntccgtaggtacggacacgagtacgtaccacctactccgtacgttcgggaccgggataacgtcgaacgtaactaagttaacgaacgttgttaaccgtttagggttaggtctaccgaacgaactaaacggaaacggtacccgggaaacccgtcccgtaaccggccttaccggtagtacgtttcgtcggtacgtcgtaccgtacctacgtttacccctaaaagtttaaccgggacgggttccgttaccaagttacggaaacgtccgacggtccgagtacgttcggtactcggtaccatacggttacttaccgttacncctaccctacgtactccgaccgcgacacggtccaccggagtaaccgttcgtaagtacgttacgtttaccgacttttaacgtactttaccgtacgtaacttaacgtaacctaacgtttaactaacccgtaccgttaccggtccggttaccgggaaccggttagggtaaccgtaaggtaacgaaacgttaacggaacgtacgtacggtcgacgtcactacgtacg

SEQ ID NO: 165807 - DNA, 715 bp, Homo sapiens
  misc_feature: GYAE6OF01A5J94.15.67.G01.1.454.CMB.1.raw
  modified_base (105)..(105): a, c, t, g, unknown or other
  misc_feature (105)..(105): n is a, c, g, or t
tcagtctacgtagccacgaccggtgctcgatttagagtatacatattgggtttgggggcaggagtcagacccactcagtacacagcatggacatgagggtccccnctcagctccgtggggctcctgctgctctggctccgaggtgccagatcgtgaccataccagatcgacccagtcctaccatccctcctgtctgcctatcctaggtacggagaccgagtagtaccaaccacttaccacgttcggccggacaagtcaaggactaatacgaactgtacttaaggttggtatcagtacaaggaaactccggaaacgtccctaagcctccgtagtactcgtagtcgacgtcgactacgttacctaacgttttaacggaacggtcgggtaccaagtacgtaacgttacgaacgggtccggaacgtggtaggtactcgttacggacaaccgtaggtttaacctttaccgtactttacccttaacaccccgtaatacccgtaacgtcaaacggttacccgtacgaccgtacgtaccgtaaggtaataaccgttactaaccgttaagttttaactaacttcggttaaacgtaactaaacgttacttaacttaaccgttaccccgtagggtactcccgggtaaccgtacgggaaccgtaaagggtaacggtaaacaaacgttaaaccggactacggtacggtactacgtaacgcccgttaac

SEQ ID NO: 165808 - DNA, 838 bp, Homo sapiens
  misc_feature: GYAE6OF01AI8RS.15.67.G01.1.454.CMB.1.raw
  modified_base (660)..(660): a, c, t, g, unknown or other
  misc_feature (660)..(660): n is a, c, g, or t
  modified_base (829)..(829): a, c, t, g, unknown or other
  misc_feature (829)..(829): n is a, c, g, or t
tcagtctacgtagccacgaccggtgctcgatttagagtatacatattggggtttggggggcaggagtcagacccactcagtacacagcatggacatgagggtccccgctcagctcctggggctcctgctgctctggcctccgaggtcgccagatggtgcccatccagtactcggaccccagtcctacccagttcccttcccgtgttcctgacctattccgtagggttaacggagaccaaggtacgttaccacctaattcccgaaccgtttcgggacccggggtactaaacggttccggaaacggtaactaacgtttaacggaacctttacgggtaaccgttttaggggtttacggtactaccgaacggacgtaaaacggtaaaccgggtaccccgggaaaaccggtcccccctaaagggtccctttaccgtacggtaacgtttccggttggtccgtccgttacggaacctacctttaacccgttaaccgtttaaacgggaacgggtttccggggtaacccctaagttaacccggtagggtaccgacgggtcggacgttaggtacggtactacggtggacctacgtagttaccttccgaactccaccacgtcgtacgacgaccgagtcccggtcgacgtaccttaccgtagtaaccgtttnttacccgaacttaacgtttctaaccgttacgtactaaacgtagttaacctaccgtacccgttaccgggtaaccgtccggaccggtaaccggtacggggtaaccgttaaggtaacgaaacgtacccgggtaaaccttagggtcccggtacgttaccgacgtaaccggttnttaacccgg

SEQ ID NO: 165809 - DNA, 713 bp, Homo sapiens
  misc_feature: GYAE6OF01EY3HQ.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctgggctcctgctgctctggctcccgaggtgcagatgtgccatccagatcgacccagtctccatcctccctgtcagcagttctagtaggagacagacgtaccacctatccaccgttcggcccgggtacaacgtccgaaggaacctaagttaacgaaaccttgggtaaaccgttttagggttcggtaaactccgaagaccgtaaaggtaaaaaccggttaacccccggggtaaaccgtaaccccgtaaccgtaccgacttaccgttacgtacgttacgttacggtccgtcgtacgtacctaaccgtaccgttaacgttaaccggtaacggtaccggtaccgtacgtacgtacgtacgacggcgagtacgtacgtacgtcgtacgtacgtacgtactactacctactacctaccactacgtacgacgtcgtacgtacgacgacgtacgtacgtacgtacttacgtacgtacttaacttacgtacgtacttactaactaacgtaacttaacgttaccgtaccgtaccgtaccgtaccggtaccggtaacggtaacggtaacggtaacgtaacgtaacgtaacgtacgtacgtcgtcgtcgtac

SEQ ID NO: 165810 - DNA, 779 bp, Homo sapiens
  misc_feature: GYAE6OF01DOGLM.15.67.G01.1.454.CMB.1.raw
tcagtctacgtagccacgaccggtgctcgatttagagtatacatattgggtttgggggcagggagtcagacccactcagtacacagcatggacatgagggtccccgctcagctcctggggcctcctgctgctctggcctcccaggtcgccaggatgtgccatccagatcgacccagtctccactcctcctgtctgctatctggtagagacagacgtaccaccactaccgtacgttcggaccgggtactaagtccgaggtactaagttacgaacgttgtaacgtttagggttacggtatcgagacaaaggtaacgtaccgggaacgaccccgtaagccgtccgtagactcgtcggtcgtcgtacgtactaactcctaaacgttaacggtaacggttccggggtaccctaagtaccgtaaggttcgacggtcggtacgtaggttcggactccggtacgtaaccgtacgtaacgtttctttacccgtaacgtccctaaccgtacccgtaacgtaccgacgtaaccgtaaccgtccgtacggaccgtaaccgtacgttaaaggtaaccggtttactttacccggtaacctttaacgtttaaccgtttacgttactaaacctaaccggttaaacgttaaaccttaaccccgttacggttaaccccggtaccggttaaccgggtacccgggtaaccgggtaaacggggaaaccggttaaggggtaacgttaaaaccgaaccgtaaccggttacgtcggtacggtaccgtacgaccgtacttaccg

SEQ ID NO: 165811 - DNA, 769 bp, Homo sapiens
  misc_feature: GYAE6OF01CXEKJ.15.67.G01.1.454.CMB.1.raw
  modified_base (490)..(490): a, c, t, g, unknown or other
  misc_feature (490)..(490): n is a, c, g, or t
  modified_base (522)..(522): a, c, t, g, unknown or other
  misc_feature (522)..(522): n is a, c, g, or t
  modified_base (563)..(563): a, c, t, g, unknown or other
  misc_feature (563)..(563): n is a, c, g, or t
  modified_base (761)..(761): a, c, t, g, unknown or other
  misc_feature (761)..(761): n is a, c, g, or t
tcagtctacgtagccacgaccggtgctcgatttagagtatacatattgggtttgggggcaggagtcagacccactcagtacacagcatggacatggacgggtcccgctcagctcctggggctcctgctgctctggcctcccgaggtgccagagtgtcgccaatccgagtactacgacccctatcctccaacttccctccctgtctgacaattcgtaggtaggaagacaggtactaccaacctagtacctaccggttcgggacccgggtaacaagttccgaaggtaactaagttacgaaacgttcggtacgtttaaggttacggtacttacgaacgacgaaacggtaaaaccggtaccgggtaaaacgtaccccgtaaacgttcgtacccgtagtacgttctggttacggtctacggtactacctaaccttacggtttaaaaccgaggtccggggtacctacgtaacgggtaacgttacggacgcggtagnggttaacgtgtacgtacgactactaacggttnttaccctatcccgttacacgtactacgacacgtaccggacncactacggtccgtaaagtaccgttacgttaccgtaacttaaacgttaacttacgtacgttaaccgtaaactagtttaactaacccgttacgttacccggagggtttaccgccgggaaccgtaacgggtaacggtaaagggtaaacgttaaccaacgttaaaaccgggcgtttaaccggacggtacaccggtacccgtnttaacccg

SEQ ID NO: 165812 - DNA, 836 bp, Homo sapiens
  misc_feature: GYAE6OF01D97AD.15.67.G01.1.454.CMB.1.raw
tcagtctacgtagccacgaccggtgctcgatttagagtatacatattgggtttgggggcaggagtcagacccactcagtacacagcatggacatgagggttcccgctcagctcctggggctcctgctgctctggctcccgaggtgccagatgtcgccatccaagatcgaacccagtcctccgactcccgtcctgtctcgctatctaggtaggagaccgagacctacacctactccgtaaccgttggacccggggactaaaggttacgaacgggtaactaaacgttaacgaaaccgttagtaacgtttagggttaaggttatacgaacgacgaaaggaaacgttaccgggggaaaacctacccctaaacggtcttacccgtagtaacgttcgtggtacggtacctacgtaccgtacttaaacccgtttaaaaaccggttttaaaagggtaccgggtacccgtaacgtacgtaaacgggtttacgacggtaacggccgtaagggtggtaattccgtcggtacgaaccttagtaacgtttctaaccttcacctaaacagtaccgtaagccgtaacggttccacggtaccgtaacttaaccggacggtaacttaaccttcggtttaacctaaactttaaacccgtttagtaacccgttaataaaccggaaacttttaacttaaacccgtaaaccgtttttaacccggaccccgggtttaaacggcccgggttaaacccgggtaaaccgggtaaacgggtaaaccggggttaagggtaaaaccgtaaaaccgtaaacgtaaacggtttgttaacgggtacctagtacccaagtttcccaag

SEQ ID NO: 165813 - DNA, 709 bp, Homo sapiens
  misc_feature: GYAE6OF01DOGXA.15.67.G01.1.454.CMB.1.raw
  modified_base (171)..(171): a, c, t, g, unknown or other
  misc_feature (171)..(171): n is a, c, g, or t
  modified_base (218)..(218): a, c, t, g, unknown or other
  misc_feature (218)..(218): n is a, c, g, or t
  modified_base (230)..(230): a, c, t, g, unknown or other
  misc_feature (230)..(230): n is a, c, g, or t
  modified_base (281)..(281): a, c, t, g, unknown or other
  misc_feature (281)..(281): n is a, c, g, or t
  modified_base (294)..(294): a, c, t, g, unknown or other
  misc_feature (294)..(294): n is a, c, g, or t
  modified_base (299)..(299): a, c, t, g, unknown or other
  misc_feature (299)..(299): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtcgccagatgtcgccatccagatgacccngtctccactcccttccctgtctgcatctgtacgagacagagtccacntcacttgccggnaagtcaggacatagactgacttaggtgtatgagacaagaacgtccggaacncccgtaagctctnctcgngtcgctgactactacctaactttaacgaaggtcgggtacctagtacgtaacggtcgaggcggtacgtaggtaggacgttcgtcggtactaacgtagttactttccacctcctaacactactcgacgacgacgtccgtagaccgtacgaccggtaactacttacggtttaccgaacctttaacttaacgtttaaccttaccggttaacccttaagtaaaccgttaacctttaaaccggttaacccgttttaaccccgggtaccgggtttaacccgggtccccgggtaaacccggggaaacgggggtaaacccgttaaggggttaaaccggtaaaacgttaaaacccgggaaaaccgttaccgggttacgggtttacccgggacgttaaccggtcccgtaaccgtttaaccg

SEQ ID NO: 165814 - DNA, 706 bp, Homo sapiens
  misc_feature: GYAE6OF01CBGZP.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggcctcccgaggtgccaggatgtgccatccagatcgacccagtcctccattccctccctgtctagctaatcgtagtaggacgtacaggtacgtccaccatacctacgttcggcccgggactaacggtccgaaggtaacctagttaacgaaccgttggtaacgttttacggggtttggtaactcggaacggacgtaaaggtaaaacggtaccccgggggaaacctacccccgtaaagccttacccgtagtactcgtaggtcgactcgactactaccgtactttaagaaccggtcgggtaccagtacgtacggttcgacggtgacgtaaggtcgacgttcgcgtacacgtacttacgttaccaccgttcccaacgacctaagtccgacgtaccgtacgtccacgtccggactacgtaagttacgttactacgttaacttaacgttcttaacctacggtaactaagtaaccttaacttaccttaccgtaccgggttaccgcggttaccggacggtaccggtaagtaggaacaacggtaacgtaacgttcgtcggtacggcctacgtcctaacgttcg

SEQ ID NO: 165815 - DNA, 663 bp, Homo sapiens
  misc_feature: GYAE6OF01ATUJV.15.67.G01.1.454.CMB.1.raw
  modified_base (242)..(242): a, c, t, g, unknown or other
  misc_feature (242)..(242): n is a, c, g, or t
  modified_base (315)..(315): a, c, t, g, unknown or other
  misc_feature (315)..(315): n is a, c, g, or t
  modified_base (431)..(431): a, c, t, g, unknown or other
  misc_feature (431)..(431): n is a, c, g, or t
  modified_base (451)..(451): a, c, t, g, unknown or other
  misc_feature (451)..(451): n is a, c, g, or t
  modified_base (455)..(455): a, c, t, g, unknown or other
  misc_feature (455)..(455): n is a, c, g, or t
  modified_base (464)..(464): a, c, t, g, unknown or other
  misc_feature (464)..(464): n is a, c, g, or t
  modified_base (470)..(470): a, c, t, g, unknown or other
  misc_feature (470)..(470): n is a, c, g, or t
tcagtctacgtagccacgaccggtgctcgatttagagtatacatattgggtttgggggcaggagtcagaccctactcagtacacagcatggacatgaggtcccgctcagctcctggggctcctgctgctctggcctcccgaggtgccagatggtagccagtccagtactcggacccagtcctccatccctcctgtctgcatcgtagtagagaccagacgtccactactcacgttcgccgganaagtcaggtacagttacgaacttgtaacgttaggttagtacacagtacgaagtaaaccggtcccgggaaaacnccccgtaagccttccaggtattcgtcggatactgtactactaccgtagtttaaccgggaaggtccgggtaaccagtacgaacggttccaggtcgtaacgcggttgaccttgacgtnactagtctcgactctacacncgtnacgcgtacnccgtanccgtacgacgtagtaacgttcgttacgaacttaacgttactacggttactaacgtaacgttaacgttaacgttaacccgttaaccgttaccggtccgtaacgggtaccgggaccggtaccgggtaaaccgtacggttaaacgaacccgttacgaaacgtttacgtacggaccgttacgactacccgagttacc

SEQ ID NO: 165816 - DNA, 802 bp, Homo sapiens
  misc_feature: GYAE6OF01DWRNT.15.67.G01.1.454.CMB.1.raw
  modified_base (183)..(183): a, c, t, g, unknown or other
  misc_feature (183)..(183): n is a, c, g, or t
  modified_base (229)..(229): a, c, t, g, unknown or other
  misc_feature (229)..(229): n is a, c, g, or t
  modified_base (239)..(239): a, c, t, g, unknown or other
  misc_feature (239)..(239): n is a, c, g, or t
tcagtctacgtagccacgaccggtgctcgatttagagtatacatattgggtttgggggcaggagtcagacccactcagtacacagcatggacatgacgggtccccgctcagctccgtggggcctcctgctgctctcggcctcccgaggtcgaccagtatgtcgaccatccagtatcgaacccngtccacctacgtccctcctgtcctgctattctaggaggacgacganacgtccaacntaccgtacgtaccgggacggtaacaggtccgaacgtaactaattaacggactaggtaacgtttacgggttagtactagaggaacgtaaggtaaaccgtaccgggaaacctaccctaagtccgtactgacttcgtgatcgtcgtaactactaaccttaacggttaacgtacgggttacggtaacctaaggtacgtaaccgggtagaacggtcggactaagggtcgaccgtaacggtcgactaacgttagttaacccgtttactacctacctacgactaaccgaacgtaacgcccgacttccgtacgtacctacggttcgtaaacggttaactacggtttaactaaccgttaaacttttaacgttaacccgttaagttaccgttaaaccgtaaacgtttaaccttaaccggtttaaccccgtaaccgggttacccgggttaccggtacccggggtaaccgggttaaaccggggtaacgtaaaacgggtaaacgggtaaaaccgtaaccgggtaaaaacgttcgggtacgttaccggaagttaccggtaccgtaaccgtttacggg

SEQ ID NO: 165817 - DNA, 838 bp, Homo sapiens
  misc_feature: GYAE6OF01CS4NK.15.67.G01.1.454.CMB.1.raw
  modified_base (153)..(153): a, c, t, g, unknown or other
  misc_feature (153)..(153): n is a, c, g, or t
  modified_base (487)..(487): a, c, t, g, unknown or other
  misc_feature (487)..(487): n is a, c, g, or t
tcagtctacgtagccacgaccggtgctcgatttagagtatacatattggggtttgggggcaggagtcagaccccactcagtacacagcatggacatgacgggtccccgctcagcctccgtggggctcctgctgctcgtggcctcccgaggtcnccagatgtcgaccatccgagataccgacccagttccacctacttcccgtccctgtcctgactagtcgtagggaggaacgacgtaacggtactaccaccgtacctaccgtaccggttcgggacccgggtaagtaaccggtacgacgtaattaacgttaacgtaacgttaggttaacggtttagggtacgtactacgacggaacgtaaacggtaaccgggtaaccccggaacccgtaccccgtagtacctaccgtagtcgtacgtcggtcgtctacgtactaccgtaccttaagtttaaccggacggttaccgtacctgtaaccggtaggtaccgngggccgtagtgggtactacggtacgacggtaactacgttaacttcttaacccaccgtttaccaaaccgtaccgaaccgtaccggaacgtcccgtaacgtcccgacgtacccgttacggtaaccgtaacgtttacctacggttaacccttacgttaacgttttacctaacgtacggtaaccttaaggtttaacctaacgttacccgtttaccgtacccgggttaccggttaccgggtacccggaaacgggggtaaacccggttaaaggggtaaacgtaaccgggtttaaaaaccaccgtttaaacgggtcggtaccggttaaccggtctaaccgaacccgtttacttccggg

SEQ ID NO: 165818 - DNA, 628 bp, Homo sapiens
  misc_feature: GYAE6OF01CZY80.15.67.G01.1.454.CMB.1.raw
  modified_base (151)..(151): a, c, t, g, unknown or other
  misc_feature (151)..(151): n is a, c, g, or t
  modified_base (278)..(278): a, c, t, g, unknown or other
  misc_feature (278)..(278): n is a, c, g, or t
  modified_base (281)..(281): a, c, t, g, unknown or other
  misc_feature (281)..(281): n is a, c, g, or t
  modified_base (368)..(368): a, c, t, g, unknown or other
  misc_feature (368)..(368): n is a, c, g, or t
  modified_base (376)..(376): a, c, t, g, unknown or other
  misc_feature (376)..(376): n is a, c, g, or t
  modified_base (614)..(614): a, c, t, g, unknown or other
  misc_feature (614)..(614): n is a, c, g, or t
tcagtctacgtagccacgaccggtgctcgatttagagtatacatattgggtttggggggcaggagtcagacccactcagtacacagcatggacatgagggtccccgctcagctcctggggctcctgctgctctggctcccaggtcgccagntgtcgccatccagactgacccagtcctccatccctccctgtctgctatcgtaggtaggacgacaggactaccaccatcacgttcggccgggacaagtcaggactatagaactgactttaggtgtatnagnaagtaagaccggaagtcccctaagctctgactctgtgctgactactacctagttaacgaacggtcggaccatcgtaaggtcaggcgntaggtcgntagtggcacgtagtactttaccacctcctccaacctagtcaccgacgttaccgcgttcacgtacgtacctaggtaattctaccgtaacttaacgttttaaccgttagttaccgtttactaaccgaactttaacgtttaacctacctttacccgggtaacggttcccggtacgggacccgggtacggaacgttaaagggtagtaaacacccgtaaaacggtacggttaggaccggtacncgtcctacgttacc

SEQ ID NO: 165819 - DNA, 735 bp, Homo sapiens
  misc_feature: GYAE6OF01B92TC.15.67.G01.1.454.CMB.1.raw
  modified_base (326)..(326): a, c, t, g, unknown or other
  misc_feature (326)..(326): n is a, c, g, or t
  modified_base (543)..(543): a, c, t, g, unknown or other
  misc_feature (543)..(543): n is a, c, g, or t
  modified_base (724)..(724): a, c, t, g, unknown or other
  misc_feature (724)..(724): n is a, c, g, or t
  modified_base (728)..(728): a, c, t, g, unknown or other
  misc_feature (728)..(728): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctcgtggctcccgaggtgccagatgtgccatccagatcgaacccagtcctccatcccttccctgtcctgcacttcgtaggtacggagacgagacgtcaaccatccgaccgttgggcccggacgtaacgttcgaaggactaagttaacgaacttcggtacgtttaggtacgtatcagtacgaagtaacggaccggaacnccgtaacggtcctccgtgacttcgtgtacgtccgtacgtacctacttaaccgttacctttaaacgggaaccgggtttccggggtaccctaacgtaacggttaacggtaccgaacgggtaccggtagtaacgggtcggtattcccgggtacgtaccaacgttacgttacgtttacctacctacccgttaccaaccgtaaccgagtaccgtcgttaacnccgtaccgaacgtaccgacgttaagtacgtcttaccggttacctaacgtttcgtacgttacctactaaccgtagttactaaccgttaaccgttccccggtaggttacccggtacccggtaacggtaacccgggtacgtaagggtaaccgtaacaacggtaacgtacgtcggtacgtacacncgtntacccgg

SEQ ID NO: 165820 - DNA, 947 bp, Homo sapiens
  misc_feature: GYAE6OF01ATBLD.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggcctcccgaggtcgccaggtattgtcgccatccagctcgaccctagtcctccacgtttccctccctgtcgtacgctagttccgtaggtaggaacacaacggtcgtaccacctactaccgtaccgttccggaccggggtacaaacgttcggaacggtactaatttaacggaactttacggtaaccgtttaggggttagttacgttaccgaaggaacgaacggtaaaacggtaaccccgggtaaaacccgtaccccgttaacggtccctaccgttacgtacgtttccgttacggttcgtacggtcctaccttaacttaaccccgttttaacgttaaaaccggttaaccgggttccgggttaacccctaagtttacggtaacggttaacgccggggactacggtagggttaccgtacgtttaccgggacgtaaccggtaaaccctttaagtttaccgttcccgttaaccctcggtttaaccctaacgtaccgtacgttaccggacccgaacgttaccccggtacgtaccccggtaccggttaaccgtaaacgttacggtttaccttaacccgtttaaaccgtttaacgtttaacctttaccgtttacgtaaacgttaaccgttaaaccgttacgtttaacccctttaaccggttacccccgttaacgggtttaacccccgggttaccgaaaaccggggtaccggggtttaaacccgttaaaggggaaaacccgggttttaaactaaaccccgggtaaacggttaaacgggtttggttaaaccccggtaccgtacccgtagttttaaacccgttcccg

SEQ ID NO: 165821 - DNA, 797 bp, Homo sapiens
  misc_feature: GYAE6OF01D3DNZ.15.67.G01.1.454.CMB.1.raw
  modified_base (144)..(144): a, c, t, g, unknown or other
  misc_feature (144)..(144): n is a, c, g, or t
tcagtctacgtagccacgaccggtgctcgatttagagtatacatattgggtttgggggcaggagtcagacccactcagtacacagcatggacatgaggtccccgctcagctcctggggctcctgctgctctggcctcccaggtnccagatgtgccatccagatcgacccagtcctccactccctcctcgtctcgctatcgtggtaacggagacagtacgtccacctactcctaccgttcggccggacaagtcgacggactaagttaacgtaactcggttaacgtttaggttagtactacgagaacgtaaacggtaaacggtaaccccggggtaaactacccccgttaaagtcccttaccgtagtaaccgtttcggttacgtcgtacgttacgcctaccgttaccctttaaaccgttaacgtaacgggttaccggtaccagttaaccgtacggtacgacggtaccgtagtacggtagacgttcgaggtactaagtacgttaccttaccaccttaccgtaccaaccgtataccggacgtactaccggtcctccgaaccgtcggtaaccttacgtaacgtttaaccgtttcgaaacctttaacttcgttaattacccggtaaactaacgtaaacgtttaaccttaacccgttaccgtttacccgggtaccgttaccgggttacccggtaaccgggtaacggtaaaccgggttaaaggtaaaccgtaaaaccggtaaaccggtaaaccggttaccgttaaggggtacccttcggtaaacccgtaccgttcccgtttaaacg

SEQ ID NO: 165822 - DNA, 488 bp, Homo sapiens
  misc_feature: GYAE6OF02IXEMW.15.67.G01.1.454.CMB.1.raw
tcagtctacgtagccacgaccggtgctcgatttagagtatacatattgggtttggggcaggagtcagacccactcagtacacagcatggacatgagggtcccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtccatcaaggttcagcggcagtggatctggcacagatttcactctcaccatcagcagcctgcagcctgaagatttcgcaacttattactgtactacaagattacaattaccctgacgttcggcacggggaccaaggtggaaatcaaacgactgtaggctgcactac

SEQ ID NO: 165823 - DNA, 495 bp, Homo sapiens
  misc_feature: GYAE6OF02GNSV8.15.67.G01.1.454.CMB.1.raw
  modified_base (393)..(393): a, c, t, g, unknown or other
  misc_feature (393)..(393): n is a, c, g, or t
tcagtctacgtagccacgaccggtgctcgatttagagtatacatattgggtttgggggcaggagtcagacccactcagtacacagcatggacatgagggtcccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatcgggaaagcccctaagctcctgatctgtgctgcatccactttacaaagtggggtccatcaaggttcagcggcagtgatctggcacagatttcactctcaccatcagcagcctgcagcctgaagntttcgcaacttatactgtctacaagtattaacacttaccctcgacgttcgccgagggaccgaaggtaggaatacgaacgaactggtacgcgtcgacacctac

SEQ ID NO: 165824 - DNA, 492 bp, Homo sapiens
  misc_feature: GYAE6OF02GZ5ZW.15.67.G01.1.454.CMB.1.raw
tcagtctacgtagccacgaccggtgctcgatttagagtatacatattgggtttgggggcaggagtcagacccactcagtacacagcatggacatgagggtcccgctcagctcctgggctcctgctgctctggctcccaggtgccagatgtgccatccagatgacccagtctccatcctccctgtctgcatctgtaggagacagagtcaccatcacttgccgggcaagtcaggacattagaactgacttagttggtatcagcagaaatccgggaaagcccctaagctcctgatctgtgctgcatccactttacaaagtggggtcccatcaaggttcagtcggcagtggatctggcacagatttcactctcaccatcagcagcctgcagcctgaagatttcgcaacttattactgtctacagattacaattaccctcgacgttcgccagggaccaaggtggaaacgtacaacgaacgtgtaggctagcactacg

SEQ ID NO: 165825 - DNA, 521 bp, Homo sapiens
  misc_feature: GYAE6OF02IEEXX.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtgggtccatcaaggttcagcggcagtggatcgtggcacagatttcactctcaccatcagcagcctgcagcctgaagtatttcgactaacttattactgtctaacaagtaattactaacttaccctacggtaccgttcggccgtaacggggacccaagggtacggaaactacgaaacgtaactggtacggactgaccactacg

SEQ ID NO: 165826 - DNA, 509 bp, Homo sapiens
  misc_feature: GYAE6OF02GHLJF.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtgatctggcacagatttcactctcaccatcagcagcctgcagcctagaagatttcgctaactttattactgtactacaagtacttaacaacttacctacggacgttcggccaggggaaccaaggtaggaaatacgaaacgaacgtggtacggctgccactacg

SEQ ID NO: 165827 - DNA, 504 bp, Homo sapiens
  misc_feature: GYAE6OF02HF9JO.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtgatctggcacagtatttcactctcaccatcagcagcctgcagccctagaagtatttcgactaacttattactgtctaacaagtattaacaattaccctcgtacgttcgccgtagggaccaaggtggaaatacgaaacgactgtaggctgacactacg

SEQ ID NO: 165828 - DNA, 559 bp, Homo sapiens
  misc_feature: GYAE6OF02G3VDZ.15.67.G01.1.454.CMB.1.raw
  modified_base (396)..(396): a, c, t, g, unknown or other
  misc_feature (396)..(396): n is a, c, g, or t
tcagtctacgtagccacgaccggtgctcgatttagagtatacatattgggtttgggggcgaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggtggtatcagcagaatccgggaagcccctaagctcctgatctgtgctgcatccactttacaaagtgggtcccatcaaggttcagcggcagtggatctggcacagatttcactctcacatcagcagcctgcagcctagaacgtntttcgactaactttacttacttgtacctaacgaacgtacttaacaactttaccctcggtaacgtttccggaccgtacggggaacccgtaagggttacgggtaaaacgttaccgaaaaccggtaacgttacggttacggaccgttacggacctacccgtaaccg

SEQ ID NO: 165829 - DNA, 555 bp, Homo sapiens
  misc_feature: GYAE6OF02H6WGT.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagccctgcagccctagaagtactttcgactaactttattactgttactaacgaagtactttaacaactttaaccctcgggtaccgttcggaccgtaagggggaacgtaaaacgggtaggtaaaacgtacgtaaaaccggaacgttaggtacggtacgtacggacctaaccgtacg

SEQ ID NO: 165830 - DNA, 573 bp, Homo sapiens
  misc_feature: GYAE6OF02F85JJ.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccggaaagcccctaagctcctgatctgtgctgcatccactttacaaagtggggtcccatcaaggttcagcggcagtggatctggcacagtatttcactctcaccatcagcagcctgcagcctagaacgtatttcgctaaactttattacttgtactaacaagtattaacctaactttaaccccgtacgggtaccgtttccgggacccgtaacgggggaacccgtaaagggttacgggaaaacttaccgaaaaaccggtaacgttacggttaccgggtaccgttacggtacccacccgtaaccg

SEQ ID NO: 165831 - DNA, 538 bp, Homo sapiens
  misc_feature: GYAE6OF02FWB2L.15.67.G01.1.454.CMB.1.raw
  modified_base (278)..(278): a, c, t, g, unknown or other
  misc_feature (278)..(278): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaatccgggaaancccctaagctcctgatctgtgctgcatcctactttacaaagtggggtcccatcaaggttcagcggcagtggatcgtggcacagtatttcactctcaccatcagcagcctgcagcctagaagtactttcgactaactttattactgtactaacaagtacttaactaactttaccctacgggtacgttccggaccgtaacggggaacctaagggtacggaaacgtaccgaaaacgtaactggtaggcctacgaccacctacg

SEQ ID NO: 165832 - DNA, 511 bp, Homo sapiens
  misc_feature: GYAE6OF02I6RX7.15.67.G01.1.454.CMB.1.raw
  modified_base (376)..(376): a, c, t, g, unknown or other
  misc_feature (376)..(376): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaaagcccctaagctcctgatctgtgctgcatccactttacaaagtgggtccatcaagttcagcgcagtggatctggcacagatttcactctcaccatcancagcctgcagcctgaagatttcgactaacttattactgtactacaagtattaacaacttaccctacggtacgttccggcgaacggggacccaaggttggaaatacgaaacgtactaggtcgactcgacacctaac

SEQ ID NO: 165833 - DNA, 531 bp, Homo sapiens
  misc_feature: GYAE6OF02GDG0F.15.67.G01.1.454.CMB.1.raw
  modified_base (369)..(369): a, c, t, g, unknown or other
  misc_feature (369)..(369): n is a, c, g, or t
  modified_base (397)..(397): a, c, t, g, unknown or other
  misc_feature (397)..(397): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaggtcgggtccatcaaggttcagcgcaggtgatctggcacagtatttcactcncaccatcagcagcctgcagcctgaagtntttcgactacttatactgtctaactagtattaacaacttacccgtacgggtaccgttccggaccggacggggtaaccgtaagggtacggaaacttacgaaacgtaacgtggtaggacctcggtaccaccgtacg

SEQ ID NO: 165834 - DNA, 504 bp, Homo sapiens
  misc_feature: GYAE6OF02JD1XL.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagtatttcactctcaccatcagcagcctgcagcctgaagatttcgactaacttattactgtctacaagtattaacaattaccctggtaccgttcggacctaggggaccaaggtaggaaactacaaacgactgtaggctgcactacg

SEQ ID NO: 165835 - DNA, 513 bp, Homo sapiens
  misc_feature: GYAE6OF02GWLDL.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctcctgtctgcatctgtaggagacagagtcaccatcacttgccgggcaagtcaggacattagaactgacttaggttggtatcagcagaaatccgggaaagcccctaagctcctgatctgtgctgcatccactttacaaagtgggtccatcaaggttcagcggcagtgatctggcacagatttcactctcacatcagcagcctgcagcctagaagatttcgactaacttattactgtactaacaagtattaactaacttacccgtacgtaccgttcgaccgacgggaaccgaaggtaggaaactacgaaacgaactggtacggctcgacacctacg

SEQ ID NO: 165836 - DNA, 500 bp, Homo sapiens
  misc_feature: GYAE6OF02HL19R.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgactaacttattactgtctacaagattaacaattaccctcggacgttcggacctaggggaaccaaggtaggaaatcgaaacgaactgtagctgcactac

SEQ ID NO: 165837 - DNA, 556 bp, Homo sapiens
  misc_feature: GYAE6OF02HLTPQ.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtgggtcccatcaaggttcagcggcagtgatctggcacagatttcactctcaccatcagcagcctgcagcctgaagatttcgactaactttacttaactgtactaactaagtacttaacctaaatttaccccgtacggtaaccgttccgggacctaacgggggaaccctaaagggttacggaaaagttaccgaaaaccgtaacgttacggtaggtaccgtacggacctacccgtaacg

SEQ ID NO: 165838 - DNA, 564 bp, Homo sapiens
  misc_feature: GYAE6OF02IRFC3.15.67.G01.1.454.CMB.1.raw
  modified_base (226)..(226): a, c, t, g, unknown or other
  misc_feature (226)..(226): n is a, c, g, or t
tcagtctacgtagccacgaccggtgctcgatttagagtatacatattgggtttggggggcaggagtcagacccactcagtacacagcatggacatgagggtccccgctcagctcctggggctcctgctgctctggctcccaggtgccagatgtgccatccagatgacccagtctccatcctcctgtctgcatctgtaggagacagagtcaccatcacttgccgggnaagtcaggacattagaactgacttaggttggtatcagcagaaatccgggaaagcccctaagctcctgatctgtgctgcatccactttacaagtcgggtccatacaaggttcagcggcagtggatctggcacagatttcacctctcacatcagcagcctgcacgccgtagaagtactttacgactaactttacttacttgttactaactaagtaactttaacgtaaacctttacccgtacggtaccgttaccgggaccgtaacgggggacctaaacggggtaggtaaaacgttaccgaaaaccggtaacgttaggtacggtaccgtacggccacctacg

SEQ ID NO: 165839 - DNA, 536 bp, Homo sapiens
  misc_feature: GYAE6OF02HYGUC.15.67.G01.1.454.CMB.1.raw
  modified_base (341)..(341): a, c, t, g, unknown or other
  misc_feature (341)..(341): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagactgacttaggttggtatcagcagaaatccgggaaagcccctaagctcctgatctgtgctgcatccactttacaaaggtgggtccatcaagttcagcggnagtgatctggcacagtatttcactctcacatcagccagcctgcacgctagaagtctttcgacctaactttattacttgtacctacgaagtattaacctaaattacccgtaggtaccgtttacggcccgtagggggaacctaaggtaggaaacttaacgaaacgtaacgtggtacggtcgtacgacctaccctacg

SEQ ID NO: 165840 - DNA, 535 bp, Homo sapiens
  misc_feature: GYAE6OF02JCWVB.15.67.G01.1.454.CMB.1.raw
  modified_base (396)..(396): a, c, t, g, unknown or other
  misc_feature (396)..(396): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctcctgtctgcatctgtaggagacagagtcaccatcacttgccgggcaagtcaggacattagaactgacttaggttggtatcagcagaaatccgggaaagcccctaagctcctgatctgtgctgcatccactttacaagtgggtccatcaaggttcagcggcaggtggatcgtggcacagtatttcactctcaccatcagcagcctgcagcctagatntttcgactaacttattactgtactacaagtactttaacaactttacccgtacggtaccgttaccggaccgtaggggaacccgtaagggttaggaaactacgaaaccggacttacggtaggccgtacggacctacctacg

SEQ ID NO: 165841 - DNA, 581 bp, Homo sapiens
  misc_feature: GYAE6OF02JA5K2.15.67.G01.1.454.CMB.1.raw
  modified_base (157)..(157): a, c, t, g, unknown or other
  misc_feature (157)..(157): n is a, c, g, or t
  modified_base (240)..(240): a, c, t, g, unknown or other
  misc_feature (240)..(240): n is a, c, g, or t
  modified_base (311)..(311): a, c, t, g, unknown or other
  misc_feature (311)..(311): n is a, c, g, or t
  modified_base (411)..(411): a, c, t, g, unknown or other
  misc_feature (411)..(411): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgcctagagtcggtnccggataccgacgactagtacccagtctccatcctccctgtcctgcatctgtaggagacagagttcaccatcacttgccgggntaagtcaggacattagaactgacttaggtgatcagcagaatccggaaagcccctaagctcctgatctgtgntgacatcctactttaacaacggtcgggtacccagttaccaaggttccagcggcaggtggatcgtaggcacgatctttcactcactacatcagctacgccncgcacgtcgtacgagtacttactactacttacttacgttacgtactaactaacgtaacttaacctaacgttaccgtacgtaccggttaccggtaccggtacgggtaacggtaacggtaacggtaacgtaacgtaacgtaacgtacggtacgtcgtacgaccgtacctacg

SEQ ID NO: 165842 - DNA, 532 bp, Homo sapiens
  misc_feature: GYAE6OF02H17JX.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtcgggtccatcaaggttcagcggcagtgatcgtggcacagtatttcactctcacatcagcagcctgcagcctagaagtatttcgactaacttattactgtactaacgaagtacttaacaacttacccgtacggtacgttccggaccgacggggtaaccaagggtacggaaactaccgaaacgtacgttggtacggtacctacgaccacctacg

SEQ ID NO: 165843 - DNA, 559 bp, Homo sapiens
  misc_feature: GYAE6OF02IV54V.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtgggtccatcaaggttcaggcgcagtgatcgtggcacagatttcactctcaccatcagcagcctgcctagcctagaagtatttccgactaacttattactgtacttaacaagtaactttaacaaactttacccgtacgggtaccgttaccgggaccgtaacgggggtaaccgtaaacgggtacggtaaactaccggaaaaccgtaaccgttaggtacggacgttacgaccctaccgtacg

SEQ ID NO: 165844 - DNA, 503 bp, Homo sapiens
  misc_feature: GYAE6OF02G9PPN.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctcctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtccatcaaggttcagcgcagtggatctggcacagtatttcactctcaccatcagcagcctgcagcctgaagatttcgactaactttattactgtactacaagattactaattaccctcgtacgttcggccgacggggtaccaaggtaggaaatacgaaacgactggtggactagcactac

SEQ ID NO: 165845 - DNA, 529 bp, Homo sapiens
  misc_feature: GYAE6OF02F9DVB.15.67.G01.1.454.CMB.1.raw
  modified_base (441)..(441): a, c, t, g, unknown or other
  misc_feature (441)..(441): n is a, c, g, or t
tcagtctacgtagccacgaccggtgctcgatttagagtatacatattgggtttgggggcaggagtcagacccactcagtacacagcatggacatgagggtccccgctcagctcctgggctccttctgctctggctcccaggtgccagatgtgccatccagatgacccagtctccatcctccctgtctgcatctgtaggagacagagtcaccatcacttgccggcaagtcaggacattagaactgacttaggttggtatcagcagaaatccggaaagcccctaagctcctgatctgtgctgcatccactttacaaagtgggtccatcaaggttcagcggcagtggatctggcacagatttcactctcacatcagcagcctgcagcctgaagtactttcgactaacttacttactgtctaacaagtacttaacaacttacccncggtaccgttccggaccgtacggggaaccgtaaagggtacggaaactaccgaaacgtaacgtacggtggactacgcctaccattaccg

SEQ ID NO: 165846 - DNA, 546 bp, Homo sapiens
  misc_feature: GYAE6OF02HT8NI.15.67.G01.1.454.CMB.1.raw
  modified_base (225)..(225): a, c, t, g, unknown or other
  misc_feature (225)..(225): n is a, c, g, or t
tcagtctacgtagccacgaccggtgctcgatttagagtatacatattgggtttgggggcaggagtcagacccactcagtacacagcatggacatgagggtcccgctcagctcctggggctcctgctgctctggctcccaggtgccagatgtgccatccagatgacccagtctccatcctcctgtctgcatctgtaggagacagagtcaccatcacttggccgggnaagtcaggacattagaactgacttaggttggtatcagcagaaatccggaaagcccctaagctcctgatctgtgctgcatccactttacaagtgggtcccatcaaggttcagcggcaggtgatcgtggcacgagtattacactctacacatcagcagcctgccagcctaggaactatttccgactaactttacttactgtacttaacgaacgttaacttaactaactttacccgtacgggtaccgtttccgggaccggtaagggaacctaagggtacggtaaactacgaaacgtacgtggtacggtcgtacgacacctaacg

SEQ ID NO: 165847 - DNA, 582 bp, Homo sapiens
  misc_feature: GYAE6OF02GCC7D.15.67.G01.1.454.CMB.1.raw
  modified_base (201)..(201): a, c, t, g, unknown or other
  misc_feature (201)..(201): n is a, c, g, or t
  modified_base (379)..(379): a, c, t, g, unknown or other
  misc_feature (379)..(379): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtagganacagagtcaccatcacttgccggcaagtcaggacattagaactgacttaggttggtatcagcaagaaataccgggaaacgccctaagctcctgatctgtgctgctatcctactttacaaagtcggggtacccagtcaaggttcaagcggcagtggatcgtggcacagtatttcactcncacatcagcagcctgcacgccgtagaaacgtacttttaccgacctaaactttacttacttcgtactaactaaagtacttaacgtaaactttacccgtacggtaccgtttccgggacggtaaccggggtaaccgaacgggttaacggaaacgtaaccgaaacggtaaccgttacggttaacggtcgtacggtaccgacctaacg

SEQ ID NO: 165848 - DNA, 526 bp, Homo sapiens
  misc_feature: GYAE6OF02HC93R.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctagaagtatttcgactaacttattactgttactaacaagtattaacaaactttacccgtagtaccgttcggaccgtacggggaaccaagggtaggaaactacgaaacgaacgtaggtggtacgtagaccactacg

SEQ ID NO: 165849 - DNA, 517 bp, Homo sapiens
  misc_feature: GYAE6OF02H9GUK.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtgggtacccatcaaggtcagcggcagtggatctggcacagatttcactctcacatcagcagcctgcagcctagaagtattcgactaacttatactgtactacaagtattacaacttacccgtgtacgttcgaccgtacggggaaccaagggtaggaaactacgaaacgaacgtacggtacggtacgtgaccacctacg

SEQ ID NO: 165850 - DNA, 563 bp, Homo sapiens
  misc_feature: GYAE6OF02IQL0W.15.67.G01.1.454.CMB.1.raw
  modified_base (201)..(201): a, c, t, g, unknown or other
  misc_feature (201)..(201): n is a, c, g, or t
  modified_base (554)..(554): a, c, t, g, unknown or other
  misc_feature (554)..(554): n is a, c, g, or t
  modified_base (558)..(558): a, c, t, g, unknown or other
  misc_feature (558)..(558): n is a, c, g, or t
tcagtctacgtagccacgaccggtgctcgatttagagtatacatattgggtttgggggcaggagtcagacccactcagtacacagcatggacatgacgggtccccgctcagctcctggggctcctgctgctctggctccaggtgccagatgtgccatccagactgacccagtctccatcctcctgtctgcatctgtagganacagagtcaccatcacttgccggcaagtcagacattagaactgacttaggttgtatcagcaagaaatccgggaaagcccctaagcctcgtgactctgtgctgcactccatttacaaggtcggtaccatcgtaaggttcagtcggactaggtgacttcgtaggaccacgtagtactttccacttcctacaaccgtactcaacggctaacggtcctaggacctacgtaccctaggtaaacttacgtttaccgaacttaactttacttacgtctactaacgaagttacttaactaacttaccgcgtacgtcgacgacgggtaacaggtacgtaacacgaacgactacggtcgtacngacnctacg

SEQ ID NO: 165851 - DNA, 493 bp, Homo sapiens
  misc_feature: GYAE6OF02GXT5A.15.67.G01.1.454.CMB.1.raw
  modified_base (412)..(412): a, c, t, g, unknown or other
  misc_feature (412)..(412): n is a, c, g, or t
  modified_base (442)..(442): a, c, t, g, unknown or other
  misc_feature (442)..(442): n is a, c, g, or t
  modified_base (481)..(481): a, c, t, g, unknown or other
  misc_feature (481)..(481): n is a, c, g, or t
  modified_base (488)..(488): a, c, t, g, unknown or other
  misc_feature (488)..(488): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttgtatcagcagaaatccgggaaagcccctaaagctcctgatctgtgctgcatccactttacaaagtggggcccatcaaggttcagcggcagtggatctggcacagtatttcactctcaccatcagcagcctgcagcctagagtacttcgctaaacttnttactgtactacaagtattaacattacccngtacgtcgccgagggccaaggtagaactacgaaacgtanggtgctncactc

SEQ ID NO: 165852 - DNA, 515 bp, Homo sapiens
  misc_feature: GYAE6OF02FV17U.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagtactttcgactaacttattactgtactacaagtattaacaacttaccctcggtacgttcggaccgaggggtaccaaggtaggaaactacgaaacgtactggtacgcgtagccacctacg

SEQ ID NO: 165853 - DNA, 560 bp, Homo sapiens
  misc_feature: GYAE6OF02GN0BV.15.67.G01.1.454.CMB.1.raw
  modified_base (373)..(373): a, c, t, g, unknown or other
  misc_feature (373)..(373): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcaggtggatcgtggcacagtatttcactcncaccatcagcagcctgcacgcctagaactattcgactaacttattactgtactaacgaagtacttaacaactttaacccgtcgggtaccgtttacggacccgtaacggggaacccgtaaagggttacggtaaaacttaccggaaaaccgtaacgttacggtacgggtacgtacgaccgacctaaccg

SEQ ID NO: 165854 - DNA, 526 bp, Homo sapiens
  misc_feature: GYAE6OF02HTP9X.15.67.G01.1.454.CMB.1.raw
  modified_base (395)..(395): a, c, t, g, unknown or other
  misc_feature (395)..(395): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctcctgtctgcatctgtaggagacagagtcaccatcacttgccggcaagtcaggacattagaactgacttaggttggtatcagcagaaataccgggaagcccctaagctcctgatctgtgctgcatccactttacaaacgtgggtcccatcaaggttcagcgcgagtgatctggcacagatttcactctcacatcagcagcctgcagcctagaagtnttcgactaacttattactgtactacaagtacttaacaacttaccgtcggtacgtttccggacgaacggggtacctaaggtacggtaaaactaccgaaacgtaacgtggtacggtacgtacgctaccgtacg

SEQ ID NO: 165855 - DNA, 530 bp, Homo sapiens
  misc_feature: GYAE6OF02GE6UI.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatcactttacaagtcggggtcccatcaaggttcagcggcagtggatctggcacagtatttcactctcaccatcagcagcctgcacgcctagtaagtactttcgactaactttattacttgtactacaagtattaactaacttaccctcggtaccgttcggccgaacggggaccgaagggtacggaaactacgaaaccggtaactcggtaggctcggaccacctacg

SEQ ID NO: 165856 - DNA, 504 bp, Homo sapiens
  misc_feature: GYAE6OF02FXGW1.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaacgatttcgctaaacttattactgtactacaagtattacaacttaccctcgtacgttcggccgaggggtaccaaggtagaaatacaaacgtactgtaggctgacactacg

SEQ ID NO: 165857 - DNA, 577 bp, Homo sapiens
  misc_feature: GYAE6OF02HEXOO.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatcctacttacaaggtcggggtaccatctaaggttcgagcggcagtggatcgtgacacagtacttcactctacacatcagcagcctgcacgccgtagaacgtactttaccgacctaaactttattaacgtcgtactaacgtaagtacttaactaaactttaacccgtacgggtaaccgttccgggaaccgtaacggggtaaccgtaacgggtaacggtaaactaaccgaaaacggtaccgttaggtaccggacgttacggaccctacctaacg

SEQ ID NO: 165858 - DNA, 585 bp, Homo sapiens
  misc_feature: GYAE6OF02JFYRW.15.67.G01.1.454.CMB.1.raw
  modified_base (425)..(425): a, c, t, g, unknown or other
  misc_feature (425)..(425): n is a, c, g, or t
tcagtctacgtagccacgaccggtgctcgatttagagtatacatattgggtttgggggtcgaggaggtcgagacccactcagtacacagcatggacatgagggtcccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggtggtatcagcaagaactccgggaaacgcccctaagctccgtgatctgtgctgcatccgtactttacaaaggtcggggtaccagtcgtaaggttcagcggtcaggtgactcgtggcacgtagtactttcactctcacatcagctagcctcggcacggtcctagtaacgtntttaccgactaaacgttacttacttacggtacttaactaacgttacttaaacctaaacgtttacccgtcgggttaaccgttcggtacccggaacggggaaccggaaggtacgtaaacgtaacgaaacgtacgttagtccggacgtacgacgtacctaacg

SEQ ID NO: 165859 - DNA, 808 bp, Homo sapiens
  misc_feature: GYAE6OF02H3FVG.15.67.G01.1.454.CMB.1.raw
  modified_base (131)..(131): a, c, t, g, unknown or other
  misc_feature (131)..(131): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctntgctccaggtcgccagatgtcgccatccagatcgacccagtcctccactccctcctgtctcgcatcgtggtaggagacagacgtccaaccatcctacgttcgggcccgggacaacgtcgaacggactaagttaacgaactagtaacgtttagggtttaggtatacgagacaagtaaaacggttaacccggggaaaaccaccccgttaaagcccttaccgttacggaattaccgttggtcgtcgttacgacctaacttacccgttaaccttttaaaccggtaaaacgggttccgggggtacccctaagttaaccgtaaacgggtttaccgaacggtacggacgtaaggtaggtactcggcggtaccaacgtagttacttttaccgacctctacccaacctagttaccacgaccgaccgtccgtcgaaccgacgtacctaaggaacgtttattaccgaacctttaaacgtttaacttaccgttacgttaaccaacgtaaacgttaactttaaacgtaaaccttttaccccgttaacgggttacccgtttacccgggaacccggggtaaacgggggtaaacccgtaacgggttaaacgggtaaaaacgttaaacccggaaaaacccggtaacggtttaccgggtaccggtaccgtaccgggaccctaacccgttaaccgg

SEQ ID NO: 165860 - DNA, 522 bp, Homo sapiens
  misc_feature: GYAE6OF02F27II.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagtatttcactctcaccatcagcacgcctgccacgcctgaacgtatttcgactaacttattactgtactacaagtacttaacaacttacccgtcgtacgttcggacgacggggtaaccaaggtacggaaattacgaaacgtacgtgtacggtctcgacactacg

SEQ ID NO: 165861 - DNA, 521 bp, Homo sapiens
  misc_feature: GYAE6OF02FYNHO.15.67.G01.1.454.CMB.1.raw
  modified_base (448)..(448): a, c, t, g, unknown or other
  misc_feature (448)..(448): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctcctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtgatctggcacagatttcactctcaccatcagcagcctgcagcctagaagtactttcgctaaactttattactgtactaacaagtattaaccaactttacccncggtaccgttcggaccgaggggtaaccaagggtacggaaattaccgaaacgactggtaggctagaccactacg

SEQ ID NO: 165862 - DNA, 527 bp, Homo sapiens
  misc_feature: GYAE6OF02F2H8Q.15.67.G01.1.454.CMB.1.raw
  modified_base (298)..(298): a, c, t, g, unknown or other
  misc_feature (298)..(298): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatcggaaagcccctaagctcctgatctgtnctgcatccactttacaaagtggggtcccatcaaggttcagcgcagtgatctggcacagatttcactctcaccatcagcagcctgcagcctgaagattcgactaactttattactgtactacaagtacttaactaacttaccctacggtacgttccggccgtaggggaacccaagggtaggaaactacgtaaaaccgtacgttacggtaggtacgtcgacctacctaacg

SEQ ID NO: 165863 - DNA, 639 bp, Homo sapiens
  misc_feature: GYAE6OF02HJQZZ.15.67.G01.1.454.CMB.1.raw
  modified_base (284)..(284): a, c, t, g, unknown or other
  misc_feature (284)..(284): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatccctccctgtctgcatctgtaggagacagagtcaccatcacgttggccgggcaagtcaggacattagaactgacttaggttgtatcagcaagaagtaccgggaaacnccccgtaagccttacctgatctgtcgctgacactccctaactttaacgaaaggttcggggaccctagtacgtaaacgggttcaggcggactaggtacggtatcgtagggccaacgagttacttccactcctacacctatacagccagccgtgacgacgtcctaggaacgttactttaccggaaccttaactttacttaaccttcgtaacctaacgtaaagttacttaaaccgtaaaccttacccggttacgggtaaccgtttccgggacccggtaagggggtaacccgtaagggttaacgggaaacttaaccggaaacggtaccgttaggcggtaaccgtacgaccacgttaccg

SEQ ID NO: 165864 - DNA, 534 bp, Homo sapiens
  misc_feature: GYAE6OF02HY59V.15.67.G01.1.454.CMB.1.raw
  modified_base (366)..(366): a, c, t, g, unknown or other
  misc_feature (366)..(366): n is a, c, g, or t
  modified_base (371)..(371): a, c, t, g, unknown or other
  misc_feature (371)..(371): n is a, c, g, or t
  modified_base (413)..(413): a, c, t, g, unknown or other
  misc_feature (413)..(413): n is a, c, g, or t
  modified_base (432)..(432): a, c, t, g, unknown or other
  misc_feature (432)..(432): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccggcaagtcaggacattagaactgacttaggttggtatcagacaagaaagtaccgggaaacgcccctaagcctcctgatcgtgtgctgcatcctactttacaaagtcgggtacccatctaaggttcaggcggcgaagtggatcgnggcanagtatttcactctacaccatcagcagcctagcagctagaatnttacgataacttattactntactacaagtacttaacaacttacccgtagtacgttaccggcgaacggggaactaaggtagaaactaaccgaaacgacttggacggactacgacctactacg

SEQ ID NO: 165865 - DNA, 747 bp, Homo sapiens
  misc_feature: GYAE6OF02JRF4B.15.67.G01.1.454.CMB.1.raw
  modified_base (202)..(202): a, c, t, g, unknown or other
  misc_feature (202)..(202): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctggtagganacagagtccaccatcacttggccgggacaagtcacggacattagaactgacttaggtggtatcagcaagaactcgaaggaacgccctaagcctaccgtagtactcgtgtcgctgactacgtacctaacgtttaacgaaacggttcgggtaccctaagtacgtaaggttcgacggtcggacgtacggtagtaacgttcgtacggacctaacgtaaggtttactttacccgtaacctttccgtaaccgtaaaccgtactaaccgtaaggaccgtacgtacccgtcgtaccgtaacgtaccggttaacgtaaacgttactttaccggtaaaccttaaacttttaacgttacctttaacgtaaccttaaaccgtaaacgtttaaaccttaaacccttaaaccgttaacccgggttaccggttacgggttaacccgggtaacccgggtaaacggggtaaacccggtaaagggttaaccggtaaaacggtttaacccggtaaaaccggttaacggttacgggtaacggtaccgttacggaacccgtaaccg

SEQ ID NO: 165866 - DNA, 697 bp, Homo sapiens
  misc_feature: GYAE6OF02HGLU8.15.67.G01.1.454.CMB.1.raw
  modified_base (319)..(319): a, c, t, g, unknown or other
  misc_feature (319)..(319): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcacatcacgttgccgggacaagtcaggacattagaactgacgttaggttggtatacagacaagaaagtacccgggaaagacccctaagccttaccgtaggacttcgtagtncgtgacctatacctaacgtttaacgaaaggttcgggtaccctaagtacgtaaggttcaggcggtacgtaaggtggaactcgtacggacgtaactaggtactttaccgaactttcctacacctaatcaagaccgtacgcctacgaccgaacggtccctaaggtaattacgtttacgaaccgtttaaactttacgtttacctgttaacctaaacgtaacgttaaactttaaacccgtaaaccgtttaaccccggtacggttaccggttacccgggaacgggtaacccgggggaaaccgtaaaggggttacgtaaaaaccgtaaccggtaaaaccgaacggtttacgggacggttaccgtaccggtaccgtaacctaccgg

SEQ ID NO: 165867 - DNA, 587 bp, Homo sapiens
  misc_feature: GYAE6OF02JP4WA.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctcctgtctgcatctgtaggagacagagtccaccatcacgttgccgggcaagtcaggacattagaactgacttaggttggtatcagtcagaaatcgggaaagcccctaagctctgatctgtgctgcatcctacttacaaagtcgggtaccatcgaagttcagcggcagtggactcgtcggacacgtacgtattttaccgacttaccgtcctaaccacttacgagccagtcccgtgaccgacgtccgtagtaaacgtctttacgacctaaactttacttaacgttcgtactaactaagtaactttaaccaactttacccgtacggtaccgttaccggtaccgaacgggtaccggaaggtacggaaactaaccggtaaacgtaacgtggtacgacgtacgacgacctaacg

SEQ ID NO: 165868 - DNA, 620 bp, Homo sapiens
  misc_feature: GYAE6OF02HNMPP.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctcctgtctgcatctgtaggagacagagtccaccatcacttcgccgggcaagtcaggacattagaactgacttaggttgtatcagcagaataccgggaaagcccctaagctcctgatctgtgctgcatcctactttacaaaggtcggggtacccagtcaaggttcagcggcgagtgggtacttacgtggacctacgtaggtacttttccgacttcctaccaacctactacgtagccacggtaccctggaccacggtccctagaaacgtactttcgaccttaactttaattaccgtcgaaccgtaaacggtcgtaaccttaagttaaacttaacgtacctttaacgtttaccgggggaccgggtaacgggtaacccggtaagggtcgggaacgtaagtaccgtaaacgtacgttaggtacggtaccgttacgaccgtaacccg

SEQ ID NO: 165869 - DNA, 538 bp, Homo sapiens
  misc_feature: GYAE6OF02F86PP.15.67.G01.1.454.CMB.1.raw
  modified_base (377)..(377): a, c, t, g, unknown or other
  misc_feature (377)..(377): n is a, c, g, or t
  modified_base (400)..(400): a, c, t, g, unknown or other
  misc_feature (400)..(400): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggtggtatcagcagaaatccgggaaagcccctaagctcctgactctgtgctgcatcctactttacaagtcgggtacccatcaaggttcagcgcagtgatcgtggcacagtactttcactctcaccntcagcagcctgcagcctagaatnttcgactaacttcttactgtactaacgaagtaactttaacaaactttacccgttaccggtacgttcggaccggacggggtaacctaagggtacgaaaacttacgaaaacgtacgtaggtcgtacgtcgtaccactacg

SEQ ID NO: 165870 - DNA, 525 bp, Homo sapiens
  misc_feature: GYAE6OF02FZ7XL.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagcctcctgatctgtgctgcatcctactttacaaaggtcggggtccatctaaggttcagcggcagtgatcgtggacacagtatttcactctcaccatcagcagcctgcacgctagaactctttcgacttaacttattacctagtactaactaagtaactaacctaacgtttaccctcggtacgttcggaccgacgggacaaggtaggaaactacaacgacgtgtagtctagcctactacg

SEQ ID NO: 165871 - DNA, 523 bp, Homo sapiens
  misc_feature: GYAE6OF02FX3OZ.15.67.G01.1.454.CMB.1.raw
  modified_base (200)..(200): a, c, t, g, unknown or other
  misc_feature (200)..(200): n is a, c, g, or t
  modified_base (402)..(402): a, c, t, g, unknown or other
  misc_feature (402)..(402): n is a, c, g, or t
  modified_base (417)..(417): a, c, t, g, unknown or other
  misc_feature (417)..(417): n is a, c, g, or t
tcagtctacgtagccacgaccggtgctcgatttagagtatacatattgggtttgggggcaggagtcagacccactcagtacacagcatggacatgagggtcccgctcagctcctggggctcctgctgctctggctcccaggtgccagatgtgccatccagatgacccagtctccatcctccctgtctgcatctgtagganacagagtcaccatcacttggccgggcaagtcaggacattagaactgacttaggttggtatcagcagaaatccgggaaagcccctaagctcctgatctgtgctgcatccactttacaaaggtcgggtccatcaaggttcagcggcaggtgatcgtggcacagtatttcactctcaccatcagcacgtcctgcacgctagaacntttccgactaacttnttactgtactaacagtacttacaactttaccgcggtacgttcggacgtacgggaaccgaaggttacgtaaactacgaaacgtactggtacggctacgacacttacg

SEQ ID NO: 165872 - DNA, 590 bp, Homo sapiens
  misc_feature: GYAE6OF02JAGML.15.67.G01.1.454.CMB.1.raw
  modified_base (201)..(201): a, c, t, g, unknown or other
  misc_feature (201)..(201): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtagganacagagtccaccatccacttggccgggcaagtcaggacattagaactgacttaggttggtatcagcagaatccgggaaagcccctaagctcctgatctgtgctgcatccactttaacaaaggtcgggtacccatcaaggttcaggcggcaggtggatcgtggacactagtactttcactctcacctatcagcacgccctgacacgtaccgtagtaaacgtactttccgacttaaacgttttacttaccgtacgttacctaaacgtaacgttactttaaacctaaacgtttacccgtacgggtaccgttccggaccggtaacggggaaccgtaagggtacggtaaactacgaaaccggtacgttggtacggacgtacggacctacctacg

SEQ ID NO: 165873 - DNA, 545 bp, Homo sapiens
  misc_feature: GYAE6OF02H8EX9.15.67.G01.1.454.CMB.1.raw
tcagtctacgtagccacgaccggtgctcgattttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaagtgggtacccatcaaggttcagcggcagtggatcgtggcagagtatttcactctcacactcagcagcctgcacgcctagacgtattcgactaacttattactgtactacaagttatactaaacttacccgtacgtacgttacgaccgtacgggaaccgtaacggtaaggaaacccccgttaagaaaccggtaacgtacggtacggtacgtacgacctaccgttaacg

SEQ ID NO: 165874 - DNA, 535 bp, Homo sapiens
  misc_feature: GYAE6OF02ICL9I.15.67.G01.1.454.CMB.1.raw
  modified_base (345)..(345): a, c, t, g, unknown or other
  misc_feature (345)..(345): n is a, c, g, or t
  modified_base (367)..(367): a, c, t, g, unknown or other
  misc_feature (367)..(367): n is a, c, g, or t
  modified_base (386)..(386): a, c, t, g, unknown or other
  misc_feature (386)..(386): n is a, c, g, or t
  modified_base (388)..(388): a, c, t, g, unknown or other
  misc_feature (388)..(388): n is a, c, g, or t
  modified_base (526)..(526): a, c, t, g, unknown or other
  misc_feature (526)..(526): n is a, c, g, or t
tcagtctacgtagccacgaccggtgctcgatttagagtatacatattgggtttgggggtcgaggaggtcgagacccactcagtacacagcatggacatgagggtcccgctcagctcctggggctcctgctgctctggctcccaggtgccagatgtgccatccagatgacccagtctccatcctcctgtctgcatctgtagagacagagtcacatcacttgccgggcaagtcaggacattagaactgacttaggttggtatctagcagaaatcgggaaaacgccctaagctacctgatctcgtgctgcatccgactttacaaagtggggtacccatacaagttcancggacagtcggaatctggctangtatttcaactctcaactntnagtcagccctgacagccttagaactattccgacaactttactatgtacttaacaagttattactaaagttaccctacggacttacggtctacgggaacggtaagtcggaaattaccgtaaagacgtaacgatcggtanccggatacg

SEQ ID NO: 165875 - DNA, 656 bp, Homo sapiens
  misc_feature: GYAE6OF02I5X0C.15.67.G01.1.454.CMB.1.raw
  modified_base (456)..(456): a, c, t, g, unknown or other
  misc_feature (456)..(456): n is a, c, g, or t
  modified_base (463)..(463): a, c, t, g, unknown or other
  misc_feature (463)..(463): n is a, c, g, or t
  modified_base (470)..(470): a, c, t, g, unknown or other
  misc_feature (470)..(470): n is a, c, g, or t
  modified_base (508)..(508): a, c, t, g, unknown or other
  misc_feature (508)..(508): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatcgacccagtcctccatccctccctgtctgcatctggtaggagacagcgtcaccatccacgttggccggacaaggtccaggtaccagttagaactgacttaggttgtaatcagcaagaaacgtccgggaaactccctaagctccgtagatcgtgtcgctgcactcctaactttacgaaagggttcggggtacccagttacgtaaacggtttcgaacggtcggtacgaggttcgggtaactcggtcgggtaccaacgtacgttacttttccgactcctaccgaacctatccgaancgtaacncccgtanccgacgtcctaggaacttacttccgtaactaaactttntttaaccgtgttaaccaaggtaacttacttaaacctaacctttacccggtagttacccggttacgggacgtaaccgggggtaactaaacgggtgtaaactaaccgaaacggtaacgttcgggtgtacgtaccggaccttactaaccgg

SEQ ID NO: 165876 - DNA, 646 bp, Homo sapiens
  misc_feature: GYAE6OF02IT6TQ.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctgtctcccaggtgccagatgtgccatccagatgacccagtctccatcctccctgtctgcatcgtgtaggagacagacgtccaccatcacttcggccgggcaagtcaaggacattagaactgtacttaggttggtatcagacaagaaacgtaccggggaaacgcccctaaggctccgtagtactcgtgtgctgacatacctactttaacgaacggtcggggtaccctaagtccgtaaggttcgacggcggtacgaggtcggaacttcgtggaccaacgtacgtactttaccgacctttaccgtaccaacctactacgacgactacggtacctcggacacgtcctaggtaagttacgtttacgaacctttaactttacttacgtacgtacttaactaagttaacttaacctaacgtttacccgacggttaccgttccgggaacgtacggggaacgttaagggtaagtaaaccgtacgtaaaccggtacgtggtacggtactacggacctaccgtacg

SEQ ID NO: 165877 - DNA, 524 bp, Homo sapiens
  misc_feature: GYAE6OF02FZ3W8.15.67.G01.1.454.CMB.1.raw
  modified_base (382)..(382): a, c, t, g, unknown or other
  misc_feature (382)..(382): n is a, c, g, or t
  modified_base (427)..(427): a, c, t, g, unknown or other
  misc_feature (427)..(427): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatccctccctgtctgcatctgtaggagacagagtcaccatcacttgccgggcaagtcaggacattagaactgacttaggttgtatcagcagaactccgggaagcccctaagctcctgatctgtgctgcatcctacttacaagtcgggtccatcaagtcagcgcagtgatcgtggcacagtattcactctacacatcagcagcctgcncgcctagaacgtctttacgacttaaactttattactgtacctaanaagttattaactaacttacccgtacggtacgttccgggaccacggggaccgaaggtacgaaactacgaaacgtacgtgtcggtcgtacgcacctacg

SEQ ID NO: 165878 - DNA, 665 bp, Homo sapiens
  misc_feature: GYAE6OF02IL2UB.15.67.G01.1.454.CMB.1.raw
  modified_base (202)..(202): a, c, t, g, unknown or other
  misc_feature (202)..(202): n is a, c, g, or t
  modified_base (449)..(449): a, c, t, g, unknown or other
  misc_feature (449)..(449): n is a, c, g, or t
  modified_base (460)..(460): a, c, t, g, unknown or other
  misc_feature (460)..(460): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccactcctccctgtctgcatctgtagganacagacgtcaccatcacttggccggacaagtcagactattagaactgacttaggtagttatactgacaagaaacgtaacgggaaaccggaacccgtaaccgtacgtcctcgtagttacttcgtcggtcgtcgtccgaacttacctaacctttaacgtaaacggtacggggttacccgtactacgtacggttacgacgcggacgagtaggatcgtgacgacagtattctacgtcctacctacactacngccacgtaccncgagtaccgtagtaccgtaagttaccgtttctaaccttaactttaacttacgttactttacgtaacttaaagaaccttttacgaaaacctttacccgttacgggtaccggtaccggtacgggaaccggtacgggtaaacggtaacggtaaacgtacggtaaaaccgtacggttacgttcgggtacgtccgtacgacccttaacgg

SEQ ID NO: 165879 - DNA, 593 bp, Homo sapiens
  misc_feature: GYAE6OF02IJ8GX.15.67.G01.1.454.CMB.1.raw
  modified_base (277)..(277): a, c, t, g, unknown or other
  misc_feature (277)..(277): n is a, c, g, or t
  modified_base (379)..(379): a, c, t, g, unknown or other
  misc_feature (379)..(379): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccggcaagtcaggacattagaactgacttaggttggtatcagcagaatccgggaaancccctaagctcctgatctgtgctgcactacctactttaacgaaagtcgggtcccactctaaggttacgagcggcgaggtgggactcgtggcacagtatttcnctctcaccatcagcacgcctgcagtccctagaacgtcttcgactaacttagttactagttacctaacgtaaagtacttaactaactttaacccgtcggttaacccggttaccggtacccggtaacggggtaacgtaaaccggggtacggtaaaacgttaccgaaaaccggttaaccgtagggttaccggtaccgtacgacccgtaccgtaaccg

SEQ ID NO: 165880 - DNA, 577 bp, Homo sapiens
  misc_feature: GYAE6OF02GX87C.15.67.G01.1.454.CMB.1.raw
  modified_base (199)..(199): a, c, t, g, unknown or other
  misc_feature (199)..(199): n is a, c, g, or t
  modified_base (225)..(225): a, c, t, g, unknown or other
  misc_feature (225)..(225): n is a, c, g, or t
tcagtctacgtagccacgaccggtgctcgatttagagtatacatattgggtttgggggcaggagtcagacccactcagtacacagcatggacatgagggtccccgctcagctcctgggctcctgctgctctggctcccaggtgccagatgtgccatccagatgacccagtctccatcctcctgtctgcatctgtagganacagagtccacatcacttggccgganaagtcaaggacattacgaactgtacgttaggttggtatcagcaagaaacgtaccgggaaacgccccgtaagtcctaccgtagactcgtgtcgctgactactacctactttaacgaaggttcgggtacctagtacgaacgttcacggcggactaggtaggtactcgtaggactacgtagtactttccacttccacaccatacagcacgtcgtgccgtacgtctaagattacttacacttaattactactatactaactaagttaacttaactaacttaccgtcgtaccgtcggacgacgggaactaaggtagaaactacgtaaacgtactacggtacgtactcgactactacg

SEQ ID NO: 165881 - DNA, 546 bp, Homo sapiens
  misc_feature: GYAE6OF02IIR9I.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccggcaagtcaggacattagaactgacttaggttggtatcagcaagaaatccgggaaagcccctaagctcctgatctgtgctgcatcctactttacgaaagtcggggtacccatacgaaggttcaggcggacaggtggatcgtggcacgtagtatttcactctccaaccatcagtcacgcctgcacgcctagaagtattacgactaactttattactgtactaacaagttaacttaactaacttacccgtacggtaccgttcggaccgtagggaaccgtaagggagtaaactacgaaacgtactcggtagccgtacgtccactacg

SEQ ID NO: 165882 - DNA, 553 bp, Homo sapiens
  misc_feature: GYAE6OF02GUP8C.15.67.G01.1.454.CMB.1.raw
  modified_base (201)..(201): a, c, t, g, unknown or other
  misc_feature (201)..(201): n is a, c, g, or t
  modified_base (404)..(404): a, c, t, g, unknown or other
  misc_feature (404)..(404): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtagganacagagtcacatcacttgccgggcaagtcaggacattagaactgacttaggttgtatcagcagaatccgggaaacgcccctaagcctcctgactctgtcgctgacactacctaactttaacgaaaggttcggggtaccctagtacgtaacggttcgaggcggtcaggtggactcgtggacacgtagtacttcactctcaccanacacgcacgcctcgcacgcctagaacttgttaccgactaacgttacttacgtcgttacaactaagttattaaccgtacttaccgacgttacgtcgcgaacgggacgtaggaacgtaacaccgaagtactaggtcgactcgacacctacg

SEQ ID NO: 165883 - DNA, 650 bp, Homo sapiens
  misc_feature: GYAE6OF02FZG6L.15.67.G01.1.454.CMB.1.raw
  modified_base (366)..(366): a, c, t, g, unknown or other
  misc_feature (366)..(366): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtccaccatccacttcgccgggcaagtcaggacattagaactgtacgttaggttgtatcagacaagaacgtaccgggaacgcccctaagcctcctgatcgtgtgctgcactcctactttaacgaaggtcgggtaccctatcgtaacggttcgacggcggnaggtgactcgtggactacgagtactttaccactcctacacctataccacgcacgccgtcgacgtacgtacctaggtaacgtactttaccgacttaaacgttttacttacgttacgttacctaaacgtaacgttaacttaacctaaaccgtttaccccgtacgggttaccggttacccgggaaccgggtaaccggggggtaaacctaaacggggttaacggtaaaccgttaaccgaaaaccgggttacgttacgggttacggaccgtacgtaccacccgttaacg

SEQ ID NO: 165884 - DNA, 810 bp, Homo sapiens
  misc_feature: GYAE6OF02HE9T1.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggcctcccaggtcgccagatgtgccatccagatgacccagtctccatccctccctgtctgcatcgtagtaggagacagacgtcacctatcacttggccggacaagtcgaaggactagttagaactagactttaggttaggtatacgagaccgaagtaaaacgtacccggggaaaacgtacccctaaagtccttaccgtagaacttccgtggtgtaccgtagacctaacttaccctaacgttttaaaccgaaaacgggtttcgggggtacccctaagttacgtaaacggttacgaacggtacgggacgtaacggttacggacgttacgttacggaaccgtaacgtacgttaaacgtttttcccaacttacccgtttaccaaacccgtaacgttaaccgaaccgggtccaaacggtcccgtaccggtaccgaaacggtacccgttaaacggttaaacgttacgtttaacccgaactttaaaccgtttaactttacggttacgtaacgttaaactaaacgggttaactttaaaccgtaaacctttaaccccggtacggttaaccccggttacgggaaccggtaaccgggtaaaccggtaaacggggttaaacgtaaacggtaacccgtaaaaggtaaccgtacgggttaacgtaccgttacggaacccgtaccttaaccgg

SEQ ID NO: 165885 - DNA, 571 bp, Homo sapiens
  misc_feature: GYAE6OF02F4WKZ.15.67.G01.1.454.CMB.1.raw
  modified_base (200)..(200): a, c, t, g, unknown or other
  misc_feature (200)..(200): n is a, c, g, or t
  modified_base (229)..(229): a, c, t, g, unknown or other
  misc_feature (229)..(229): n is a, c, g, or t
  modified_base (282)..(282): a, c, t, g, unknown or other
  misc_feature (282)..(282): n is a, c, g, or t
  modified_base (300)..(300): a, c, t, g, unknown or other
  misc_feature (300)..(300): n is a, c, g, or t
  modified_base (362)..(362): a, c, t, g, unknown or other
  misc_feature (362)..(362): n is a, c, g, or t
  modified_base (396)..(396): a, c, t, g, unknown or other
  misc_feature (396)..(396): n is a, c, g, or t
tcagtctacgtagccacgaccggtgctcgatttagagtatacatattgggtttgggggcaggagtcagacccactcagtacacagcatggacatgagggtccccgctcagctcctgggctcctgctgctctggctcccaggtgccagatgtgccatccagatgacccagtctccatccctcctgtctgcatctgtagganacagagtccaaccatcacttggcccgggnaaggtcaggacattagaactgacttaggttggtatcagcagaaagtcggaaancccctaagctcctgatcngtgctgcatccactttacaagtggggtcccaatctaaagttcgagtcggacgtgtaaaaggntcgtggaccacgagtactttcacgtcctcaaccntcagtacagtcctgactagcctagtaacgtaactttcgaccttaaagttaacttactcgttaactaacgtaagtacttaaactaacgtttaacccgtacgggtacgttcgaccggaagggacccgtaaggtacggtaaactaccaaacgtacggtatacggctcgacgcctaacg

SEQ ID NO: 165886 - DNA, 672 bp, Homo sapiens
  misc_feature: GYAE6OF02JWF6C.15.67.G01.1.454.CMB.1.raw
  modified_base (202)..(202): a, c, t, g, unknown or other
  misc_feature (202)..(202): n is a, c, g, or t
  modified_base (264)..(264): a, c, t, g, unknown or other
  misc_feature (264)..(264): n is a, c, g, or t
  modified_base (284)..(284): a, c, t, g, unknown or other
  misc_feature (284)..(284): n is a, c, g, or t
tcagtctacgtagccacgaccggtgctcgatttagagtatacatattgggtttgggggcaggagtcagacccactcagtacacagcatggacatgacgggtcccgctcagctcctgggctcctgctgctctggctccaggtgccagatgtgccatccagactgacccagtcctccatcctcctgtctagcatctggtagganacagcgtcaccgatccgacgttggccgggcaagtcaggacattagaactgacttaggtgtancagacagaacgtccggaaancccctaagcctaccgtagatacctgtcgctcgctaacgtcctaacgtttaacgaaacgggttcggggtacccagtacgaacggttacagggcggtactaggtacggtactcggtaggctaacgtagttacttttacgacttccgtaccaacctagtaccaacggtacacggtcctggactaacgaccgttaaggtaacgttactttacggacttaaacttttacgtacgttagtaccgtaaactaacggttaaccttaaccttaaaccgttacccggtacgggttacccgggtttaccgaccggtaacggggaaccctaaaggggttaaccggtaaacctacggtaaaccgtacgtacggtaccggtcgaccgtaccgtaacgttacg

SEQ ID NO: 165887 - DNA, 633 bp, Homo sapiens
  misc_feature: GYAE6OF02IB4K2.15.67.G01.1.454.CMB.1.raw
  modified_base (288)..(288): a, c, t, g, unknown or other
  misc_feature (288)..(288): n is a, c, g, or t
  modified_base (492)..(492): a, c, t, g, unknown or other
  misc_feature (492)..(492): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtcctccatcctcctgtctgcatcgtggtaggagacagagtccaccatcacgtcggccgggcaagtcaggactataagactgtacgttaggttgtatcgagacagaacgtaccggaaancccctaagctccgtagacttctgcgctcgcacttacctactttaacgaaggttcgggtacccagtacgtaaacggttcgacggcggtacgaaggtcggtatcgtcggactaacgtacgttacttttacgaccttcctacacatcgagccgacgtcctagcgacgtactagaacgttacttacgaactttaacttagttaccgtnttaactaactaagtactttaacctaaccgttacccggtacggtaccggttaccggaccggtaggggaacctaagggtaacgtaaaccgtaaccgtaaaacggtacgttaccgggtagacccgttacgaacccgtcgtaacg

SEQ ID NO: 165888 - DNA, 606 bp, Homo sapiens
  misc_feature: GYAE6OF02IAW1T.15.67.G01.1.454.CMB.1.raw
  modified_base (435)..(435): a, c, t, g, unknown or other
  misc_feature (435)..(435): n is a, c, g, or t
  modified_base (452)..(452): a, c, t, g, unknown or other
  misc_feature (452)..(452): n is a, c, g, or t
tcagtctacgtagccacgaccggtgctcgatttagagtatacatattgggtttgggggcgaggagtcagacccactcagtacacagcatggacatgagggtccccgctcagctcctggggctcctgctgctctggctcccaggtgccagatgtgccatccagatgacccagtctccatccctccctgtctgcatctgtaggagacagagtccaccatcacttggccgggcaagtcaggacattagaactgacttaggttggtatcagacagaaagtccgggaaagcccctaagcctcctagactcgtgtgcgtcgcacttacctaacttttaaccgaacggtcggggtaccagtactaacggttcaggcggctaggtggtatcgtggaccacgtagtatttacacttctacgactatcagcacgctagcagctanagttattcgataacttntacttgtactaacaagtacttaacctaacgtttacccgtacggtaccggtttacccggaccggtaacggggtaaaccgtaaacgggtaacgggtaaacttaaccgtaaacggtaacttacgggtaccggtacgtacggtacccaaccgttaccg

SEQ ID NO: 165889 - DNA, 681 bp, Homo sapiens
  misc_feature: GYAE6OF02H9X8C.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctcctgtctgcatctgtaggagacagagtcacatcacgttgccgggcaagtcaggacattagaactgacttaggttggtatcagcagaagtcggaaagcccctaagctcctagatctgtgcgtgcacttcctaactttacgaaaggtcggggtacccaagttcaaggttccgagcggacgaggtggactacgtcgggcactaggtactttcaacgttcctaccaacctactaccagtccgaacggtccctaggtacccaacggtacccgttaggaaaccgttacgttttaccggaaccttaaaccgttttaatttaccgttacgttaccgttaaactaaaggttaacctttaaaccgaaaccgttttaaccccggttaccgggtaccggttttaccggacccgggtaaagggggtaacccgtaaacggggtaacgggtaaaaccgttaacaaaacccgggttaacgttcgggttaccgtccggtacgtaccgtacccttaacg

SEQ ID NO: 165890 - DNA, 747 bp, Homo sapiens
  misc_feature: GYAE6OF02IEABS.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtcgccagatgtcgccatccagatgacccagtcctccatccctcctgtctgactatctggtacggagacagacgtccaactatcacgttcggaccggactaagtccgaggactagttaacgaactgtacgttacggttaggtactacgacgacgtaaggtaaaacggttaccggggaaaaccgtccccgtaaaggtcccttaccgtagtaacttccggtggtcgtaccgtcgtacctaaccgttacctacgtttaacgaaacgggttcggtaccctagtaccgtacggttacgacggcggtactagggtacgtaacttccgcggtaactaaccggtagttaactttaccgaacctttcccggaacttaaacccggctacgaacggtaccaacggtcccgtagaccgtaacgaccgttaaaggtacgttactttaccggaacctttaaacggtttacctttacggtaccgttaaacgtaacgtaaacgttaacttaacccgtaacgttaacccgtacggttaccggttacggacggtaaccgggacgtttaacgggagtaaacgtaacccgtaagtacgtacggtagtaccgtacaccggtactacg

SEQ ID NO: 165891 - DNA, 546 bp, Homo sapiens
  misc_feature: GYAE6OF02G2KF4.15.67.G01.1.454.CMB.1.raw
  modified_base (225)..(225): a, c, t, g, unknown or other
  misc_feature (225)..(225): n is a, c, g, or t
  modified_base (364)..(364): a, c, t, g, unknown or other
  misc_feature (364)..(364): n is a, c, g, or t
  modified_base (369)..(369): a, c, t, g, unknown or other
  misc_feature (369)..(369): n is a, c, g, or t
  modified_base (398)..(398): a, c, t, g, unknown or other
  misc_feature (398)..(398): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctcctgtctgcatctgtaggagacagagtcaccatcacttgccgggnaagtcagacattagaactgacttaggttgtatcagcagaaatccgggaaacgcccctaacgcctcctgatcgtgtgctgccatcctactttaacgaaagttcggggtaccatacgaaggttcaggcggacagtggatcnggcanagtattcactctacaccatcagcacgccncgcacgcctagtaagtactttcgactaactttattacgtgtactaataagtacttaacgtaacttacccgtcgtacggttcggtaccgacggggacctaagggtacgaaactacgaaacgtacgtacggtaggtcgtgaccaactacg

SEQ ID NO: 165892 - DNA, 700 bp, Homo sapiens
  misc_feature: GYAE6OF02GIDKE.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctcctgtctgcatctgtaggagacagagtcaccatcacgttgccgggacaagtcaggacattagaactgacttaggttggtatcgagacaagaaacgtaccgggaaacgacccctaagcctcctagatcgtgtgctgactactcctaactttaacgaaggtcggggtacccagtacgtaaggttcgacggcggcgtaggtaggactcgtaggtaccacgtagtactttaccgaccttcctaccgacctactacgaacgccgtacgtccgtacgacctacggtcccgttaaggtaacgttaacgttttacccgaaccgttaaacttttaacgttaaccgttacgttaacctaaccgtaaagttaactttaaacccgtaaaccgtttaaccccggtacgggttaaccggttacccgggtaccggtaaccgggggtaaaccggtaacgggttaacggtaaaaccgttaaccgtaaaccggtaaccgttacgggttaccggaccgtacgtacccgaccgttaaccg

SEQ ID NO: 165893 - DNA, 531 bp, Homo sapiens
  misc_feature: GYAE6OF02G0Q35.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtcggggtccatcaaggttcagcggcagtggatcgtggcacagatttcactctcacatcagcagcctgcagcctagaagatttcgactaacttattactgtctaacaagtatttaacaacttacccgtcggtaccgttcggaccgtacggggaacccgtaagggtacggtaaacgtacgaaacgtaacgttggtacggccgtacgcacctacg

SEQ ID NO: 165894 - DNA, 692 bp, Homo sapiens
  misc_feature: GYAE6OF02GQE6T.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatcgacccagtctccatccctccctgtctgcatctgtaggagacagacgtcaccatcacgttcggcccgggactaagtcaggacctaattaagaacgttgtaacgtttagggttgtatcgagacaaggaacgtaccgggaaacaccccgttaaggcctaccgtagtactcgtcgtcgcgtcgacctacttccgttaacgtttaacgaacggtccgggtacccattacgtaacggttcaggaccgtcgaggttcgacgtcgtaggacaacgtacgttactttacctaccgttcctaccaacctataccgacgcctacgtccctacgcgtaccggtacgtaacggttaacgttcgtttaccgaactttaaccgttttaagtttaccgtacgtttaacaacgttaaacgttaacttttaaccgtaaacctttaccccgggtacgggttaccgttaccgggacccggtaaggggaccgtaaggtacggtaaaccaacggtaacgtacgttcgacggtccacggtccaccgttacg

SEQ ID NO: 165895 - DNA, 574 bp, Homo sapiens
  misc_feature: GYAE6OF02F5L5P.15.67.G01.1.454.CMB.1.raw
  modified_base (202)..(202): a, c, t, g, unknown or other
  misc_feature (202)..(202): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctggtagganacagagtcaccatcacttgccgggcaagtcaggacatagaactgacttaggtggtatcagcaagaactaccgggaaacacccctaagcctcctagatcgtgtgctgactactcctaactttaacgaaaggtcggggtacccaatcgtaaggttcaggcggacgtaggtggatcgtggacacgagtactttcgactctcgactatcagcagcctcgcacgctagaactcttacgacttaactttatacgtgtactaagtaactacttaactaaccgttaccgtacggtaccgttaccggacggtaaccgggtaacgtaaggtacggtaaactacgaaacggtacgttcgggtacgtcgtcgtaccaccgtacg

SEQ ID NO: 165896 - DNA, 598 bp, Homo sapiens
  misc_feature: GYAE6OF02JZ77E.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatcgacccagtctccatcctccctgtctgcatctgtaggagacagagtcaccatcacttgccggcaagtcaggacattagaactgacttaggttggtatcagcaagaaacgtaccgggaaacgtcccctaaggcctaccgtagacttcgtagtcgtcgttcgactacttcctaactttaacgaaacggttcggggtacccctagtaccgtaaggttcgacggcggacgtaggtcgtagtcgtaggacactagttattaccactcctacgaccatccagcacgcctgcctacgtctacgatcttacgacttaacttacttacgtactactagtaacgtacttaacctaacgtacccgtcgtaccgtaccggacgtaacgggtaactacgggtaagtaaccgtacgaaacgtagtacgggagtctacgtacgtacctag

SEQ ID NO: 165897 - DNA, 553 bp, Homo sapiens
  misc_feature: GYAE6OF02I3MOR.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctcctgtctgcatctgtaggagacagagtcaccatcacttgccgggcaagtcaggacattagaactgacttaggttgtatcagcaagaaagtccgggaaacgcccctaagcctcctagactctgtgctgccatcctactttacgaaaggtcgggtaccagtctaaggttcagcggcagtggatcgtggacacgagtatttcactctacaccatcagcacgcctgcagcgtagaacgtactttaccgactaactttacttacttcgtactaacaagtacttaacgtaactttacccgaggtaccgttcggaccgtaacgggacgaagggtacgaaacgtacgaaaccgtagtggtacggcgtacgtaccgactacg

SEQ ID NO: 165898 - DNA, 714 bp, Homo sapiens
  misc_feature: GYAE6OF02I6UYL.15.67.G01.1.454.CMB.1.raw
tcagtctacgtagccacgaccggtgctcgatttagagtatacatattgggtttgggggcaggagtcagacccactcagtacacagcatggacatgagggtcccgctcagctcctggggctcctgctgctctggctcccaggtgccagatgtgccatccagatgacccagtctccatcctcctgtctgcatcgtgtaggagacagagtcaccatcacgttcggccgggacaaggtcaggacattagactgtacgttaggttggtatcgagcgaagtaaacgtccgggaaacgtccccgtaacggcctacctagatcgtgtcgctgctactcctaactttaacgaaacggtcggggtaccctagtacgtaacggttcgacggcggacgaggttggatcggtacggactaacgtagttactttccgtactccgtaccaacctacgtacagaccgtacgcccgtagaccgtaacggtcccttaagggtaacgttacctttaccgaactttaacgtttacgttaccgttacgtacctaaacgttaaacgtaacctttaaaccgttacgttaaccccgtcggggttaacccgttacccggggtaaccgggtaacggggtaaacccggttaaacgggttaaacggaaaccttaaacccgggaaaccgttaaccggttacggttaccgggtaaccgtccggtaacccgtacccgtttaacgg

SEQ ID NO: 165899 - DNA, 807 bp, Homo sapiens
  misc_feature: GYAE6OF02H2DS8.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagacgtccaccatccacgttcggccgggacaaggtcaaggactaagttaacgaacttagtaacgtttagggtttaggtactacgaggtacgaaaggaaaacggtacccggggaaaaccgtacccccgttaaaggcccgttaccgtaggtacttcgtgtcgtctacgacctacttacctaacgtttaacgaaacgggttcgggtaccctagtacgtaaacgggttcacggtccggtagtaggtggtacgtcgtacggacctagtaacgttacttttaccaccttcctaccgtaacctagttaccgacgaccgtaaccgttccgtacgtaccgaacggttaccgtaaggttaacgtttacctttaccgaaaccttttaacgtttaacgttaaccttacgtttaacctaaacgtaaacgttaaaccgttttaaccgtaaacccggtttaccccgtacggggtttaacccgttacccggggaaccgggtaaccgggggttaaaccgttaaaccggggtaacggttaaaaacccgttaaaccgtaaaacccggttacggtttacgggtacccgggtaaccgttaaccggtaccccgtaaccctttacgg

SEQ ID NO: 165900 - DNA, 635 bp, Homo sapiens
  misc_feature: GYAE6OF02GKDLQ.15.67.G01.1.454.CMB.1.raw
  modified_base (226)..(226): a, c, t, g, unknown or other
  misc_feature (226)..(226): n is a, c, g, or t
  modified_base (302)..(302): a, c, t, g, unknown or other
  misc_feature (302)..(302): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggnaagtcaggacattagaactgtacttaggttggtatcagcaagaagtccgggaaagcccctaagctcctgatctgtnctgcactcctacgtttaacaaggtcgggtaccctagtacgtaacggttcgaggcggacgaggttcggattcggtcggactaacgtagttactttaccacttcctacctaacctataccgacgcgaggtcccgtagacgtacgtaccgtaagtaacgtactttccgaacttaactttaattaccgtagttaccttaacaagttaacttaacctaaccgtttaaccgtacgggtaccggtttaccggacggtaacggggtaaccgtaagggtaacgtaaacgtaaccggtaaacgtacggttcggtaacggtacctaccggtacctacgttaccg

SEQ ID NO: 165901 - DNA, 721 bp, Homo sapiens
  misc_feature: GYAE6OF02IZ098.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagtagtccaccatctacgttggcccggacaacgtcgaggactattagaactgtacgttaggttaggtatacgagcgaagaaacgtaccgggaaacgaccccgtaagcctacctggtactcgtgtcgctgactatccctaagtttaaccgaaaggtccggggtaccctaacgtacgtaagggttccgacggcggtacgtaggtacggtactcgtggaccgacgtagttactttacctaccttacctaccaacctacgtacgacgtaccgacgtaccctgccgtaacgtccgtagtaacgttacgtttacccgacttaacctttaacttaccgttcggtaaccttaaacggtaaagttaaccttaaaccgttaacccgtttaacccgttaccggggttaccggttaccgggtacccggaaaccgggggttaaccgtaaaggggtaaaccggttaaacgtaacccggtaaaacggtaaccgttacgggttacggacccttacgtacccgaaccgttaaccg

SEQ ID NO: 165902 - DNA, 649 bp, Homo sapiens
  misc_feature: GYAE6OF02JDZZX.15.67.G01.1.454.CMB.1.raw
  modified_base (199)..(199): a, c, t, g, unknown or other
  misc_feature (199)..(199): n is a, c, g, or t
  modified_base (226)..(226): a, c, t, g, unknown or other
  misc_feature (226)..(226): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctcctgtctgcatctgtaggnacagagtcaccatcacttgcccgggtnaaacgtcaggacattagaactagacttaggttggtatcgagacagaaataccgggaaacgtacccctaaggactcctagtactctagtgcctgcctatacctactttaacaaaggttcggggtaccctagtaccgtaaggttccaggtccgtacgaggttacggataccgtgggacctacgaacgtactttacgacttcctaccaaccgtactcacggacacgtccctagccgacgaccgttagtaacgtactttcgaccttaacttagttaccttacgttacgtaactaagttacttaaactaaccttaacccgtacggttaaccgttccggtaccgaaccggggtaaccgaacggttacggtaaaacgtaccgtaaaacgtaacggttacggtaccgtacggtaccgtacgtaccttaacg

SEQ ID NO: 165903 - DNA, 618 bp, Homo sapiens
  misc_feature: GYAE6OF02GX54X.15.67.G01.1.454.CMB.1.raw
  modified_base (228)..(228): a, c, t, g, unknown or other
  misc_feature (228)..(228): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctcctgtctgcatctggtaggagacagagtccaccatcacttcgccgggnaagtcaggactattagaactgtacttaggttgtatcagcaagaatacccgggaaacgcccctaaggcctcctgactctgtgctgcatcctacttaacgaaggtcgggtaccagtacgtaaggttcgacggcgacgtaggtggtactcgtgggaccacgtagtactttacgtacctacctaccacctacgtacacgacacgtcctacgactacgccgtacgtaacgttacttacgctaaaaaaactttcttacttacgttactaacgtaattaacttaactaacttaacccgtacgtaccggttcggtaccggaacgggtaaccggtaacgggtaacggtaaacgtaaccgtaaacgtaacgtacggtacggacgtacggaccgtactacg

SEQ ID NO: 165904 - DNA, 687 bp, Homo sapiens
  misc_feature: GYAE6OF02I0LDH.15.67.G01.1.454.CMB.1.raw
  modified_base (229)..(229): a, c, t, g, unknown or other
  misc_feature (229)..(229): n is a, c, g, or t
tcagtctacgtagccacgaccggtgctcgatttagagtatacatattgggtttgggggcaggagtcagacccactcagtacacagcatggacatgagggtccccgctcagctcctgggctcctgctgctctggctcccaggtgccagatgtgccatccagatgacccagtctccatccctccctgtctgcatctgtaggagacagagtccaccatcacttggcccgganaagtcaggacattagaactgacttaggttggtatcagcaagaaataccgggtaaacgaccccgtaaagcctccgtagacttcgtgtagcttagaccgtactccctaactttaacgaaaggttcggggtaccctagtacgtaaaggtttcgacggtccggtacgaggttacggaacttccgacggtacctacgaaggttacttttacccgtacttccgtaccaacctactaccgaacgccgtaacgcccgttacgaccgtacggtaccttacggaacgttacgtttaccgaaccttaactttaactttaccttacgttactaaaccgtaagtaacctttaacgtaaacctttaccccgttacggttaccgttacccggtaccgtaacgggtaaccggtaacggtaggtaaacgtaaccgaaacgttaacgtcgaggttaccgacgtaccgacttaaccg

SEQ ID NO: 165905 - DNA, 754 bp, Homo sapiens
  misc_feature: GYAE6OF02HML6S.15.67.G01.1.454.CMB.1.raw
  modified_base (203)..(203): a, c, t, g, unknown or other
  misc_feature (203)..(203): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatcgacccagtcctccatcctcctgtctgcatctggtagganacagacgtccaccatccacttcggccgggacaagtcaaggactattaagaactgtacttaggttggtactcgagacaaggaaacgtacccgggaaacgtccccgtaagtcctaccgtagtacttctcggtcgtcgttcgactactacccttaacgtttaacgaaacgggttcggggtaccctaagtaccgtaaacggttcacgggcggtacgtaacggtacggtacgttacggtcgggactaacgtaacgttactttcccgtaaccttacccgttaccaacccgtagtacccgaaggtacccgtacggtacccgttcggaccgtacggttaccgtaacggtaaacgttaaccgtttaccgaaccgtttaactttaacgttttaccgtactttaaccgtaaactaacggttaacctttaaaccgtaacccgtttacccggttacggttaccgggttacccgggaccggtaacggggtaaccggtaacgggttacggtaaaaccgtaaccggtaacgttacgtacggtccggtactacggacctaccgttacg

SEQ ID NO: 165906 - DNA, 536 bp, Homo sapiens
  misc_feature: GYAE6OF02IDG7U.15.67.G01.1.454.CMB.1.raw
  modified_base (413)..(413): a, c, t, g, unknown or other
  misc_feature (413)..(413): n is a, c, g, or t
  modified_base (435)..(435): a, c, t, g, unknown or other
  misc_feature (435)..(435): n is a, c, g, or t
tcagtctacgtagccacgaccggtgctcgatttagagtatacatattgggtttggggggcaggagtcagacccactcagtacacagcatggacatgagggtccccgctcagctcctggggctcctgctgctctggctcccaggtgccagatgtgccatccagatgacccagtctccatcctcctgtctgcatctgtaggagacagagtcacatcacttgccgggcaagtcaggacattagaactgacttaggttggtatcagcagaaagtccgggaaacgcccctaagcctcctgatctgtgctgcactcctacttacaaaggtcgggtacccagtactaagttcagcgcagtggatctcggcacgtagtatttcactcctacaccatcagcacgcctgccagcctagacgtntttcgacttaacttattacttntacataagtattaacacttaccgtcgtacgtcggaccgaagggtaacgaaggtacggtaaactaccgaaacgtacgtaggtacgtactacgtaccactacg

SEQ ID NO: 165907 - DNA, 606 bp, Homo sapiens
  misc_feature: GYAE6OF02HFM4J.15.67.G01.1.454.CMB.1.raw
  modified_base (201)..(201): a, c, t, g, unknown or other
  misc_feature (201)..(201): n is a, c, g, or t
  modified_base (399)..(399): a, c, t, g, unknown or other
  misc_feature (399)..(399): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtagganacagagtcaccatcacttcgccgggacaagtcaggacattagaactgtacgttaggttaggtatcagacaagaaacgtaccgggaaagccccgtaaagctacctgactctgtgctgctactacctaacgtttaacaaaacggtcggggtacccaagtacgtaaggttcgaacggcggacaggtggtatcgtagacaanagtatttaccactctacacccatacacgacacgcctcgacgtacgaccgtaggaacgttactttaccgacttaaacgttattaaccgttgtactaaactaagtaacttaactaaaccttaccgtacgtacggttcggaccgtacgggaaccgtaaggtacggaaacgtaacgaaacggtactacggtacggcctagaccgtactacg

SEQ ID NO: 165908 - DNA, 636 bp, Homo sapiens
  misc_feature: GYAE6OF02I566P.15.67.G01.1.454.CMB.1.raw
  modified_base (208)..(208): a, c, t, g, unknown or other
  misc_feature (208)..(208): n is a, c, g, or t
  modified_base (300)..(300): a, c, t, g, unknown or other
  misc_feature (300)..(300): n is a, c, g, or t
  modified_base (306)..(306): a, c, t, g, unknown or other
  misc_feature (306)..(306): n is a, c, g, or t
  modified_base (372)..(372): a, c, t, g, unknown or other
  misc_feature (372)..(372): n is a, c, g, or t
  modified_base (407)..(407): a, c, t, g, unknown or other
  misc_feature (407)..(407): n is a, c, g, or t
tcagtctacgtagccacgaccggtgctcgatttagagtatacatattgggtttgggggcaggagtcagacccactcagtacacagcatggacatgagggtcccgctcagctcctgggctcctgctgctctggcctcccaggtgcccagatgtcgccatccagatgacccagtcctccatcctccctgtctgcatctgtaggagacagngtcacatcacttgccggcaagtcagactattagaactacttaggtgatacgagcaagaaagtccggaaagacccctaagctacctgacgtcngtgctncactacactttacgaaaggtcgggtacccattacgaacggttcaggcggctaggtacgacgttcgnggaacacgagtactttacacctctaccgaactacnacgactagcctagcgacgaccgtagagttacgttaccgacttaaaccgtttattaccgttacgtaaccgtttaaacgaaacgttaacttaaacttaacccgttaaacccgtttacggggacctttaccgggaccgtacggggtaaaccggtaaaggtacgggtaaaataccggtaaaacggttaacccgtagggttacggacgtttaccgaccgtaaccgtacgttacg

SEQ ID NO: 165909 - DNA, 597 bp, Homo sapiens
  misc_feature: GYAE6OF02HWN3Q.15.67.G01.1.454.CMB.1.raw
  modified_base (200)..(200): a, c, t, g, unknown or other
  misc_feature (200)..(200): n is a, c, g, or t
  modified_base (226)..(226): a, c, t, g, unknown or other
  misc_feature (226)..(226): n is a, c, g, or t
  modified_base (288)..(288): a, c, t, g, unknown or other
  misc_feature (288)..(288): n is a, c, g, or t
  modified_base (425)..(425): a, c, t, g, unknown or other
  misc_feature (425)..(425): n is a, c, g, or t
  modified_base (588)..(588): a, c, t, g, unknown or other
  misc_feature (588)..(588): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctcctgtctgcatctgtagganacagagtcacatcacttggccggganaagtcaaggacattagaactgacgttaggttagtatacagacaagaaacgtaccgggaaacnccccgtaagccgtacctggattcgtgtcgctcgactacttacctacttaacgaaggtcggtaccagtacgtaggtcagcgatagtgatcgtgactacgagtattcacgtcaccactagtcacgcgacgtcgtagacncgtctagagttacgtactactaactttacgtattcgtaactaacaagttacttacctaaccgttacccgtaggtaccggtaccggaacggacggggtaacctaaggggttaacgaaaccgttaaccgtaaacgtacgttcgggtaacggacctacggtacccnccgttaacg

SEQ ID NO: 165910 - DNA, 697 bp, Homo sapiens
  misc_feature: GYAE6OF02GRTCK.15.67.G01.1.454.CMB.1.raw
  modified_base (202)..(202): a, c, t, g, unknown or other
  misc_feature (202)..(202): n is a, c, g, or t
  modified_base (213)..(213): a, c, t, g, unknown or other
  misc_feature (213)..(213): n is a, c, g, or t
  modified_base (371)..(371): a, c, t, g, unknown or other
  misc_feature (371)..(371): n is a, c, g, or t
  modified_base (392)..(392): a, c, t, g, unknown or other
  misc_feature (392)..(392): n is a, c, g, or t
tcagtctacgtagccacgaccggtgctcgatttagagtatacatattgggtttgggggtcgaggagtcaggacccactcagtacacagcatggacatgagggtcccgctcagctcctgggctcctgctgctctgggctcccaggtcgccagatgtgccagtccagatgacccagtctccatccctcctgtctcgacattcgngtaggatcagngtcaccatcatcgcggcaagtcagacgatagaactgtacgttagttcggtatacagtacgaagaacgtaccgggtaacacccgtaagtacgtccgtagatcgttagcggacttggcactacctactttagaaacggtgggaccctatacgtaggtacnggacgcaggtcgtaacgtcgngtacgactagacgttttaacacgttcgactacctactcacggtacacgtaccctggaaccaccggacttacggaaacgtaccgtttacgtaacccgtaacgtttaacgtacctttacggtaaccctacggtaaacgttacttaaacccgtaacgttttaaacccggacccggttaaccggttcggtaccccggttaacgggggaaaccggttaaccgggtaacggggtaaaacccgttaacgggtaaaacccgttaaccgggttacccggtaagggttccgtaacccggtacggtacccgtaacg

SEQ ID NO: 165911 - DNA, 778 bp, Homo sapiens
  misc_feature: GYAE6OF02FKD40.15.67.G01.1.454.CMB.1.raw
  modified_base (227)..(227): a, c, t, g, unknown or other
  misc_feature (227)..(227): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctcctgtctgcatctgtaggagacagagtcaccatcacttcggccgganagtcaggacattagaactgtacgttaggttgtatcagacaagaacgtccgggaaacgccccgtaagcctcctagtactctgtgctgctactacctactttaacgaaggtcggggtaccctagtaccgtaaggttcgacggcggtacgaggtcgggtacttcgtcggacctaagacttaacgtttccgtaccttactacccgtaactactaccgaacgtccgtaaccggtcccgttacggaacccgttacggtacccgttaacggtaaacggttaccgtttttacccggaacctttaaaaccgttttaaccgtttaaccgttacgtttaaacccgttaaaaccgttaaacgttaaacctttaaacccgttaaacccggtttaccccgtttaacccgggggttaaccggttttaccccgggggacccgggtaaaccggggggttaaaccccggaaaggggtttaaaccggtaaaaccgttaacccggtaaaaccggtaccggtttacgggttaaaaccggtccgttaaccggtacccgtaacccgttaaccgg

SEQ ID NO: 165912 - DNA, 726 bp, Homo sapiens
  misc_feature: GYAE6OF02HKC6R.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatccctcctgtctgcatctgtaggagacagagtcaccatcacttggccggacaagtcaggacattagaactgacttaggtgtatcagcaagaagtaccggaaacgcccctaagctcctgactctgtcgctcgctactacctaactttaacgaacggttcggggacccctagtaccgtaaacggttccgaaggtccgggtactaagggttcggtaaacgttccggttcgggacctaactacggttacttttaccacccgttaccttacccgaacctacttaccgaacgacgtaacgtccttcggacctaacgcccgttaggtaaccgttaacgttttaccgacctttaaaccgtttactttaaccgttcgttaacccgttaacgtaaacgtttaacttaaaccttaaaccggtttaaccccgtaccgggtttaccggttaccggacccgggttaaccgggggaaacccgtaagggttaacggtaaaaccgttaacccggaaaaggttaacccgtgggttaccggtaccgtaacgtaccctaaccgttacccg

SEQ ID NO: 165913 - DNA, 510 bp, Homo sapiens
  misc_feature: GYAE6OF02GIYIU.15.67.G01.1.454.CMB.1.raw
  modified_base (275)..(275): a, c, t, g, unknown or other
  misc_feature (275)..(275): n is a, c, g, or t
  modified_base (396)..(396): a, c, t, g, unknown or other
  misc_feature (396)..(396): n is a, c, g, or t
  modified_base (409)..(409): a, c, t, g, unknown or other
  misc_feature (409)..(409): n is a, c, g, or t
  modified_base (421)..(421): a, c, t, g, unknown or other
  misc_feature (421)..(421): n is a, c, g, or t
  modified_base (439)..(439): a, c, t, g, unknown or other
  misc_feature (439)..(439): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccggcaagtcaggacattagaactgacttaggtggtatcagcagaatccgggaanccctaagctcctgatctgtgctgcatccactttacaaggtcgggtccatcgaagttcagcggcagtgatctggcacgagtactttcactctacacatcacgcagcctgcagcctagaactnttcgactaacttntactgtactaanagattacaacttacccgngtacgttcgaccgaagggacctaaggtacggtaaataccgaaacgtacgtggtaggcctacgtccactacg

SEQ ID NO: 165914 - DNA, 657 bp, Homo sapiens
  misc_feature: GYAE6OF02I04SA.15.67.G01.1.454.CMB.1.raw
  modified_base (233)..(233): a, c, t, g, unknown or other
  misc_feature (233)..(233): n is a, c, g, or t
  modified_base (290)..(290): a, c, t, g, unknown or other
  misc_feature (290)..(290): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtcctccatccctcctgtctgcatctgtaggagacagacgtccaccatcacttcggcccggganaagtcaggacattagaactgacttaggttggtatcagcaagaaacgtccgggaaacncccctaagcctacctgatcctagtgctgctagtcctaactttaacaaaggttcggggtacccaatcgtaacggttcacggtcggcgtaggtacggtactactgggacacgtagttactttaccaccgttctaacccacgtactcgtagcctaacgccctacggctaccgtcgtaacgtaacgtaccgttttcaaccgttaacttttattaacccttggtttaaccttaacgtaacgtttaacttaaacgttacttaaccccggttaccgggtacgttacccgggtacggtacggggaaacccgtagggtaaccggtaaacgttaaccggaaacgtacggttgtacgggtatacggacctaccttacg

SEQ ID NO: 165915 - DNA, 705 bp, Homo sapiens
  misc_feature: GYAE6OF02G41B9.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtcctccatccctccctgtctgctatctggtaggagacagacgtccaaccatcacttggccggacaagtcaggactattagaactgacttaggttgtatcgagcaagaaacgtaccgggaaacgtacccctaagccttaccgagacttcgtggtcgcgtgactactcctaacgttaacgaaggtcgggtacctagtacgtaaggttcgaggccggacgtaggtacggacttcggtacggaccgtaacgtaacgttactttcccacttccctaaccaccctataccgaagtcccgtaacggcccgtcgaccgtacgtcccgtaaggacgtttacctttaccgtaactttaacctttacttaaccgttgttaaaccctaaacgttaacgttaaactttaacccgtaaacctttacccgggtacgggttaacccgttccggggaaccggttaacggggaaacccggtaaaggttaacggtaaacccttaacggtaaaaccggtagttacggtccggtacgtacccgacctaccggttac

SEQ ID NO: 165916 - DNA, 667 bp, Homo sapiens
  misc_feature: GYAE6OF02H6E0N.15.67.G01.1.454.CMB.1.raw
  modified_base (200)..(200): a, c, t, g, unknown or other
  misc_feature (200)..(200): n is a, c, g, or t
  modified_base (275)..(275): a, c, t, g, unknown or other
  misc_feature (275)..(275): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggnacagagtcacatcacttgccggcaagtcaggacattagactgacttaggttgtatcagcagaaagtccgggaaanccccctaagctcgtgatctgtgctgcacttccgtaactttaacgaaaggtcgggtacccatcgaaggttcagcggacaggtgtaatcgtggacacgtagtactttccgactcctccgaacctataccacggtaccacggtccttaggtaccacggttaccctaaggtaaacgttacgttttaccgaactttaaactttacgtttaacgttacgtttaacctaacgtaaacgttaactttaaacccgtaaacgtttaacccccgtcgggttaaccgttacccgggaacccgggtaacggggtaaccccggtaaaggggttaaccgggtaaactaaacccggttaaaaccggtacgttacgggtaccggtacctacggaccctaacccgttacg

SEQ ID NO: 165917 - DNA, 619 bp, Homo sapiens
  misc_feature: GYAE6OF02GLU9Q.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctcctgtctgcatctgtaggagacagagtcaccatcacttggccgggacaagtcaggactattagaactgacttaggttaggtatcagcaagaaacgtaccgggaaacgcccctaaggctccgtagactctgtcgctgacctacttacctaactttaacgaaggttcggggtacccatacgtaagttcgacggcgagtaggtgactcgtggacactagtacttacacgtctaccactactcacgacctacgtacccgtgaccgtacgtccgtaagtaacgttacgtttacgaccttaaactttattaccgtacgttactaacgtaacgttacttaactaaacccttaccgttacggtaccgttacggaccggtaacgggaacctaagggtacgtaaacgtacgaaacgtcgtacggtacgtacgtcgtaccaccgttaacg

SEQ ID NO: 165918 - DNA, 640 bp, Homo sapiens
  misc_feature: GYAE6OF02G6CP8.15.67.G01.1.454.CMB.1.raw
  modified_base (202)..(202): a, c, t, g, unknown or other
  misc_feature (202)..(202): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatccctccctgtctgcatctgtagganacagtagtcaccatccacttcggcccgggacaagtcaaggactattaagaactgacttaggttggtatcagcaagaaagtccgggaaacgcccctaaagccttccgtgatcctgtgctgcctactcctaactttaacgaaagggtcggggtacccagtacgtaacgggttcacggcggacgtaggtcgggtaacttcggtcggaccacgtaagttacgtttaccacttcctacctaaccctattaccgacgcgaacgtccctagccgaacgtaccgtaggaacgtttactccgtaaccttaactttacgttacctagttacctaacgtaattaaccttaactaaaccttacccgtccggtacgttccgggacgaacgggtaccggaaggtaacgtaagtaaccgtaaagaccgttagcggtactacgacctacgtacg

SEQ ID NO: 165919 - DNA, 863 bp, Homo sapiens
  misc_feature: GYAE6OF02I0Y3Z.15.67.G01.1.454.CMB.1.raw
  modified_base (167)..(167): a, c, t, g, unknown or other
  misc_feature (167)..(167): n is a, c, g, or t
tcagtctacgtagccacgaccggtgctcgatttagagtatacatattgggtttgggggcaggagtcagacccactcagtacacagcatggacatgaggtccccgctcagctccgtgggctcctgctgctctggcctcccgaggtcgaccagtatgtcgccatccagntcgacccagtcctccatccctcccttgtctgctacttcgtaggtaaggacgacagacgtcccaacctactaccgtaccgttcgggacccgggactaaggttcgaacggtactaagttaacgtaacgtcgtaacgttttagggttagtactacgaaggtacgaaacggtaaacggtaccccgggtaactacccccgttaaggtcccttaccgtagtaccgtttccgtacggtcggtacgttccgaccttaccgttaccttaaaccgtttaacgggtaaccggggttaccggttacccttaacttaaccgggttaaacgtttcgaccgggtcgggtaacgtacgggttacgtacggtccgtacggtaacccgtacgtaagtttacctttacccgtaacttacccttaaccctaaccctgtacccgtaacgtacccgtccgttccgtaccggaccgttaacggttaccggtaaacggttaccggtttaacttttacccgaaacgtttttaaaccgttttaccggttaacctttacggttaaaccttaacggttaaccgtttaaactttaaccgtacccgtttaacccggtacccgggttaccggttacccggaacgggtaccggggtaaaccgtaacgggtaaccggtaacgttaacgaacggtttacgtcgggaccgtacgtaccgaccttcgtaccg

SEQ ID NO: 165920 - DNA, 621 bp, Homo sapiens
  misc_feature: GYAE6OF02GU00X.15.67.G01.1.454.CMB.1.raw
  modified_base (261)..(261): a, c, t, g, unknown or other
  misc_feature (261)..(261): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagacgtcaccatcacttgccgggcaagtcaggacattagaactgacttaggttaggtntcagcaagaaacgtcccgggaaagaccccgtaagcttccgtgatctggtcgctgcatcctacttaacgaagtcgggtccatcaagttcagcggcaggtggactcgtggacacgtacgttattcgacctcgtaccacctatacaggacacgcccgtagcaccgccttaaggattactttacgaccttaacgtttagttacctgttaacctaacgaacgttactttaaaccgtaaccttttaaccccggacggttaccggttaccgggaccgtaacgggggtaacttaaacggggtaccggtaaagtaacccgtaaacggtaccgttaggttaccggccgttacgacccgtacccgttaacg

SEQ ID NO: 165921 - DNA, 693 bp, Homo sapiens
  misc_feature: GYAE6OF02GKPY0.15.67.G01.1.454.CMB.1.raw
  modified_base (200)..(200): a, c, t, g, unknown or other
  misc_feature (200)..(200): n is a, c, g, or t
  modified_base (223)..(223): a, c, t, g, unknown or other
  misc_feature (223)..(223): n is a, c, g, or t
  modified_base (259)..(259): a, c, t, g, unknown or other
  misc_feature (259)..(259): n is a, c, g, or t
  modified_base (314)..(314): a, c, t, g, unknown or other
  misc_feature (314)..(314): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctcctgtctgcatctgtagganacagagtcacatcacttgccggnaagtcaggacattagaactgacttaggtgtatcagnagtaacgtccgggaaactccccgtaaaggtcttaccgtagaacgttcctggtacncgttgacctaacgttacccgtaacttttaaaccggaaagggtttcccggggtacccctaagttccgaaaaggggttttccaaacggggttccgggacgtaacgggttagggtacgttaccgtacgggtacctaaccgtaggttaaccttttccaaacccgtttcgaacctaacctacgttaccgaggtaccaaggtccctagccgtaaacgccttaagaaccgttagtttaccgattaaactttacttaccgtgttaaccctaacgtacgtacttaaacctaccgttaacccgtaggtacccgttacgaccggtaacgggtaaccgtaaggtacggtaaactacgtaacgtactcggtacggactcggtacaacgttcc

SEQ ID NO: 165922 - DNA, 622 bp, Homo sapiens
  misc_feature: GYAE6OF02IJY9T.15.67.G01.1.454.CMB.1.raw
  modified_base (221)..(221): a, c, t, g, unknown or other
  misc_feature (221)..(221): n is a, c, g, or t
  modified_base (351)..(351): a, c, t, g, unknown or other
  misc_feature (351)..(351): n is a, c, g, or t
  modified_base (394)..(394): a, c, t, g, unknown or other
  misc_feature (394)..(394): n is a, c, g, or t
tcagtctacgtagccacgaccggtgctcgatttagagtatacatattgggtttgggggcaggagtcagaccactcagtacacagcatggacatgagggtcccgctcagctcctggggctctgctgctctggctcccaggtgccagatgtcgccatccagatgacccagtctccatcctcctgtctgcatctgtagacacagagtcacatcacttgccgganagtcaggactagttagaactgacgttaggttggtatcagcaagaagtccggaaagcccctaagctcgtacgatctagtgctgctagtcctacttaacgaagtcgggtcccagtactaggtcaggcgacgngtagatcgtggacacgagtactttcactctacgacagtcgtanccgacggtcctgacctcgtcctaggtaacgttcgtttaccggaacttaacgtttacgtttacctacggttacctaaacgtaacggttaccttttaaaccgtaacccgtttacccggtacgggttaaccgttccgggtaccgggtaaccgggggtaccctaaagggtaccggtaaactaccggtaaaaccgtacgttcggtagacccgtaggtaccccaaccgttaccg

SEQ ID NO: 165923 - DNA, 546 bp, Homo sapiens
  misc_feature: GYAE6OF02G9X9R.15.67.G01.1.454.CMB.1.raw
  modified_base (363)..(363): a, c, t, g, unknown or other
  misc_feature (363)..(363): n is a, c, g, or t
  modified_base (393)..(393): a, c, t, g, unknown or other
  misc_feature (393)..(393): n is a, c, g, or t
  modified_base (398)..(398): a, c, t, g, unknown or other
  misc_feature (398)..(398): n is a, c, g, or t
  modified_base (408)..(408): a, c, t, g, unknown or other
  misc_feature (408)..(408): n is a, c, g, or t
  modified_base (411)..(412): a, c, t, g, unknown or other
  misc_feature (411)..(412): n is a, c, g, or t
  modified_base (419)..(419): a, c, t, g, unknown or other
  misc_feature (419)..(419): n is a, c, g, or t
  modified_base (529)..(529): a, c, t, g, unknown or other
  misc_feature (529)..(529): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtccaccatcacttgccgggcaagtcaggacattagaactgtacttaggttggtatcagcaagaaacgtacccgggaaacgacccctaagcctacctgactctgtgctgcactacctaactttaacgaaggtcggtccatacgaaggttcaggcggnagtgatcgtaggcacgtagtacttcactcncacancagcacgccngcnnctagatnttcactattatactgtacaagatacttaacctactaccgtacggtacgtccggacggtaacgggaaccgtaaggtaacgtaaactaacgaaaccgtaacgttggacggtntaccggtacaccgtacg

SEQ ID NO: 165924 - DNA, 622 bp, Homo sapiens
  misc_feature: GYAE6OF02GB8RA.15.67.G01.1.454.CMB.1.raw
  modified_base (280)..(280): a, c, t, g, unknown or other
  misc_feature (280)..(280): n is a, c, g, or t
  modified_base (359)..(359): a, c, t, g, unknown or other
  misc_feature (359)..(359): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctcctgtctgcatctgtaggagacagagtcaccatcacttggccgggcaagtcaggacattagaactgacttaggttggtatcagcagaaactccgggaaancccctaaagcctcctgattctgtgctgcatccatttaacaaaggtcgggtaccagtcaaggttcagcggcagtgatcgnggcacagtatttccacttctaccacctatcgagccacgcctgcacgtccgtagaactactttcgacttaaacttttatacttgttacctaacgaagttaattaacctaaacgtttaccccgtacggttaccggttaccggaccggtaacgggggtaaccgtaaaggggttaaccggtaaaaaccgttaacccggtaaaaaccggtaaaccggttacgggttaacgggtacccgtttacggtacccgtaccccgtttaaaccgg

SEQ ID NO: 165925 - DNA, 668 bp, Homo sapiens
  misc_feature: GYAE6OF02HFTLM.15.67.G01.1.454.CMB.1.raw
  modified_base (228)..(228): a, c, t, g, unknown or other
  misc_feature (228)..(228): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtccaccatcacttcggccggnaagtcaggacattagactgacttaggtgtatcagcaagaaacgtccggaaactcccctaagcttccaggactctgtcgcttgacactacctaactttaacgaaaacgttcggggtacccaagtacgtaaggttccgaggccggtactagggttacgggacttcgtaggtaccaacgtagttactttacaccgttctaccaacctctaacacgcgaacgtccgtacgactacggtccgtaagtaacgttacttaccgaacttaaacgtttacttaccgtattaaccgaagttaacgttaacctttaaccgtaaaccgtttaccccggtacggttaaccggttacccggaccggtaaccggggtaacgtaaacgggttaacggtaaaacttaaccggtaaacgtacggttagtaccggtactaccgtacctacccgttaacg

SEQ ID NO: 165926 - DNA, 808 bp, Homo sapiens
  misc_feature: GYAE6OF02JTFUU.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctcggggctcctgctgctctgggcctcccaggtgccagtatgttcgacccatccaggatcggaccccaggttcctcccatccccttccctggttcctgccattcgtaggtacgggacaacaggatccaaccatccacgttccggacccggggactaaaggtccaagggtaacctaagttaccgaacttacgtacggtttacggttgtaagttccaaggaaccgtaaggtaaaccgtaccggggaaacctaccccgtaacggcctaccgtagacgttccgtggtcgtaccgtgacctactaccttaacttaccggtaaacggtcgggtaacccagtaccggtaacggttacgacggtacgtcggtaaggtggacttaccggtcggaccaagtcgttacctttacgacctaccgtacctaacacgttaccgacgtaacccggacgtcccggtacgaccgttaccgtacggttaacgtaccgttacgggttacctaacctttaacctttaacgttaccgttaccgttaacgtaaaccgttaacgttaaacctttaacccggtaaccctttaacccgggtacccggggttaccgttaccgggtaaccgggtaggggaaacccgttagggtaaaccgaaaggtttaacccgaaacggtaacggttaccggtaggtaccccgtaagtaccccgaattaccg

SEQ ID NO: 165927 - DNA, 591 bp, Homo sapiens
  misc_feature: GYAE6OF02FU8D2.15.67.G01.1.454.CMB.1.raw
  modified_base (201)..(201): a, c, t, g, unknown or other
  misc_feature (201)..(201): n is a, c, g, or t
  modified_base (227)..(227): a, c, t, g, unknown or other
  misc_feature (227)..(227): n is a, c, g, or t
  modified_base (340)..(340): a, c, t, g, unknown or other
  misc_feature (340)..(340): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtagganacagagtcaccatcacttggccgggnaagtcaggacattagaactgacttaggtggtatcagcagaatccgggaaagcccctaaagctcctgactctgtgctgcatccactttacaagtgggtccatcaagttcagcgnagtggatctggcacagtactttacgactctacaccatacagccagccctgacgacgccctaggtaacagttttaccggaccttaaactttacttaacgttcggttactaaacgtaacgtatttaaaccaacgtttaacccgtacgggtaccgttaccggaccgaacggggtaacccgtaacggggtaacgtaaaccgttaaccgtaaacccggtaacgttcgtacgggtacctcggtaccaccgttaaccg

SEQ ID NO: 165928 - DNA, 672 bp, Homo sapiens
  misc_feature: GYAE6OF02GMHNJ.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatcgacccagtctccatcctccctgtctgcatctgtaggagacagagtaccaccatcacttcggccgggacaagtcaggactattagaactgtacgttaggttaggtaatcagacaagaaacgtaccgggaaacgacccctaagccttaccgtagtactcgtgtcgctagacacttacctaactttaacgaaagggtccgggtaccagttacgaaaggttccgacggacggactaggtacggattcggaggaccaacgtaagttactttaccaaccgttcctacctaacctactaccgtacgacgacgtccctagaccgacgtaccgttaagtaacgttacgtttaccgtaactttaaacgttactttaccgttacgttaacgtaactaaacgttaactttaaaccgttaacctttaacccggtacgggtaccggttacggaccggtaacggggaaccgtaaggtaaccgtaaacgtaacgaacgtacgtacggtcgactgacccactacg

SEQ ID NO: 165929 - DNA, 704 bp, Homo sapiens
  misc_feature: GYAE6OF02GQ1XJ.15.67.G01.1.454.CMB.1.raw
  modified_base (224)..(224): a, c, t, g, unknown or other
  misc_feature (224)..(224): n is a, c, g, or t
  modified_base (234)..(234): a, c, t, g, unknown or other
  misc_feature (234)..(234): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagatcaccatcactgccgganaagtcagganattagaactgacttaggttgtatcagcaagaagtaccgggaaacgcccctaaagccgtacctgtataccgtgtcgtctgcaactctaaccgttttaacgaaacggttcgggtaccctagtaacgtaacgggttacaaggccgtacgtaaggtacgtactcgtacgggactacgtaagtactttacctaactccgtctaaccgtataccacgtacagtcccgtgcctacggtaccttaagaaacgttacttacctaaccgtttaacttttaacttaccgtttacgaacctttaaacgaacttaaaccgttttaaacccaaactttacccggttaaccgggtaccggtttacccgggaacggttaaccggggtaaaccggtaaagggttaacgggtaaaaccgttaacgtaaaaccggtaaaccgttacgggttaaaccggtcccggtacgtaacccggttaactaacccgg

SEQ ID NO: 165930 - DNA, 808 bp, Homo sapiens
  misc_feature: GYAE6OF02IKTOF.15.67.G01.1.454.CMB.1.raw
tcagtctacgtagccacgaccggtgctcgatttagagtatacatattgggtttggggggcaggagtcagacccactcagtacacagcatggacatgagggtcccgctcagctcctggggctcctgctgctctggctcccaggtgccagatgtgccatccagatcgcccaaaaaaaaaaaacgtctcctactcctcctgtctgcatcgtggtaggagacgagacgtaccacactactacgttcggaccgggacgaagtacgacggactaagttaacgtaacgttacgtaacgttagggttaggtagtacgtagacgaagaaacgtaccgggaaacgtaccccgtaacgtaccgttaccgtagtacgtcgtacgtcgtcgtcgtacctactaccgtaacttaacgtaacgggtacgggtaccgtacgtacgtaacggttacgacggacggcgtacggtaggtacgtacggtcggacgacgtacggttacttttaccgacttcccgtaaccaacccgtattaccgaagtccgacgtcccgttggacccgttaacggtacccgttaggtaaaccgtttacgtttaccgaacctttaaaaccgttttacgtttaaccgtttacgttacccgttaaacgtaaacgtttaaaccgttttaaaccctaaacgttttacccccggtcggggtttaaccgggttcccgggaacccgggtaacgggggtaaacccgttaacggggtaacggtaaaccgttaaaccgaaaccggttaccgtagggttccggtaaccgttccggtaccaaccgtttaacgg

SEQ ID NO: 165931 - DNA, 796 bp, Homo sapiens
  misc_feature: GYAE6OF02JO958.15.67.G01.1.454.CMB.1.raw
  modified_base (200)..(200): a, c, t, g, unknown or other
  misc_feature (200)..(200): n is a, c, g, or t
  modified_base (235)..(235): a, c, t, g, unknown or other
  misc_feature (235)..(235): n is a, c, g, or t
tcagtctacgtagccacgaccggtgctcgatttagagtatacatattgggtttgggggcaggagtcagacccactcagtacacagcatggacatgagggtcccgctcagctcctggggctcctgctgctctggctcccaggtgccagagtgtgccatccagatcgaccctagtcctccatccctccctgtcctgcattcngtaggacacagagtcacgaatcacgttcgccgggntaacgtcgaacggactagttaacgacgtacgtacgttagggttagtactactaggtacaaggtaaacggtaccggggaaaaccgtaccccgttaaaggccgttaccccgtaagtacttccgtacggttacgctcggtacctacttaccttaaccggtttaaacgaaacgggttccggggtaaccttacgtaaccgttaacgggttaccaagggcggtacgtaggtcgaacgttcgtaggacaccgtagttacttcgtaccttcacctaactacgtacgaacgtaccgagtcccgtagaccaacggtttaccgtaacggtaacggtttaccgtttaaccgtaccggttttaaacctttacggttttaaacctcggtttaacctaaaccggtacttttaaaacttacccgtttaaaaacccggtttccgtaacgggttaacccgggtttaccggaaccgggggaaccggttaaacccgggtaaggtaacggtttaaaaccgggacctaaaacggttaacccggttggtaaccggttcgtaacccggtcttaacccgtaaccgg

SEQ ID NO: 165932 - DNA, 676 bp, Homo sapiens
  misc_feature: GYAE6OF02GBHOP.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatccctccctgtctgcatctgtaggagacagagtcaccatcacgttgccggcaagtcaggactagttagaactgtacgtttaggttagtatcgagacaaggtaaacgtaccgggaaacgacccctaagcctaccgtcgtactctagtcgctgactactacctaactttaacgaaacgggttccgggtaccctagtacgtaacggttacgacggtcggacgtaggtaggtacgttcgtaggacaacgtacgttactttaccgaccttccgtaccaacctactcaacgtcgtacgccgtcgacgtacgtaccgttaaggtaacgttcgtttaccgaactttaacgtttaacttacgttacgttaactaaacgtaacgttaactttaaccgtaaaccgtttaccccgacggttacccgttcggaacccggtaacgggtaaccggtaaggtaacgtaaacgtaacgtaacgtacggtcggtaccgtacgtacgtacctacctacg

SEQ ID NO: 165933 - DNA, 563 bp, Homo sapiens
  misc_feature: GYAE6OF02FVAHB.15.67.G01.1.454.CMB.1.raw
  modified_base (229)..(229): a, c, t, g, unknown or other
  misc_feature (229)..(229): n is a, c, g, or t
  modified_base (281)..(281): a, c, t, g, unknown or other
  misc_feature (281)..(281): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctcctgtctgcatctggtaggagacagagtccaccatcacgttgccggganaaggtcaggacattagaactgacttaggtggtatcagcagaatccgggaaancccctaagcctcctgatcgtgtgctgcatcctatttacaaggtcgggtccagtcgaagttcagcgcagtgatgtggacacagtatttcactctcactatcagcacgcctgcacgccttaggaagttcgttccgacttaaacgtttatacgttagtcctaaagaagttacttaaccgtaacgtttacccgtacgggtaccgtttcggaccgtaacggggtaaccctaagggtacggaaacttacgaaacgtacgttcggtacggtctacgtaccacgttaccg

SEQ ID NO: 165934 - DNA, 765 bp, Homo sapiens
  misc_feature: GYAE6OF02JC0UQ.15.67.G01.1.454.CMB.1.raw
  modified_base (479)..(479): a, c, t, g, unknown or other
  misc_feature (479)..(479): n is a, c, g, or t
  modified_base (497)..(497): a, c, t, g, unknown or other
  misc_feature (497)..(497): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtcgccatccagatcgacccagtctccatcctccctgtctgcatcgtgtaggagacagacgtcaccactctacgttcggccgggacaacgtcacggactacttagactgtacgtttaggttgtactcagacaagaaacgtaccgggaaactccccgtaagcctccgtgacttctggtcgctagccgtacttcccgttaaacgtttaacgaacgggttccgggtaccccaagttaccggttaaacgttccggagggtccggacgtaaggtacgacgtccgtaggacctaagtaacgttctttaccgaccttacctaccgaccgtataccngaccgtacgtccggtacncggtaacgtcccgttaagtaaccgttacgttacccgtaacgtttaaccgtttaacgtttaaccgtttcgtaaccgtttaaaccgtaacgtttaacctttaaaccgtaaacccgttttacccggaaccggggtttacccgggttacccggaaccggggtaacggggtaaaccgggttaaacgggaaacccggttaaacgttaaccgggtaaacccggttagttaaccggggttaccggacgttacccgggtaaccctaccggtaacccg

SEQ ID NO: 165935 - DNA, 695 bp, Homo sapiens
  misc_feature: GYAE6OF02GHIU9.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttggccgggacagtcaggacattagaactgactaggttgatcagcaagaaagtaccggaaacgccctaagcctcctgactctcggtgtctgcaactccctaactttaacgaaagggttcggggtacccctaatcgtaaacggttcgaaggccggtctaggtcggtactcggttcggccaacgtagtatttccgacctaccttacccaactactacagtaccgaaggccctacgacctacgtcccttaggaaagtttacgtttactaccgttaaacctttttaacgttaccgttaccgttaacttaaaccgtaaaggttaaccttttaaaccctaaaccgttttaacccccggtacgggttaccccggtttaccggggaccgtaaaccggggggtaacccgaaaggggttaacgggtaaaactaacccggtaaaaccgtaacggttggtacggtaccgtaccggaccgtaccttaaccg

SEQ ID NO: 165936 - DNA, 715 bp, Homo sapiens
  misc_feature: GYAE6OF02IB02H.15.67.G01.1.454.CMB.1.raw
  modified_base (291)..(291): a, c, t, g, unknown or other
  misc_feature (291)..(291): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatcgacccagtctccatcctcctgtctgcatctgtagagacagagtccaccatcacttcggaccgggcaagtcaaggactattagaactgtacgttaggtggtatcgtagcaggaaagtaccggggaaanccccgtaaagtccttccgtagtactcgtgtcgactgctactacccgtactttaacgaaacggttcgggtaccctacgttacgaaacggttcgacgtcggcgtaacggtcgggtaatcggtacggaccaagtacggttactttcaccgttcctaaccgaacctacgtacaacgtaccacggtacctggaccgtacgtaccgtaagtaacggttaatttcccggaactttaaaccgttttaacgttaaccgtttacgtaaccgtaaacgtaacgttaaacgtttaaacccgtaaacgtttaccccgtacgggttacggttacccgggtacccgggtaacggggtaaacccgtaagggttaaccgggaaaccgttaacgtaaacccggacgttaccggtacgggtactacggtacccacgttaacgg

SEQ ID NO: 165937 - DNA, 686 bp, Homo sapiens
  misc_feature: GYAE6OF02FMYNT.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcactgccgggcaagtcaggacattagaactgacttaggttgtatcagcagaatccgggaagcccctaagctcctgatctgtgctgcactacctaactttacgaaaggtcgggtacccagtcgaaggttcgagcggcgagtgtactcgtaggctacgtagtactttaccgactcctccaacctattaccgaagtccacgtacccgttcggccgtaaccggtacccgttaggtaaacgtttaacgttttacccgaaccgtttaaacttttaccgtttaacgtttccgtttaaccgttaaacctaaacggttaaacctttaaaccttaaaccgtttaaaccccgttaccgggttaacccggtttccgggacccgggtaacgggggtaaaccctaacgggggttaaacggttaaaccgtaacgtaaaccggtaaccgttagggtccgggtacgtaaccggtccgtaaccgttaccg

SEQ ID NO: 165938 - DNA, 633 bp, Homo sapiens
  misc_feature: GYAE6OF02GH4T2.15.67.G01.1.454.CMB.1.raw
  modified_base (263)..(263): a, c, t, g, unknown or other
  misc_feature (263)..(263): n is a, c, g, or t
  modified_base (300)..(300): a, c, t, g, unknown or other
  misc_feature (300)..(300): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctcctgtctgcatctgtaggagacagacgtcaccatcacttcgccggactaacgtcgagacattagactgattaggtgtatcgancagaacgtaccggaacgccctagctcgtgactctgtnctcgctactcctaactttaacgtaacggtcgggtacctatacgtacggttcgacgcggtcgagtaggacttcgacggactacgtacgtactttacctaccgtcctacctacctataccgacgtccgaacgtcccgtcggacacggtaccttaggaacttcgttacgacttaactttacttacgttacttacgtaacgtaacgttactttaaccgtaaccgtttacccgttcggggtaaccgttccgggtaccggtaccggggtaaaaccgttaacgggtaacgtaaagtacccgaaaaggtacgttaggtcgtaccgtacgacctagtacccg

SEQ ID NO: 165939 - DNA, 693 bp, Homo sapiens
  misc_feature: GYAE6OF02FPITC.15.67.G01.1.454.CMB.1.raw
  modified_base (205)..(205): a, c, t, g, unknown or other
  misc_feature (205)..(205): n is a, c, g, or t
  modified_base (224)..(224): a, c, t, g, unknown or other
  misc_feature (224)..(224): n is a, c, g, or t
  modified_base (285)..(285): a, c, t, g, unknown or other
  misc_feature (285)..(285): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctcctgtctgcatctgtaggagacagngtcaccatcactgccgggnaagtcaggactattagaactgtacttaggttagtatcagacaagaaacgtaccgggaaacnccccgtaaagcctcctagtactctagtcgctgacctacttaccgtaacttttaaccgaaagggttaccggggttaccctaagtaccggtaaacggtttccgacgggacgggtacgtagggttacggaactttccgtcgggacctaacgaacgttacctttttacgaccctttcctaccaacctacgttacgaacgccgtacggtcccctaggaccgaacgttcccgtaaggtaacgttaactttccgaaccgttaaacttttacgttaacgttacgtaacttaacgtaagttaaccgttaaactaaccgttaccccggtacgggtaccgttaccggacgaaccggggtaacgtaacgggttataaacgtaccgaaacgtacgttggtacgtacgtgtaccacgttacg

SEQ ID NO: 165940 - DNA, 564 bp, Homo sapiens
  misc_feature: GYAE6OF02FRMEZ.15.67.G01.1.454.CMB.1.raw
  modified_base (348)..(348): a, c, t, g, unknown or other
  misc_feature (348)..(348): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttgtatcagcaagaaacgtaccggaaacgcccctaagctccgtgatctgtgctgctatcctattacgaaagtcgggtaccatacgaagtcagcgnagtgactgtgacacagtactttcactctcacctatcagcacgtccagcacgacctagaacgtactttacgacttaactttattacctagtacctaacaactaacttaacctaacttacccgtacggtaccgttccggaccggtaacggggaaccaacgggttagtaaacgtacgaaaaccggtacgttggtaggtacctacggtaccaaccgtacg

SEQ ID NO: 165941 - DNA, 716 bp, Homo sapiens
  misc_feature: GYAE6OF02H77FL.15.67.G01.1.454.CMB.1.raw
  modified_base (435)..(435): a, c, t, g, unknown or other
  misc_feature (435)..(435): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctcccatccctcctgtctgcatctgtaggagacagagtccaccatcacttgccgggcaaggtcaggacattagactagtacgttaggttaggtatcaggacagaaagtaccgggaaacgcccctaaggcctacctgatctgtgctgcatcctacttacgaaaggtcgggtaccatacgtaaggttcgagtcggacgagtggtatacgtgggacctaacgtaggtacctttcaaccttctaccctaacctaagttaccgacgacnccggtaccctcggtaacgccggtaccctaaggtaacggttctttaccgaaaccttaaccttttaacgtttaaccgtcgttaaaccgttaaaccgtaaagtttaaccgttaaaccttaaacccgtttaaacccgttccgggtaacccggttttaccgggaaccccgggaaacgggggttaacccgggtaaaggggttaaaccggtaaaaccgttaaaccggtaaaccggtaaccggttagggtttacccgggtaccgtacggtacccccgtatttaacccgg

SEQ ID NO: 165942 - DNA, 730 bp, Homo sapiens
  misc_feature: GYAE6OF02JQVBB.15.67.G01.1.454.CMB.1.raw
  modified_base (144)..(144): a, c, t, g, unknown or other
  misc_feature (144)..(144): n is a, c, g, or t
  modified_base (173)..(173): a, c, t, g, unknown or other
  misc_feature (173)..(173): n is a, c, g, or t
  modified_base (211)..(211): a, c, t, g, unknown or other
  misc_feature (211)..(211): n is a, c, g, or t
  modified_base (242)..(242): a, c, t, g, unknown or other
  misc_feature (242)..(242): n is a, c, g, or t
  modified_base (306)..(306): a, c, t, g, unknown or other
  misc_feature (306)..(306): n is a, c, g, or t
  modified_base (618)..(618): a, c, t, g, unknown or other
  misc_feature (618)..(618): n is a, c, g, or t
tcagtctacgtagccacgaccggtgctcgatttagagtatacatattgggtttgggggcaggagtcagacccactcagtacacagcatggacatgagggtccccgctcagctcctgggctcctgctgctctggcctcccaggtnccagatcgtgaccatccagatcgaacccngtcctccatcctccctgctacgctagtctggtaagganacaggactcaccatccacgttcggacccggntaagcgaagtacattagactgtaacttaggttgactcagtacaacgaaacgaccgggtaaaccncccgtaaagtcctacccgttagcttaccgttagtcgccttgacttaccgtaccttaaccgtttaacaacgggttcgaaccctagttaacgaaacggttcaccggaggtacgtagggtacgtacgtcccggtaggaaaccttacgggtaattccttttaacctaaccgtcccggtacttaaccacgtaaacgtccgaaccgttcgtacccgtgtcgtaacgccgtaggtaaccttcggtttacaacttacgttttaactcgtaactacgttaaacgtaccgttaaaccgtttacaaaccctttaaacccgggngtttaaccccggtccgaaccgggttacggtaaaccgggtaagtaacccgggtaaaccttaacggtaaccgttaacgggtcttaccgtacgggtacctaacccgttccgtaag

SEQ ID NO: 165943 - DNA, 778 bp, Homo sapiens
  misc_feature: GYAE6OF02H0ITC.15.67.G01.1.454.CMB.1.raw
  modified_base (207)..(207): a, c, t, g, unknown or other
  misc_feature (207)..(207): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccgaggtgccagatgtgccatccagatcgaccctagtcctccatccctcctgtctgctatcgtgtagganacagacgtccactatcctacgttcggaccgggactaacggtcgaacggtactaacgtttaacgaacgttacggttaaaccggttttaggggtttaggtaacttaccgaaggtaaccgtaaacggtaaaaccggttaaccccgggggaaaccgtaccccccgttaagtcccgttaccgtaggtacttcgtacggtcgtaccgtcgtactacttacccgtaacgtttaacggaacggttcggtaccctaataccggtaaggtcgacggcgtagtaggtcggtactcgtacggtacctagtacgttccttacgaccttcctaccgaactacgtagaccgacgtcgcgtagaccgtcgtacgtagtaaacgttcgttaccgaactttaacgttacctttagtacgttaacgtaaactaacgtttaaccttaccgttaaaccgttcccggttaacggtacccggttaccgggtaacgggtaccgggtaaaccggttaaacgggtaacgttaaacccgtaaaccggtaaccggttacgttacgggtacccgtacggtaccgtacctaccgtttaccg

SEQ ID NO: 165944 - DNA, 713 bp, Homo sapiens
  misc_feature: GYAE6OF02JHF3C.15.67.G01.1.454.CMB.1.raw
  modified_base (543)..(543): a, c, t, g, unknown or other
  misc_feature (543)..(543): n is a, c, g, or t
tcagtctacgtagccacgaccggtgctcgatttagagtatacatattgggtttgggggcgaggaggtcagacccactcagtacacagcatggacatgagggtcccgctcagctcctgggctcctgctgctctggctccaggtcgccagatgtgccatccagatcgaccctagtctccatcctcctgtctgcatcgtgtaggacgacaggctcaccagtccacgttacggccgggacaagtcgaagggactaagttaacggtaacctaggaaccgtttagggttacggtaacgttcgagacgaaacggtaaacgtaacccggggaaaaccgtaccccggtaaaggtcccttaccgtacgtaccgttacggtgttaccgtacgtacgtctacttaacctaaccgtttaaaccgtaaacggtccggggtaccctacgtaaccgtaacgggtacgtacggacggtacgtaggtacgggtaacttcggacggtacgaacctagttacttactaaccgttctaccgtactacgtcgaacgcacgtaccngaacgtcgtcctaaggtaacgtcttacgacttaactacgtttctaacgtactaaacgtagtacttaaactaccttaaccggacgttaccggtaccgtacggaacgggtaacggttaacggaacgtaaacgtacgaaccgtagttacggacgtagtaccgagtcctaacgg

SEQ ID NO: 165945 - DNA, 560 bp, Homo sapiens
  misc_feature: GYAE6OF02F1GWO.15.67.G01.1.454.CMB.1.raw
  modified_base (281)..(281): a, c, t, g, unknown or other
  misc_feature (281)..(281): n is a, c, g, or t
  modified_base (419)..(419): a, c, t, g, unknown or other
  misc_feature (419)..(419): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctacctgtcctgcatctgtaggagaaagagtcaccatcacttggccgggcaagtcaggacattagaactgacttaggttggtatcagcagaaatccgggaaancccctaagctcctgatctgtgctgcactccacttttacaaagtggggtacccatcaaggttcagcggcaggtggatcgtggcaactagatttccactctcgacccattcacgccaggcctggccaggcctagaacgtntttcgactaacttattactgtactacaagtactttaactaacttaacccgtggaaccgtttcggaccgacggggtaccgtaacgggtacggaaactacgaaacccgtaagtcggtacggtcgtacggccctaccgattacg

SEQ ID NO: 165946 - DNA, 694 bp, Homo sapiens
  misc_feature: GYAE6OF02GKUGK.15.67.G01.1.454.CMB.1.raw
  modified_base (288)..(288): a, c, t, g, unknown or other
  misc_feature (288)..(288): n is a, c, g, or t
tcagtctacgtagccacgaccggtgctcgatttagagtatacatattgggtttgggggcaggagtcggacccactcagtacacagcatggacatgagggtccccgctcagctcctggggctcctgctgctctgactcccaggtgccagatgtgccatccagatgacccagtctccatcctccctgtctgcatctggtaggagacagacgtcaccatcacttggccgggacaagtcaggactatagactgtacttaggttggtatcagcaagaaacgtaccgggaaacnccccgtaagcctcctgatcgtgtgctcgcactcctaactttaacgaacggttcggggtaccctatacgaacggtttcacggtcgggacgtacggtggtacttcgtcggacgtaacgtaacgtactttaccgtaccttccctaccgtaacctaacgtaccgtacaccggtaccgccgttacggaccacggtacccgtaaggtaaacgttaccttttaccgacctttaaacgttttactttaccgttagttaccctaaacgtaacgttaacgttaaccgttaaacctttacccggtacggttaccggttccggaccggtaaccggggtaacggtaaacgggtaacggtaaactaaccggtaaaccgtacgtacggtacggtaccgtaccgacctaccgtagttacccg

SEQ ID NO: 165947 - DNA, 829 bp, Homo sapiens
  misc_feature: GYAE6OF02H4OOV.15.67.G01.1.454.CMB.1.raw
  modified_base (361)..(361): a, c, t, g, unknown or other
  misc_feature (361)..(361): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggcctcccaggtgccagatgtgccatccagactgacccagtctccactcctccctgtctgcatctgtaggagacagacgtaccaccatccacgttcggaccgggacaagtcgaggacagttagaactcgtaacgttaggtttaggtactacgagacaaggtaaacgtaccgggaaaacgtacccccgtaaaggtccttaccgtagtacttcgttacgtcggtctgaccnctttacctaaccgtttaacgtaaaacgggttccggggtaccctaagtacgtaaggttacgacggtacggacgtaggtcggtacgttacgtggtaccacgtaacgttacttttaccaccttacaccgtaacctacttacgacgtaccgtaccgccgttacgaccgtacgtaccgttaaggaacgtttacgttaccgtaaaccgttaacgttttaaccgttaaccgtttaccgtaaaccgttaacggttaaaacgtttaaccgtttaaaaccctttaaacccggtttaaaccccggtttacccgggggtttaacccggggttttaccccgggaaccccgggggttaacggggtaaaacccgggttaaacgggggtttaaaccggtaaaacggttaacccggtaaaaaccgggttaccgttaccggggttaacccgggttccgtaaccggtacccctaccgttaaacccgg

SEQ ID NO: 165948 - DNA, 931 bp, Homo sapiens
  misc_feature: GYAE6OF02JM9MI.15.67.G01.1.454.CMB.1.raw
  modified_base (156)..(156): a, c, t, g, unknown or other
  misc_feature (156)..(156): n is a, c, g, or t
  modified_base (170)..(170): a, c, t, g, unknown or other
  misc_feature (170)..(170): n is a, c, g, or t
  modified_base (174)..(174): a, c, t, g, unknown or other
  misc_feature (174)..(174): n is a, c, g, or t
tcagtctacgtagccacgaccggtgctcgatttagagtatacatattggtttgggggcaggagtcagacccactcagtacacagcatggacatgagggtccccgctcagctcctggggctcctgctgctctggctcccaggtgccagatgtgaccntccagatgaacccngtcnccatccctcccgtgtctagcctagtcctggtaacgggactacgagtacgtcaacctagtcctaccgtggcccgggactaaacggtccgtaaggacctaacgtttaacggaaacctgtaacgtttaggttacggtataccgtagacgaagtaaacgtaccgggaaaccgtacccctaaaggccttaccgtataccgttcgtaccggtacggttacgtagacccgttacctaaccgttttaaccgtaaaaccggggttacgggttacccgggtaacccttaacgggttaaccttaacgggttaaccggtaaccggtaccgggtaacgtaacggggttactttaaccggtaacggttaccggtaaccgtaacgttaaccgtttaccgttaacccttaccgtaacccgtttaaacccgtaaccgttaaacgtacccggttaaacgaccggtttaacccggaaccgtttcccggaacgttacccggtttaaacgtaaacccgtttaacggtttaaccccggtttacttaaaacccgggtttaaacctttaacccgggtttaccgttaaccgtttaaacgtaaaccgtttaaacctaaaccgttttaaccgtttaaaccccgtaacccgggtttacgggttaaacccggtccggttaacgggtaaacccgggttaacgggtaaccggttaaaacggtaaaccgttaaccggaaacgttcgggtaaccgttacggacccgttacgtaacccgcgtttaacccgg

SEQ ID NO: 165949 - DNA, 720 bp, Homo sapiens
  misc_feature: GYAE6OF02JFN57.15.67.G01.1.454.CMB.1.raw
  modified_base (238)..(238): a, c, t, g, unknown or other
  misc_feature (238)..(238): n is a, c, g, or t
  modified_base (332)..(332): a, c, t, g, unknown or other
  misc_feature (332)..(332): n is a, c, g, or t
tcagtctacgtagccacgaccggtgctcgatttagagtatacatattgggtttgggggcaggagtcagacccactcagtacacagcatggacatgagggtcccgctcagctcctgggctcctgctgctctggctcccaggtcgccagatgtgccatccagatgacccagtctcactcctcctgtctgcatcgtgtaggagacaggacgtaccaccatctacgttcgggacccgggtanaacgtcgaaggtactaagtttagaaccttggtaacgtttaggttggtaatccgagcaacggtaaacgtaccggaaaccgccctaagccttccgntacgtctggctcgtgctactcgttaaactttacggtaaggtccggtacctagtacgtaaggtcgaacgcggtacgtaggtgtactacggtacggaccgtactaagttaccttccaacctccgtaacaacctacttagacggctaacgtcacggtcctaacgtacggtacgtaagttaccttacgtaacgttaaattttaccgtacgtttaacgtaaccctaaaggtaaccttaagtttaaaacccgtcccgttaacccggttaacggttaaccggtcccgggttaaggggtaacccggaaacgggtaacgttaaacgggtaaacgttaaaccgtaaccggttaacggtccggttaacggggtccgaaccgttacccgtacgttaaccg

SEQ ID NO: 165950 - DNA, 758 bp, Homo sapiens
  misc_feature: GYAE6OF02IV869.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatcgacccagtctccatcctcctgtctgcatctgtaggagacagagtcaccatcacttggccggcaagtcaggacattagaacgtgtacttaggttggtactcagcaagaaacgtaccgggaaacgacccctaagcctccgtgacttctggtcgctcgactacttaccctaacgtttaacgaaacgggttcggggtaccctatacgtaaacggttcaggccggtacgaggttcggacgttcggtaggacctaacgtaacggttacttttacgaccctttactacccgaaccctaacgtccgaacgtacccgaacgtcccgtacgaccgtaacgtacccgttaagtaaacggttaaccgttttcccggaacctttaaaccgttttaacgtttaaccgtttaggtttaaccttaaaccgtaaacgtttaaccttttaaaaccgttaaacccgttttaaccccgttaccgggttacccggtttacccgggaacccggtaaacgggggttaacccgtaaaacggggttaacggtaaaacgttaacccgaaaaccggttaacgttcgggttacggtaccgtacgtaccgtaacccttaacgg

SEQ ID NO: 165951 - DNA, 732 bp, Homo sapiens
  misc_feature: GYAE6OF02F1PM0.15.67.G01.1.454.CMB.1.raw
tcagtctacgtagccacgaccggtgctcgatttagagtatacatattgggtttgggggcaggagtcagacccactcagtacacagcatggacatgagggtcccgctcagctcctggggctcctgctgctctggctcccaggtgccagatgtgccatccagatgacccagtctccatccctcctgtctgcattcgtgtaggagacagtagtccacctatccacgttcggaccgggactaaagtccaaggacattaagaacctggactttaggttggttaatcgagcaaggtaaacgtaccgggaaactccccgtaaacggccttaccgtagtaacttcgttaggtcgtaccttgacctaactcccttaacgttttaacgaaacggttcggggttacccctagtaccgtaaggtttccgaggtccggtacgtaagggttacgacgttacggttcggactaaccgttagttacgttttaccactacctacgaacctacgtcgtaacgcacgtacctgaccgtagtaccgttaggacgtactttaccgtaaccttaacgttactttaccgttcgttaactaaccgttaaagttaccttaaacttaaccgtttacccggttaccgggttaccgttaccgggacccggtaacggggaaccgttaaacgggttaaacgaaacccggttaactaaaccgggtaccttgggtaccggtactaccggcgttaccctaaccgg

SEQ ID NO: 165952 - DNA, 746 bp, Homo sapiens
  misc_feature: GYAE6OF02I56U7.15.67.G01.1.454.CMB.1.raw
  modified_base (202)..(202): a, c, t, g, unknown or other
  misc_feature (202)..(202): n is a, c, g, or t
  modified_base (205)..(205): a, c, t, g, unknown or other
  misc_feature (205)..(205): n is a, c, g, or t
  modified_base (504)..(504): a, c, t, g, unknown or other
  misc_feature (504)..(504): n is a, c, g, or t
tcagtctacgtagccacgaccggtgctcgatttagagtatacatattgggtttgggggcaggagtcagacccactcagtacacagcatggacatgacgggtccccgctcagctcctggggctcctgctgctctggctccaggtgccagatgtgccatccagatgacccagtctccatccctcctgtctgcatctggtagganacngagtcaccactcacgttcggccgggacaagtcaggactatagtaacgtgtacttaggttggtaatcgacgacaacggaaacgtacccggggaacgtacccccgtaaaggcctccgtacgtacgtccgttagtcgtctacggtacctatacccttaacgtttaccgaaaaggttccggggtaccctatacgtaacggttccgacggaccggtcagggttacgtagtccgttacggactaaccgagttactttacgaccctacgttccaaccgtagtaccgtactcgaacggtccgtaacncggtaacgtccgtaacgtagtactttacccgatttaaaccggttttattacccgttacgttaaccgttaaccgttaaacgttaaccgtttaaaccgttaaaccgtttaaccccggtttaccgggttaacgtttacccggggaaccggttaaccggggaacccgtttaaggtaacggttaaacgttaacgtaaaccgaaccgggtttcgggtaattacccggtacgtacgttaaacccgttcg

SEQ ID NO: 165953 - DNA, 662 bp, Homo sapiens
  misc_feature: GYAE6OF02FSN29.15.67.G01.1.454.CMB.1.raw
  modified_base (225)..(225): a, c, t, g, unknown or other
  misc_feature (225)..(225): n is a, c, g, or t
tcagtctacgtagccacgaccggtgctcgatttagagtatacatattgggtttgggggcaggagtcagacccactcagtacacagcatggacatgagggtccccgctcagctcctgggctcctgctgctctggctcccaggtgccagatgtgccatccagatgacccagtctccatcctcctgtctgcatctgtaggagacagagtcaccatccacttggccggnaagtcaggacattagaactgacttaggttgtatcagcagaagtaccggaaacgcccctaagctcctgactcgtgtcgctgctatcctaacttaacgtaaggtcggggtacctagtacgtaaggttcagtcggacgtaggtgatcgtggactaacgtagtactttctaccgtctccaacctactacgacgtacctaccgcccgtcgaccgtacgacccgttaaggtaacgttacgtttccggaaccttaaacgtttacctttacgttaccgttacttaaacgtaagttaactttaaacgttaaaccctttacccggttacggtacccgggtttaccgggacccggtaacgggtaaccggtaaacgggttaacggtaaacgttaaccgtaaacggtaacgttacgggttacggtaccggtacgaccgtacccgtaaccg

SEQ ID NO: 165954 - DNA, 607 bp, Homo sapiens
  misc_feature: GYAE6OF02GROH0.15.67.G01.1.454.CMB.1.raw
  modified_base (143)..(143): a, c, t, g, unknown or other
  misc_feature (143)..(143): n is a, c, g, or t
  modified_base (203)..(203): a, c, t, g, unknown or other
  misc_feature (203)..(203): n is a, c, g, or t
  modified_base (222)..(222): a, c, t, g, unknown or other
  misc_feature (222)..(222): n is a, c, g, or t
  modified_base (276)..(276): a, c, t, g, unknown or other
  misc_feature (276)..(276): n is a, c, g, or t
  modified_base (354)..(354): a, c, t, g, unknown or other
  misc_feature (354)..(354): n is a, c, g, or t
  modified_base (413)..(413): a, c, t, g, unknown or other
  misc_feature (413)..(413): n is a, c, g, or t
  modified_base (590)..(590): a, c, t, g, unknown or other
  misc_feature (590)..(590): n is a, c, g, or t
tcagtctacgtagccacgaccggtgctcgatttagagtatacatattgggtttggggggcaggagtcagacccactcagtacacagcatggacatgagggtcccgctcagctcctgggctcctgctgctctggctcccaggtnccagatgtgccatcagatgacccagtctccatcctcctgctgcagtctgtaggagacagngtcaccatcacttgccggnaagtcaggacagtagacagacgttagtgtatcagtcaagaacgtccgggaaacnccccgtaagcttcctgactcgcgtgctgcatcctaacgtttaacgaaaggtccggtacctataccgtaaggttcaggngtacgaggttacgacgtcgtggacctaacgagttacttcgaactcgtcaacatacacgnaacgtcgtcgacgtcgtacttagaattacgttacgaacttaatttaactacggttataactaacgtaacgttaaacttaaccgtaacgttaaccgtacgggtacccgtttagggacccggtaacggggtacgtaaacgggaccggttaaataacggtaaacacggttacggacggtnacgtaccgaactaccgg

SEQ ID NO: 165955 - DNA, 705 bp, Homo sapiens
  misc_feature: GYAE6OF02JN4BC.15.67.G01.1.454.CMB.1.raw
  modified_base (233)..(233): a, c, t, g, unknown or other
  misc_feature (233)..(233): n is a, c, g, or t
  modified_base (464)..(464): a, c, t, g, unknown or other
  misc_feature (464)..(464): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatccctcctgtctgcatctgtaggagacagagtccacctatcacgttcggcccggganaacgtcgaaggactaagttaacgactggtaacgtttagggttggtatcgagacgaaggtaaacgtaccggggaaacctaccccgtaagccctaccgtagtaagttccgttggtacgcgttcgacctacgttacccttaacgtttaacggaacgggtccgggtaccctagtacgtaacggttcgacgggtacgacgtaggtacgagttccgtaggactacgagttccttacnctacacgtaaccataccagacctacgcctacgacgtaccgtactaacggtaactccgttaagaccttaaacgttacgtactacgtacgtaaattaacgttaccttaacgtaacccgttaccgtacggttaccggttaccgggaccggtaaccgggtaaccggtaacgggtttaaagtaacccgtaaaccggtaacccggtagttccgggtaccgtacgttaccggaccctaccggttaacg

SEQ ID NO: 165956 - DNA, 751 bp, Homo sapiens
  misc_feature: GYAE6OF02IHXJC.15.67.G01.1.454.CMB.1.raw
tcagtctacgtagccacgaccggtgctcgatttagagtatacatattgggtttgggggcaggagtcagacccactcagtacacagcatggacatgagggtcccgctcagctcctggggctcctgctgctctggctcccaggtgccagatgtgccatccagatcgacccagtcctaccactcctcctgtctgctactcgtaggtaggacacgagtacgtccactatccgtacgttcggaccgggactaagtcgaaggtactagttaacaaccgtgtaacgtttaggttgactacgagacgtaaggaaacgtcccggtaaacgtccccgtaagtccgtccgtaagacttcgtacgtgtcctacggaactacgtaaccttaacgttaacggaaacggttccgggtaaccctaagttacgacggttacgacggtacccgtacggtacgggtacgtaagttcccggtacgggaccctaaagttccgtttaacgtttacccgttaaccgtttacccgtaaccccgaactttaaccgtaccggtagacccgttaccggaccgttcgaaccgttaccgtacgtacgtaacgttacgttaccgactactttacgtacgttcgtacgtaataacgttaccgttaactaaccgttaccggttcgtacggttacccggacggttaaccgggaacggtaacggtaactaaaccggtactaaaccgggttcgtacggttccggacgtacgttaccgaactttcgg

SEQ ID NO: 165957 - DNA, 714 bp, Homo sapiens
  misc_feature: GYAE6OF02H0J1Y.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggcctcccaggtgccagatgtgccatccagatcgacccagtcctccatccctccctgtctgcatctgtaggagacagacgtccaccatctacgttcggccggcaagtcaggactagttaagaactagtacgttaggttgtatcgagacagaaacgtaccgggaaacgtcccctaagcctccgtagtactctgtcgctcgctactacctaactttaacgaacggtcgggtacccagttacgtaagtcgagtcggactaggtcgtactccgtggacctaacgtagttacttttaccacctttacctaccaaccgtacgtacgtaacgaccgtaccgtcccgtcggtaccaaccggtcttaacggtaaactttccgttacgaacccttttaacgtttaacttaccgtacgtttacctaaacggtaactttaacttaacccgttaaaccgttccccgggttaacggttaaccgggttcccgggaacccgggtaacgggaaacccggttaagggtaaacggttaaaaccgaaccgtaaaccggttacgttacggtacccggtaaggtcccgtacgtacccgttaacg

SEQ ID NO: 165958 - DNA, 782 bp, Homo sapiens
  misc_feature: GYAE6OF02G6W0V.15.67.G01.1.454.CMB.1.raw
  modified_base (146)..(146): a, c, t, g, unknown or other
  misc_feature (146)..(146): n is a, c, g, or t
  modified_base (265)..(265): a, c, t, g, unknown or other
  misc_feature (265)..(265): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggcctcccaggtcnccagatgtcgaccatccagatacgaccctagtcctaccattcccctccgtagttcctagacctattcgtaggtaggacaacaggtactaccacctatccgtaaccgtggcccggggaanaacgtcgaacggtaactaagtacgaactgttaacgtttaggtcgtaatcgagaaccgaaggaaacggtaccggaaacctaccctagtcctcgtagactcgttgtcggctgactacttaccgttaacgttaacggaacgggttcggtaccctaagtaccgtaagtcggtacggacgacgtaggtaacgtcgtacgtacgggactaacgtacggtaccttaacgtacccgtaccctacctaaaccgtacgtacccgaacggtacctaaccggtccgtaccggtaaccgtacccgtaccgttaaaggttaaccgtttacccttaccgggtaaacctttaacgtttacgtaaccgtttacgttaacccgtaaacgttaacgttaaacttttaacccgtaccgttaacccgttacccgggtaacgttacccgggacgggttaccgggaaaaccgggttaacgtaacggttaaaccgtaaccgttaacggtacgtacgtacgtaccggtaccacggtactacg

SEQ ID NO: 165959 - DNA, 647 bp, Homo sapiens
  misc_feature: GYAE6OF02H8T6R.15.67.G01.1.454.CMB.1.raw
  modified_base (167)..(167): a, c, t, g, unknown or other
  misc_feature (167)..(167): n is a, c, g, or t
  modified_base (192)..(192): a, c, t, g, unknown or other
  misc_feature (192)..(192): n is a, c, g, or t
  modified_base (199)..(199): a, c, t, g, unknown or other
  misc_feature (199)..(199): n is a, c, g, or t
  modified_base (319)..(319): a, c, t, g, unknown or other
  misc_feature (319)..(319): n is a, c, g, or t
  modified_base (346)..(346): a, c, t, g, unknown or other
  misc_feature (346)..(346): n is a, c, g, or t
  modified_base (466)..(466): a, c, t, g, unknown or other
  misc_feature (466)..(466): n is a, c, g, or t
  modified_base (475)..(475): a, c, t, g, unknown or other
  misc_feature (475)..(475): n is a, c, g, or t
  modified_base (628)..(628): a, c, t, g, unknown or other
  misc_feature (628)..(628): n is a, c, g, or t
tcagtctacgtagccacgaccggtgctcgatttagagtatacatattgggtttgggggcaggagtcagaccactcagtacacagcatggacatgagggtccccgctcagctcctggggctcctgctgctctggctccaggtgccagatgtcgcatccagatcgaccngtctcatcctcctgtctgcattcgngtagganacaggtactacgacctatacacgttcggaccgggtacaagttcgaaggtactaagttaacggaactggtaaacgtttagggttcggtaatccgaagcaaaggtaacgtaccgggaaaacncccgtaagcctacctagtactcgtggngtcctgactacgttacctaaacgtttacggaaacggttcgggtacctaagtaccgtaaggttcaggcgtacgaggttcgaatcgtcgacgacgtgtacttcacttcacactagacgacgngaccacgtnaacgtaccggtctaaaggtaacctagtttacgaacttaaacgtttacgtacttcgtaacttaaagtaccgtaattaaccgaagttcccgagggtcctacgggacgtaacgggaacgtacggtaacgttaaccaaggtaaccgtacgtaccggngtacctacgactacctacg

SEQ ID NO: 165960 - DNA, 622 bp, Homo sapiens
  misc_feature: GYAE6OF02G4WKR.15.67.G01.1.454.CMB.1.raw
  modified_base (200)..(200): a, c, t, g, unknown or other
  misc_feature (200)..(200): n is a, c, g, or t
  modified_base (224)..(224): a, c, t, g, unknown or other
  misc_feature (224)..(224): n is a, c, g, or t
  modified_base (276)..(276): a, c, t, g, unknown or other
  misc_feature (276)..(276): n is a, c, g, or t
  modified_base (396)..(396): a, c, t, g, unknown or other
  misc_feature (396)..(396): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctcctgtctgcatctgtagganacagagtcacatcacgttgccggntaagcaggacattagaactgacttaggtgtatcagcaagaaatccgggaaanccctaagctcctgatctgtgctgcatctaactttaagaaggtcggtaccatacgtaagtcaggcgacagtggatcgtagcactagtactttcaacttcacgacatcaggctacgccgtanacgtagaccgtagtaaggttactttcgaaccttaaactttacggttacgtacttaaccgtaataaacttatttaaacctaaaccgtttacccggtacggttaaccggtttccgaaccgggtaaccgggggaaacttaaaacggggttacgaaaaaccgttaaacccggaaaaacggtaacgggttttcggacggtacccgttaacgtacccggaaaccctttacgg

SEQ ID NO: 165961 - DNA, 715 bp, Homo sapiens
  misc_feature: GYAE6OF02GEGH1.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccactcctccctgtctgcatctggtaggagacagacgtcaccatccacttggccgggacaagtcaaggactagttaacgaacttgactttaaggttggtatccgagacaagaacgtaccggaaacgtcccctaagcctctagtactactgtcgctgactactaccctaagtttacgaaacggttcggggtaccctagtacgtaaggttccaggcggactaggtacggtagtccgtacggtacctacgtaacgttactttaccgtaacctccttaccgaaacctacgtaccgtacgacgtaccgaccgttcgactaccgtaccgttagttaaacggttacttttaccgaaccgtttaaactttaatttaaccgttaggttaacccttaaacgtaacgtttaacgtttaaaccttaaaccgtttaacccggtacgggttacccgtttaccggggacccggtaacggggtaaccggtaagggttaacggaaacttaaccggaaacgtaacgggttcggtacggtaccgtacgaccgtcttaaccg

SEQ ID NO: 165962 - DNA, 783 bp, Homo sapiens
  misc_feature: GYAE6OF02IHFBH.15.67.G01.1.454.CMB.1.raw
  modified_base (200)..(200): a, c, t, g, unknown or other
  misc_feature (200)..(200): n is a, c, g, or t
  modified_base (205)..(205): a, c, t, g, unknown or other
  misc_feature (205)..(205): n is a, c, g, or t
  modified_base (224)..(224): a, c, t, g, unknown or other
  misc_feature (224)..(224): n is a, c, g, or t
  modified_base (285)..(285): a, c, t, g, unknown or other
  misc_feature (285)..(285): n is a, c, g, or t
tcagtctacgtagccacgaccggtgctcgatttagagtatacatattgggttttgggggcaggagtcagacccactcagtacacagcatggacatgagggtccccgctcagctcctggggctcctgctgctctggctcccaggtgccagatgtgccatccagatgacccagtcctcatcctcctgtctgcatctgtaggnacagngtcacatcacttggccggnaagtcaggacattagaactgtacttaggttagtatcgagacaagaaacgtaccgggaaacncccctaagccttcctaggattctgtcgctcgacattacctaactttaacgaaaggttcggggtaccctaagtacgtaagggttccgacggtcggtacgtagggttcggtaacttacggttccgggactaaccgtaaggtttaactttttacccgtacctttacccgtttacccgtaaaccccgtaacttaacccgtaacggtacccgaaaccggtcccggttacggtaaccgtaaccggtaccgttacgggtaaaacgtttaccggtttaccgtaaccttaaacgtttttaaacgttaccgttttagtttaaacctaaaccgttaattaaaccgtttttaaactaaacgttttaaccccggttacgggtacccggtttaccggaacccgggtaacggggaacccggttaaagggtaaccggtaaaaacggtaaccaaaaacgggttaacccgttacggggttaacggtacccggttacggtaaccctacgtaacccgg

SEQ ID NO: 165963 - DNA, 675 bp, Homo sapiens
  misc_feature: GYAE6OF02JYHNO.15.67.G01.1.454.CMB.1.raw
  modified_base (88)..(88): a, c, t, g, unknown or other
  misc_feature (88)..(88): n is a, c, g, or t
  modified_base (296)..(296): a, c, t, g, unknown or other
  misc_feature (296)..(296): n is a, c, g, or t
  modified_base (318)..(318): a, c, t, g, unknown or other
  misc_feature (318)..(318): n is a, c, g, or t
  modified_base (472)..(472): a, c, t, g, unknown or other
  misc_feature (472)..(472): n is a, c, g, or t
  modified_base (553)..(553): a, c, t, g, unknown or other
  misc_feature (553)..(553): n is a, c, g, or t
  modified_base (566)..(566): a, c, t, g, unknown or other
  misc_feature (566)..(566): n is a, c, g, or t
tcagtctacgtagccacgaccggtgctcgatttagagtatacatattgggtttgggggccaggagtcagacccactcagtacacaggnatggacatgagggtccccgctcagctcctgggctcctgctcgctcctggctcccaggtcgccagatgtgccatcccagatgacccagtctcctagtcctccctgtactgcatcctggtaggagacagtacgtccaccatcctacgttggacccgggcaaggtccgaaggtacctagttagaactcggtacgttagggttgtaatccgngactagaagtacccgggtaacnccccgtaaggtcctccgagtactcgtgtagcttcgacactacctaacgtttacgaaaccggtccggtaccctagtacgtaacggttccgaaggtccggtaccgtaaggtcgaacgttccgtacggtacccaagtaccgttaattcctaaccgtntaccgtaaccattaccacggactacggtccctacgtcgacgtaccgtagtaaccgtattccgaacttaacttcttacgttntaccgtacgtaanactttactaaccttaccggtacgttaccggtcgtaacggaccggataaccggagaaccgtaaccgtaaccggtacgttacggtccggtactcgggtacccacggttacg

SEQ ID NO: 165964 - DNA, 804 bp, Homo sapiens
  misc_feature: GYAE6OF02FL7C2.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatcgacccagtctccatcctccctgtctgcatctgtaggagacagagtccaccatccacgttcggcccgggactaacgtcgaggtaactaacttaacgaaccgttaggtaacgttttaaggggttcgggtttaacttacgaacggtacgtaaacggaaaacggttaccccggggaaaaccgtacccccgttaaacggcccgttaccgttacggtaacgttccgtggttccggtaccgtcggtaccctacttaacccttaaaccgttttaaacgaaaacgggttccgggggtacccctaagttaccgtaacgggtttacgacgggacggtacgtaaggttacgggtacgtttccgtacgggactaaccgtaggtttaactttcccgttaaccctaccttaccctaaccgttaacgtaccgaacggacctacggtcccgttacgacgtaccgttaccgtaacggtaacgttacctttaccgaaccttaaacgtttacttacgtcgttaacctaacgtaacttaacgttaaccgttaaccgttaaccccgtacggggttaacccgttaccgggaccgacggggtaaccgaaggtaacgtaaacgtaccgaacgtaacggtggtaccgtcgacggtaccaagttacg

SEQ ID NO: 165965 - DNA, 763 bp, Homo sapiens
  misc_feature: GYAE6OF02F04U2.15.67.G01.1.454.CMB.1.raw
  modified_base (543)..(543): a, c, t, g, unknown or other
  misc_feature (543)..(543): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggcgccagatgtgccatccagatcgacccagtctccatccctcctgtctgcatcgtgtaggagaccgagacgtccaacctactccacgtttcggacccgggacaacggtcgagggtactaagttaggaacttcggtacgtttagggttggtacttacgaggacaaacggtaaaccggttacccgggggaaacctacccccgtaaaggtcccgtcccgttagtacgttccgtggtcgtccgtagtccctaacttacccttaacgttttaaaccgaaacggggttccgggtacccctagttaccggtaacgggtttaccgacgggtcgggtaaccgtagggtacggtacgtccggttacggacctaacgtacgtttactttcccgtaaccgtttcaccgtaactntaccgacgtctaaccgtccgtctaccgagtacctaggtaacgttacttttaccgaccgtttaaacgtttacctaacggtttccctttaaacaacgttaagttaaccgtttaactaacccggttttaccggacgttaccggtaccggacggtaacgggaaccgtagggtaacgtaaaccgacgttaaaccgacgttcggacgtaccgtcgaccttcgtacg

SEQ ID NO: 165966 - DNA, 651 bp, Homo sapiens
  misc_feature: GYAE6OF02H3RY8.15.67.G01.1.454.CMB.1.raw
  modified_base (145)..(145): a, c, t, g, unknown or other
  misc_feature (145)..(145): n is a, c, g, or t
  modified_base (153)..(153): a, c, t, g, unknown or other
  misc_feature (153)..(153): n is a, c, g, or t
  modified_base (210)..(210): a, c, t, g, unknown or other
  misc_feature (210)..(210): n is a, c, g, or t
  modified_base (301)..(301): a, c, t, g, unknown or other
  misc_feature (301)..(301): n is a, c, g, or t
  modified_base (436)..(436): a, c, t, g, unknown or other
  misc_feature (436)..(436): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggcctcccaggtnccagatgngcccatccagatgacccagtctccatcctccctgtcctgcatctggtaggacgtacnggtaactcaacctatctacttggaccgggaccaagttcgaggacattacgaactggactttaggttgtatcagcagtaaacgtacgggaancccctaagctacctagattctgtgctgacacgtacctaacgttaacaaaggtcgggtacccattacgaaacgttcagtacggtcgaacgttgaacgttcgtaggacgacgagtactttagaaccttcacgaaccnttacgaacgcaacggctagaccgttagaccccgttagaaagttacgtttaccgaccctaaattacttacggttctaaacgttcaaaaccggttattaaccctaaaccgttacccgttaccggaccgtttcggaccccggttagggaaaccctaacgggttacgaaacgtaaaccgtaacggtacttcggttacgacggttacggacctacctagg

SEQ ID NO: 165967 - DNA, 782 bp, Homo sapiens
  misc_feature: GYAE6OF02GZJY5.15.67.G01.1.454.CMB.1.raw
  modified_base (202)..(202): a, c, t, g, unknown or other
  misc_feature (202)..(202): n is a, c, g, or t
  modified_base (231)..(231): a, c, t, g, unknown or other
  misc_feature (231)..(231): n is a, c, g, or t
  modified_base (399)..(399): a, c, t, g, unknown or other
  misc_feature (399)..(399): n is a, c, g, or t
tcagtctacgtagccacgaccggtgctcgatttagagtatacatattggggtttgggggcaggagtcagacccactcagtacacagcatggacatgagggtcccgctcagctcctggggctcctgctgctctggctcccaggtgccagatgtgccatccagatgacccagtctccatcctcctgtctgctatcgtgtagganacagagtccaccatcacttcggccggtanaagtcaggacattagaactgacttaggttgatcagacagaaactacgggaacgacccctaaggctaccgtagaactcctagtcggctaggcagtacctaatttaacgtaaaggtcgggtacccatacgaaacgggttcaacggcggtaccaggttcggaacgttacgngggactacgtaagttactttaccacttactacctaactaactcgaaacgccgtaacgtacccgttgaacccgtaaacggtacccgttaacggtaaaccgtttaacgttacccgtaaacgtaaaaccggtttttacttaaacccggttacgttacccttaaaaacggtaaaacgttaacttttaaaccggtaaaaaccccgtttaccccgggttaacggggtttaaccggttaccccggggttaaccggtaaacccgggggggtaaccttaaaaaccggggtaacgggttaaaaccgtttaaaccggaaaaacccgggtttaaaacggttcgggtttaaccggaacccggtttaacggttaccccggaaacttttaacccgggg

SEQ ID NO: 165968 - DNA, 655 bp, Homo sapiens
  misc_feature: GYAE6OF02HFMJO.15.67.G01.1.454.CMB.1.raw
  modified_base (303)..(303): a, c, t, g, unknown or other
  misc_feature (303)..(303): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggcctcccaggtgccagtatgtgccatccagatgacccagtctccatcccgtcctgtctgcatctaggtaggacacagacgtccaacctatctacttcggccgggacaagtcaggactaagttagaactgtacgttaggttagtatccagacaagaacgtaccgggaaacncccctaagcctacctgactcgttgtcggctcggctaattaccttaacgttaacgtaacggtcgggtcctaacgttaccgtaaaggttccgaacggtccgacgtacggttaggacgtttccgacgggtacctaacgtaacgttacttcctacgtaccctacgtacaacctcgacgctaacgccttgacctggaccgtagagtacttcggaacttaagttacttaccgtagtacctaaagtacgttaactaaccgttaacctacccggtacggttaccgtaccgggaacggtacgggaacgttaaggtaacgaagtaacgaacgtaacgtggaccgtcgacgaccgaccttacg

SEQ ID NO: 165969 - DNA, 801 bp, Homo sapiens
  misc_feature: GYAE6OF02HEYXK.15.67.G01.1.454.CMB.1.raw
  modified_base (162)..(162): a, c, t, g, unknown or other
  misc_feature (162)..(162): n is a, c, g, or t
tcagtctacgtagccacgaccggtgctcgatttagagtatacatattgggtttgggggcaggagtcagacccactcagtacacagcatggacatgagggtcccgctcagctcctggggctcctgctgctctggctcccaggtgccagatgtcgccatccagntacgacccagtctccactcctcctgtctgacatctggtaggacgacagacgtccaacctactacctacttcggaccgggactaacggtaccgaaggaactaagttaacggtaacttcggtaacgttttagggttagtaactacgacgaacgaaacgtaaacggtaacccgggaaaacccgtccccgtaaaagtccgttacccgtagtaacttcgttcggtacgtctacgacgtaacttaccgttaaccgtttaaaccggaagggtttccggtacccaagttaccgtaaaggttaccggacggtcggacgtaggttacgtacgttacgacgggacctaacgtagttaaccctttacgtacccgttacctaccctaaaccgtactaaccgtaaccggaccgttaccggaccgtaccggtaaccggtaaccgtacgtaacggtaacgttaacgtttaccgaaccgtttaaacttttaacttaaccgttacgttaaccgtaaacggtaaccttaaacgtttaaacccgtaaccgtttaacccgtacgggttaccggtacccggtacggtaaccgggtaaccggttaaacggtaacgtaaaccgtaacgtaacggtacgtacggttcgactacgtacgactacg

SEQ ID NO: 165970 - DNA, 826 bp, Homo sapiens
  misc_feature: GYAE6OF02FIGDV.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatccctcctgtctgcatctgtaggagacagagtccaccatccacttggccgggcaagtcgaggacattagaactgacgtttaggttggttatcagcaagaaacgtacccgggaaacgtaccccgtaagtcctacctagtacttactggtcgcttacgacgtaacttcccttaaaccttttaacgaaacggtttaccgggggtacccctaagttaccgtaaaagggtttccgaacgggtccgggtacgtaagggttaacggacgtttccgtacgggtaccaaacgtacggttaactttttaccgtaccttaccctacccgtaaccctaacttaccgaaccgtaccgaaccgtacccgtacggtaaccgttaccgacccgttaacggtaaacggtttaacttttaaccccggtaacctttaaacccgtttttaaacgttaacctttaaccggttaacctttaaaccgtaaacgtttaaaaccgtttaaaccctttaaaaccgtttaaccccgttacccgggttaacccggtttacccgggtaacccgggtaaccgggggtaaacccggttaaaggggtaaacggtaaaaccgttaaccgaaaacggtaaccggttacggttacggtacggtaccgtaccgtaacccgtaaccg

SEQ ID NO: 165971 - DNA, 684 bp, Homo sapiens
  misc_feature: GYAE6OF02HTR5S.15.67.G01.1.454.CMB.1.raw
  modified_base (201)..(201): a, c, t, g, unknown or other
  misc_feature (201)..(201): n is a, c, g, or t
  modified_base (316)..(316): a, c, t, g, unknown or other
  misc_feature (316)..(316): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtagganacagagtcacatcactgccggcaagtcgaggactattagactgattaggttggtatcgagcaagaacgtaccgggaaacgccccgtaagccttaccgtagtacttcgtgtgcgtntcgtacttcctaacgtttaacgaacggtcggggtacccaagtaccgtaaggttcaggccggtagtaggtcggtatcggtaggcctaactagttactttcctaccgtacctaccaaccgtaactcgaacgtccacgtcccgttacgaccgtacgtaccgtaaggtaacgttactttaccgtaacttaactttacgttacttacgtaaccgttaacgaacgttaactttaaaccgttaacttaccccgggtacggtaccggttaccgggaccggtaaaccgggtaaccggtaaccgggttaaggaaaccgttaaccggtaaaaccggtacgtacggggttagtacccggtaacggaccgtacgttaaccg

SEQ ID NO: 165972 - DNA, 733 bp, Homo sapiens
  misc_feature: GYAE6OF02I4875.15.67.G01.1.454.CMB.1.raw
  modified_base (106)..(106): a, c, t, g, unknown or other
  misc_feature (106)..(106): n is a, c, g, or t
  modified_base (166)..(166): a, c, t, g, unknown or other
  misc_feature (166)..(166): n is a, c, g, or t
  modified_base (189)..(189): a, c, t, g, unknown or other
  misc_feature (189)..(189): n is a, c, g, or t
  modified_base (196)..(196): a, c, t, g, unknown or other
  misc_feature (196)..(196): n is a, c, g, or t
  modified_base (307)..(307): a, c, t, g, unknown or other
  misc_feature (307)..(307): n is a, c, g, or t
  modified_base (501)..(501): a, c, t, g, unknown or other
  misc_feature (501)..(501): n is a, c, g, or t
  modified_base (566)..(566): a, c, t, g, unknown or other
  misc_feature (566)..(566): n is a, c, g, or t
  modified_base (684)..(684): a, c, t, g, unknown or other
  misc_feature (684)..(684): n is a, c, g, or t
  modified_base (706)..(706): a, c, t, g, unknown or other
  misc_feature (706)..(706): n is a, c, g, or t
  modified_base (726)..(726): a, c, t, g, unknown or other
  misc_feature (726)..(726): n is a, c, g, or t
tcagtctacgtagccacgaccggtgctcgatttagagtatacatattgggtttgggggcaggagtcagacccactcagtacacagcatggacatgagggtccccgntcagctcctggggctcctgctgctctggcccctagtgccgagtatgtcgcactccgatancgtaccagtctccactccttccncgtactncatctagtaacggagacagtacgtactaccaacgtctacgtcggaccgggactaacgtacgtaacggactaacggttaacacggttactaacggtttaaggtttcggtaanaccggagaacgtaaacgtaaaacggttaccggggaaaccctaacccgtttaagtcccggttcctaaaggtcctttaccgtagggttcacttaccggaacttaaccttaccccggttaactttaaacggggaacgggttccgggtacccaaattaccgttaaaggtcccaacgggtcgttaaccgaagggttttnaacgtcctaaccggaacattacgggtaacttccgtaaactcccgtaacaacctacgtacaccganacggttccacttacgacgttaccaggtaacgttacctataacctaagtttacttcgtacctactaaactaaggttacctaacttaccgtaccgtagaaccgttccgagacccggtaanaacggtaatactaaccgtaacngtcgtacagaccacgttacnccttaag

SEQ ID NO: 165973 - DNA, 813 bp, Homo sapiens
  misc_feature: GYAE6OF02F3E0R.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggcctcccaggtcgccagatgtcgccactccagactcgacccagtcctccactcccgtccctgtctgcattcgtgtaggacgacagacgtcacactacacgtcggccggataacgtcagactagtaacgactagtacgttaggtagtactcgagacgaagtaacgtacccgggaacctacccgtaacgtcctccgtagtactcgtacgtcgtcgtcgtacctacttaccgttaacgtttaaacggtaacgggttaccccgggtcctaacgttaaccgggtaacgttccggaacgggaccggtacggtacggttaccggtacgttcggtaccgggtaacgttaccggttactttacctttacctacccgttacctaaccccgacgtaccggtactaccgggaaccttaccggtcctaccggaaccgttaccggtacgttaaacggtaaccggtttaccgttacccgttaaaacgtttacgtttaaccgttacggttaccgtttaaactaaacggttacgttaaacccgttttaaacctaaccccggtttaccggtttaaccggtcccgggttaccgggtaaccggggtaaacgggtaaccggtttaaacgggaaaccggttaacccgtaaaacggtacggttacggtccggttaacggcctaaccgtcccgttattacccgg

SEQ ID NO: 165974 - DNA, 645 bp, Homo sapiens
  misc_feature: GYAE6OF02IZ5XU.15.67.G01.1.454.CMB.1.raw
  modified_base (201)..(201): a, c, t, g, unknown or other
  misc_feature (201)..(201): n is a, c, g, or t
  modified_base (227)..(227): a, c, t, g, unknown or other
  misc_feature (227)..(227): n is a, c, g, or t
  modified_base (277)..(277): a, c, t, g, unknown or other
  misc_feature (277)..(277): n is a, c, g, or t
  modified_base (306)..(306): a, c, t, g, unknown or other
  misc_feature (306)..(306): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtagganacagagtccaccatcacttggccggnaagtcaggacattagactgacttaggttgtatcagcagaatccgggaaancccctaagctctgactctgtgctcgactntacctaactttacgaaggtttccggggaccctataccgtaaggttcacggtcggacagggttggaacttcgtcgggaccacgtaagttactttaccgaccttacctaccaccgtatccaacgacgtaaccggccttaggaccgcgtacccgttaggaacgttactttccggaactaaacgttttacttacgttacgttactaacgtaacgttactttaaccgtaaccgttacccgtacggttacggttacccggacggaaccgggttaacgtaaccgggttacgtaaacgtaacgtaaaccgtacgttacgggtacggtactcgggactaccgttaccg

SEQ ID NO: 165975 - DNA, 667 bp, Homo sapiens
  misc_feature: GYAE6OF02JOWNE.15.67.G01.1.454.CMB.1.raw
  modified_base (208)..(208): a, c, t, g, unknown or other
  misc_feature (208)..(208): n is a, c, g, or t
tcagtctacgtagccacgaccggtgctcgatttagagtatacatattgggtttgggggcaggagtcagacccactcagtacacagcatggacatgagggtcccgctcagctcctggggctcctgctgctctggctcccaggtgccagagtgtgccatccagatcgaccctagtcctccatccctccgtgtctgctatcgtggtagganaccaggacgtccaaccgtatccgtacgttcggaccgggtacaaagggtcaacggtactacttaagaacgtgtaacggtttagggttagttacgtacgaggtacgtaaacggaacggttaaccgggaaacgtaccccgtaaggtccttaccgtaacgtacgtcgtaggtcggtacctaggtacctactaccgttaacgttacgtaaacggttcggtaccctagtacggtaacgttcacgggcgtcgagttaggtctacggtggactagacgtaacttcaccgtctacgtactatacgtacgcgtacgtccgtagtcgacgtacgtagtaacgttctacgtacttacgttgtactagtactaacgtacgtatacgtacttaccgtgtaccgtacgtacggtacggaccggtaagtacctaacgacgttaaccggacgtacggtacgcgtacacgtcctacg

SEQ ID NO: 165976 - DNA, 736 bp, Homo sapiens
  misc_feature: GYAE6OF02IH07I.15.67.G01.1.454.CMB.1.raw
  modified_base (205)..(205): a, c, t, g, unknown or other
  misc_feature (205)..(205): n is a, c, g, or t
  modified_base (244)..(244): a, c, t, g, unknown or other
  misc_feature (244)..(244): n is a, c, g, or t
  modified_base (341)..(341): a, c, t, g, unknown or other
  misc_feature (341)..(341): n is a, c, g, or t
tcagtctacgtagccacgaccggtgctcgatttagagtatacatattgggtttggggggcaggagtcagacccactcagtacacagcatggacatgagggtccccgctcagctcctggggctcctgctgctctggctcccaggtgccagatgtgccatccagatgacccagtctccatccctccctgtcctgcatcctggtaganacaggatacacatcactgccggcaagtcaggacagttanaactgtaacgttaggttcggaattcgaggtacaagtaaaacgtaccggggtaaacgacccccgtaagtaccgtaccgttagaacgttcgtcggtacnccgttacggacctaacttaccctaaccttttaaaccgaaaagggttccgggggttaccctacgttaacgtaacgggttaccgacggtaccgggtacgaacgggtaggtacgtaccgttacgggacctaacggtaagttacctttacgtaccctaacgttcccaacccgttaactccgtaaggacctaccggccgttacggaccgttacggacccttaggaaccttcgttacctataacctttacttaacctcgttaactaacgtaacgtaactttaacgtaaccctaacgtcccgggtaacggttaccgggtaccgtacggggaacgtaggtaacgggttaaactacggtaaaaccgtacgtacgggttacgtaccgtacgtcccggtaactccg

SEQ ID NO: 165977 - DNA, 761 bp, Homo sapiens
  misc_feature: GYAE6OF02HA9SB.15.67.G01.1.454.CMB.1.raw
tcagtctacgtagccacgaccggtgctcgatttagagtatacatattgggtttgggggcaggagtcagacccactcagtacacagcatggacatgagggtcccgctcagctcctggggctcctgctgctctggctcccgaggtgccagatgtgccatccagatcgaccctagtctccatcctccctgtctgcatcgtagtaggacgacagacgtccaccatcgacgttcggccgggacaacgtcgacggtacctaagtttacgaacgttgtaaccgtttaggttaggtattacgacgtactaaggaaaacggttacccgggaaaacgtcccccgttaaagccgttccgtaggtacttccgtaggttcgacttcggaactaccgttaccttacgtttaaacggaacgggttccgggtaaccctagttaccggtaacggttcgaccgggtacggtacgttagggtacgtaacgttcgtacgggacctaagtcggtttaaccttccaccgttacttaccactaactcgacgtaccgacgaccgttcgacgtacgtaccttaggaacgtttaccgttcgaacctttaacgtttacgtaaccttacgttacctaaacggtaactttaaccttaacttaacccggttaccgtaccggtacccggttgggtaacccgggtaacggggttaaacgaaccgggttaaaggtaacccgtaagtaacccggttaggtcggtaaccggtcggtaccgtaaccctagttacccg

SEQ ID NO: 165978 - DNA, 803 bp, Homo sapiens
  misc_feature: GYAE6OF02JLATN.15.67.G01.1.454.CMB.1.raw
  modified_base (226)..(226): a, c, t, g, unknown or other
  misc_feature (226)..(226): n is a, c, g, or t
  modified_base (310)..(310): a, c, t, g, unknown or other
  misc_feature (310)..(310): n is a, c, g, or t
tcagtctacgtagccacgaccggtgctcgatttagagtatacatattgggtttgggggcaggagtcagacccactcagtacacagcatggacatggagggtccccgctcagctccgtggggcctcctgctgctctggcctcccgaggtcgaccagattcggtcgaccactccagatcgaacccagtcctccacttccctccctgtctgcattcgtaggtaggacanagacgtccaaccgtataccaccgtccgggaccggactaacgtccgaacggactagttaagaactagttacgttaggttcgtaancagacgaagaacgtaaccggaccgacccagtccgtactacgtatccgtagtcgtactacgtactaacccgtaccttaaccgttaaggtaaccgggtaccggtacctacgtaacggtaccggacgtacgggcgtacggtacggtagtctcggtacgtacaacggttacttaccgttacctacctaccgtacctaaccgtactaccgacgtaccgaccgttcgacctcgaaccgtacgtaacggtttaaccttacgtttaacccgtaacttttaaacgttaccttaacgttaccgttaaacgttaaacttaacggtttaaccctttaaaccttaacccggtttacccgggaaccgggttaccggttaacccgggaaccgggttaacccgggtaaaccgggttaaattaaccggttaaaaccggtaaaacgggttaaccggttaacgggtccggttaaacccggtacggtttaaacccgtaccgtaaaccgttacg

SEQ ID NO: 165979 - DNA, 621 bp, Homo sapiens
  misc_feature: GYAE6OF02ISZRO.15.67.G01.1.454.CMB.1.raw
  modified_base (434)..(434): a, c, t, g, unknown or other
  misc_feature (434)..(434): n is a, c, g, or t
  modified_base (466)..(466): a, c, t, g, unknown or other
  misc_feature (466)..(466): n is a, c, g, or t
  modified_base (552)..(552): a, c, t, g, unknown or other
  misc_feature (552)..(552): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatcgacccagtctccactccctcctgtctgcatctaggtaggacgacagtacgtcaccatcacttcggaccggcaagtcgaaggtacagttagaactgtaacgttaggttacgtatcgagacaagaaacgtaccgggaaacgtacccctaaagtcctaccgttacgactcgttggtacgtctagtacctacgtaccttaactttaaacgtaaacgggttccggggtaccctaagtaacgtaacgttacgacggtcgacgtaggtacgtagtcncgacacgtactctttacgactactaccactanactacgacacgactcgacgtacgacgtagtaattacttacacgtaacttacttatacgtactagtaagtacttaactacgttaccncgtacgtacggacgacgggtaactaacggacgtaacgacgaacgtacgtacgtcgacgacgacagtaac

SEQ ID NO: 165980 - DNA, 895 bp, Homo sapiens
  misc_feature: GYAE6OF02FS2I0.15.67.G01.1.454.CMB.1.raw
  modified_base (193)..(193): a, c, t, g, unknown or other
  misc_feature (193)..(193): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggcctcccgaggtcgccagatgtcgccatccagatcgacccagtctccatcctcctgtctnctatctggtagacacagacgtccaccatcctacgttcggacccgggataacgtacgaggtacctaagttacgtaacgtggtaacgtttagggttacgttaacgtcgagacgtaaagtaaacggtaccccgggaaaccgtaccccgtaaacgtccgttaccgtagtaccgttccgtggtaccgtcgtacgtaccttaccttaacccgttaacttttaaaccggaacgggttaccggtacccgtaacgtacggtaacggttaccggacggtcccgggtagtaacgggttcgtaaccggtccgttacggtaccgaaccgtttaacgtttacctttacccgtaccgtttaccctaacccctaacttaccgttaaccgaccggtaccgtaacccggtccggttaccgtaaccggttaaccgtacccggtttaaacggttaaccggttaaccttacgtttaaacccgtttaacttttaaccgtaaccgttttaccggtttaaaccttaaacggtaaacgtttaaaccgtttaaaccttaaaccccggttttaacccgggtaaccgggtttaccgggttacccgtacccggggtaacccggggttaaaccggttaaaccggggttaacgttaaaacccgttaaaccggttaaaaccggttacggtaaccgggtttccgtaaaccggacccgttaccgtaccgttaaccg

SEQ ID NO: 165981 - DNA, 711 bp, Homo sapiens
  misc_feature: GYAE6OF02FWANN.15.67.G01.1.454.CMB.1.raw
  modified_base (163)..(163): a, c, t, g, unknown or other
  misc_feature (163)..(163): n is a, c, g, or t
  modified_base (581)..(581): a, c, t, g, unknown or other
  misc_feature (581)..(581): n is a, c, g, or t
tcagtctacgtagccacgaccggtgctcgatttagagtatacatattgggtttgggggcaggagtcagacccactcagtacacagcatggacatgagggtcccgctcagctcctgggctcctgctgctctggcctcccaggtgccagatgtgccatcccgagntagacccagtcctccatcctccctgtctgctatctacgtaggagaccagtacgtcaaccagtacaccgttggccgggataagtaccaggactatagaacctgtacgtttacggttagttatacgagacaacggaaacggttaaccgggaaacctaccccgtaacgtacctccgtacgtactacgtacgttgtacgtcgtccgtacgttaccttaacgtttaaacggtaaacgggttccgggggtttaccctaacgtaaccggttaaacggttccgaacgggtacccggtcgtaaggttaggggtacttacccggtacgttaccggaccgttacgtaaccgttttccgaacttacttaccgactacgttacaccgtcgaacccgtcgttacgactaccggtccttaacgggaaactttnttaccgtaacctaacttttggttaactcgtaactactaacgtaacttaactacgttaccgtacggttaccgtcggagtaccggactaaggaacgaacgtaactacggaatcgtacgtagtcgactacgtc

SEQ ID NO: 165982 - DNA, 850 bp, Homo sapiens
  misc_feature: GYAE6OF02IGWUX.15.67.G01.1.454.CMB.1.raw
tcagtctacgtagccacgaccggtgctcgatttagagtatacatagttggggtttgggggcaggagtcagacccactcagtacacagcatggacagtcggacgggtccccgcttacgaggtcctccgtggggtcctcctgctgctccgtggcctcccgaggtcgaccgagtagtcgccgacctactacccgagtactaccgtacccgtcgtaccctctacctcccgtaccgttacgtcgtactacgtaaccgttggtaagggtaacggacgaaccgtccgtaactacccgtaacgttcgtaccggttaccggaccgggtaccgtacggttaccgacggtaactacggtaacgtaccgttacgtacggttacggttcggttacgtaccgtacggaactaacgggtaaacggtaacccggtaaccggtaccccgtaccggtacctcgggttactacccgtaggtcggtaccctaggtacccaaacgtttcccgaaaccgttttacgtaacccgtaggggttaccccaaaggttcccgaacgggttaccgacggtaacgggtcgtacgtcggtaacgttacgtcgggtacgttacgtaccggtacttacctacgtaacgttaccgactacgccgtacgtaccgtaccggtacgtacgtacgtacgttacgtaacgttaccgtacgttaccgttacttaacggtacttaccgtaacgttactaacgtaacgttaactacccgtaacgtccggtacgtaccggtacgtaccgggtacgtaccggttaaacgacggtaacgacggtaaccggttacgtacgttacctacggtacctaccgtagtacctacggtacc

SEQ ID NO: 165983 - DNA, 783 bp, Homo sapiens
  misc_feature: GYAE6OF02I65KB.15.67.G01.1.454.CMB.1.raw
tcagtctacgtagccacgaccggtgctcgatttagagtatacatattgggtttgggggcaggagtcagacccactcagtacacagcatggacatgagggtcccgctcagctcctgggctcctgctgctctggctcccgaggtgccagatgtgccatccgagactgacccagtcctccattcctccctggtcctgctacttctggtacggaacgaccaagaccgtccaaccgtataccgacgttcggcccgggactaaaacggtcgaacggtactaagttaacgaaaccgttggtaccgtttaagggtcggtaactacgacggtacgtaaacgaaacggttacccggaaaaccgtccccgtaagtccttcggtacgtacttcgtcgttacgcgtacgtacctacttaacccgtaacgttttaaaccggacgggttacccgggttcctaagtaacccgttaaacggttaccgacggtacggtacggtacggtacgggtaaccgtcgtacggtacaacgtacgttaagtttacccgcttacccacgtaccgtataccggtacacgttacgccgacgtccgtacgtaccgtaggtaccgtacttacgaaaccttacgtaccgttagttaccgaacgtttaccgtaaacgttacgttaaccttaaaccggtaccccgttttcgggaaccggttccgggtaaccgggacggtaaccggtaacgggaccgttaaacgaaccgtaaccgtacgtacggtaccggtcggtacccggttaccacgttacccgg

SEQ ID NO: 165984 - DNA, 766 bp, Homo sapiens
  misc_feature: GYAE6OF02GNBAA.15.67.G01.1.454.CMB.1.raw
tcagtctacgtagccacgaccggtgctcgatttagagtatacatattgggtttgggggcaggagtcagacccactcagtacacagcatggacatgagggtccccgctcagctccgtggggctcctgctgctctggctcccgaggtgccagatgtgccatccagactcgacccagtcctccatccctcctgtctgcatcgtaggtaggacgacgagacgtaccacctatcctacgttcggcccgggactaaaggtccgaaggtactaattaagtaacgtacgtacgttaggttaggtagtacgacgtacgaagtaaacggtaaccggaaccgaacccgtaacgtaccgtaccgtacgtacgtacgtcggtcgtacgtcgactacctaccttaaccgttaaccgtaaacggtaccgggttacccgtacgtacgtaacggttacgtacggtacggtacgtacggtacggtacgttacggtacgacgttttttttttttttttttttaacgacgttaacgtttaccgtacctacctaccgtaaccctactacgacgtaccgtacgtccgtacgtaccgtacgtacgtacgtaacgttacgttacgtaacttaacttaacgttacgttacgttacgttaacgtaacgttaacttaacttaaccgttaaccgttaccgtaccgttaccggtaccggtaccgggtaacggtaacggtaacgtaacgtaaccgtaacgtaacgttacggtacggtacgtacgtacctacgtacg

SEQ ID NO: 165985 - DNA, 689 bp, Homo sapiens
  misc_feature: GYAE6OF02FSJD2.15.67.G01.1.454.CMB.1.raw
  modified_base (213)..(213): a, c, t, g, unknown or other
  misc_feature (213)..(213): n is a, c, g, or t
tcagtctacgtagccacgaccggtgctcgatttagagtatacatattgggtttgggggcaggagtcagacccactcagtacacagcatggacatgagggtccccgctcagctccgtggggcctcctgctgctctggcctccccgaggtcgccagatgtcgccatccagatcgacccagtcctccactccctcctgtctgctatcgtggagganacgagcgtaccacctatacctacgttcggccgggactaacggtcgaacggaactaagttaacgaacgtgtaacgtttagggtagttaactcgaagacgaaagaaacggtacccggggaaaaccgtaccccgtaagcccgtcgtagactcgtgtcgctgactactacctaacttaacgaaggtccgggtacctagtacgtaacggttcacggtcggagtagtgacgtcgtacgactacgtagtacttacctcgtacctaccaactctacgacacgactccgacgactacgccgtagtaacgtacttacgtaacttaatttacctagtctaacgtaacgtaacttaacttaaccgtaaccgttacccgtacggttacccgttaccgggaaccggtaacgggtaacgtaaacgggtaagtaaaacctaacggtaaaccggtacgttcggtaacggtcctaaccggtacctaagttaccg

SEQ ID NO: 165986 - DNA, 761 bp, Homo sapiens
  misc_feature: GYAE6OF02JRPPH.15.67.G01.1.454.CMB.1.raw
tcagtctacgtagccacgaccggtgctcgatttagagtatacatattgggtttgggggcaggagtcagacccactcagtacacagcatggacatggagggtccccgctcagctcctggggctcctgctgctctggcctcccgaggtgccagatgtgccatccagatcggacccagtctccactccgtcctgtctcgctatcgtaggtaggacgacgtagcgtacccacctactcgtacgtttcggccgggacgtaaacggtacgaacgggtacttaaagttaacgtaaaccgttacggttaacgtttaaggggttacggttaacgtacgaacgtacgaaagggtaaaccgtaacccggggaaaccgttaccccgaaaggtccttccgtacggtacttcgtcggtcgtcgtactcctactacccgttagtttaacggtaacggttcggtacctagtacggtagttacgacggtccgaggtacgtacggaggtcgtacggctacgtacgttacttactacctaccgtaaccaccgtaacgtcgtacgtactacgggtacctacggaccaacgttacaacggttaacgtatttacgaacctttaacttagtacgttacgtacgtaacttacgttaaccgttaacgtaccttaaccggtaccggttaccggtacggtacccgggtaaggtaaccggtaaacgggtagtaaacccgacgttaaacggtaacgtacggtaacggtaccggttcgtacgtacgtaccg

SEQ ID NO: 165987 - DNA, 675 bp, Homo sapiens
  misc_feature: GYAE6OF02H0PRG.15.67.G01.1.454.CMB.1.raw
  modified_base (284)..(284): a, c, t, g, unknown or other
  misc_feature (284)..(284): n is a, c, g, or t
  modified_base (303)..(303): a, c, t, g, unknown or other
  misc_feature (303)..(303): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtcgccagatgtgccatccagatgacccagtcctccatcctccctgtctgccatctcggtaggacgacagagtccaccgatctaccgttgaccgggacaggtccaggacagtttacgaacgtgacgttaggttgtaatcgagnaagaacgtaccggggaacncccctaagcctacctaggactcgtgtcgacgtcgactacgtacctaccttaacgaaggtccgggtaccagtcgtaaggtcgagcgggctaggtacgtatcgacggtaccacgtaagtaccgttttacaccttacctaccacctagttccgtaacggtccgtacggtcccgttacgaccggtactaccgttaggtaaacgttaacgtttaccgaaccttaaccgtttaatttaacgttacgtaccttaaacgaacgttaacgttaaccgtaaactttacccggtacgttacccgggttcggtaccgaccggggaacgttaacggtaagtaaaccgacgtaaacgacgttcggtacgtagcccgtacacgttac

SEQ ID NO: 165988 - DNA, 658 bp, Homo sapiens
  misc_feature: GYAE6OF02FVV12.15.67.G01.1.454.CMB.1.raw
  modified_base (229)..(229): a, c, t, g, unknown or other
  misc_feature (229)..(229): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctcctgtctagcatctgtaggagacagacgtcaccatccattcggcggtanaacgtcaggacagttagaactgtacttaggtgtatcagacgaagaacgtaccgggaaactacccctaggccttaccagtacttccgtggtcgacttggactaaccttaccctaaaccggttttaacgaaacgggtttccggggtaccctaagtaccgggtaaacgttccgaacgggtacgggtaccagggttacgattccgaggtacaccgtagtaactttccactaccgtacaaccgtataccgactcgaaccgtctcgaccgtacgtaccgtagttaccgaacggttttaccaactttaacgttactacgttataactacgtaataaccgtttacaacccgtttacggacctaggtcccggacgtaagggtaccgtaaggaacggtaacaacgaaacggtacgtcggactcgtactaccgattaccg

SEQ ID NO: 165989 - DNA, 691 bp, Homo sapiens
  misc_feature: GYAE6OF02I8P6E.15.67.G01.1.454.CMB.1.raw
  modified_base (229)..(229): a, c, t, g, unknown or other
  misc_feature (229)..(229): n is a, c, g, or t
  modified_base (306)..(306): a, c, t, g, unknown or other
  misc_feature (306)..(306): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatcgacccagtctccatccctcctgtcctgcatctagtaggagcagacgtcaccatcacttgccgggnaagtcagacatagaactgtacgttaggttagtatcagcgaagaacgtaccggaacgtacccctaagtcctccgtagntcgtcgtcgtctcgacctattcctaacgttaacgtaaacggttcggtaccctagtacgaacgttcgacggtcggtacgtaggtagtactcgtcggacctaacgtaagttacgtttaccaccgtttacctccgaaccttacctcgtacgcgtaaccgtcccgtagtacccaacggttacctaacggttaagtacctttaccggtaccttaaacctttacgtaacctttaccggtacttaacgtaacgttactttaaacccgtaaccggttaaccccgttaccgggtacccggttaccggtaccgggaacccgggtaacggtaaccggttaaggaaaccgttaacgaaacggtaacgtaggtaccgtcacggtacctaccgttaccg

SEQ ID NO: 165990 - DNA, 861 bp, Homo sapiens
  misc_feature: GYAE6OF02IZEMU.15.67.G01.1.454.CMB.1.raw
  modified_base (152)..(152): a, c, t, g, unknown or other
  misc_feature (152)..(152): n is a, c, g, or t
  modified_base (196)..(196): a, c, t, g, unknown or other
  misc_feature (196)..(196): n is a, c, g, or t
tcagtctacgtagccacgaccggtgctcgatttagagtatacatattgggtttgggggcaggagtcagacccactcagtacacagcatggacatgagggtcccgctcagctcctggggctcctgctgctctggctccaggtgccagatggtnccatccagatcgacccagtctccatcctcctagtctgcactcgnggtaggagacagacgtcacctagtctaacgttggccgggactaaacgtcgaacggacaagttagtaactcgtaacgtttacgggttggtaactacgtaagacctaaaggaacgttaaccggggaaaccgtccccgtaaagtccgttaccgtaggtaccgtccgttagggtacctcgttacggaccttaacgttaccccgttaaaacgtttaacgtaaacggggttaccgggggtacccctaagttaaccggtaaagggtttaccggacggggaccggtaacggttaacgggttacgggaaccttagggttaccgggaacctacctaaacgggttactttacccggaacctttaccttaaccgaaaccgtcgtaacccgtaggtaacccgtacggttacccgtacggtaccaacggttacccgttaacgggttaaagttacccggttttacaaaacccttttaacgggtttaactttaacgttaaccgggtaacctttaaaacgtaacgtaaacccttttaaaccgaaccggttttaaacccgtcgggttaacccggtttacccgggaacggtaaacccggggtaacttaaacggggtacgtaaaaccgtaaccggaaacgttacggttacggtaccggtacggtacctacgggtacccttaacgg

SEQ ID NO: 165991 - DNA, 608 bp, Homo sapiens
  misc_feature: GYAE6OF02G7UXR.15.67.G01.1.454.CMB.1.raw
  modified_base (233)..(233): a, c, t, g, unknown or other
  misc_feature (233)..(233): n is a, c, g, or t
  modified_base (303)..(303): a, c, t, g, unknown or other
  misc_feature (303)..(303): n is a, c, g, or t
tcagtctacgtagccacgaccggtgctcgatttagagtatacatattgggtttgggggcaggagtcagaccactcagtacacagcatggacatgagggtcccgctcagctcctgggactcctgctgctctggctccaggtgccagatgtgcctatccagatgacccagtctccatccctcctgtcctgcattcgtagtaggacacgagacgtcacatcacttgccggcaagtnaggacattacgatgacttaggtgtatcgagcaagtaacgccggaaacgtccctaagctcctgactctgtnctagcatcctacttaacgaaggtcggtaccagtacgaaggttcaggtccgtagaggtcgatcgtaggacctacgagtttacttccgaacgttcctaccaactaactcgtaagaccgtacgcctggacacggtacctaaggacgttacgtttacaccttaacgttataccttagtactaacgtaacgtaaccgttaataaccgttaccgtcgtaccggtccggtacggacggggtaaccgtaacgggtaactaaacgtaccggtaaacgaaccggttcggacgttacccacggtactaacttacgg

SEQ ID NO: 165992 - DNA, 915 bp, Homo sapiens
  misc_feature: GYAE6OF02JFG4G.15.67.G01.1.454.CMB.1.raw
tcagtctacgtagccacgaccggtgctcgatttagagtatacatattgggtttgggggcaggagtcagacccactcagtacacagcatggacatgagggtccccgctcagctcctggggctcctgctgctctggcctcccaggtcgccgagtatgtcgccactccagactcgacccagtcctccacttccctccttcgtctgctactcgtggacggacgaacgtagtacgtaccacccgtactacctacggttccggacccgggtaacgtaacggtaccgacggtaacttaacgttacgaacgttcggtacgtttaggttaggtactacgtagacgtaaacggaaacccggtacccggggtaaaccctaccccgtacgtcccttaccggtacgttcgttaccggttcggtcgtacttacggtacccttacctttacccgttaaacccgttaacgggtaaccgggttccccggaaccctaagggttaaaccggttacgggtaccggtacggaccggttacggtaaggttccgtaccgtcgtaccgtaacgtaaccggtttgtaaccttcccgaccttacccgtaacgtacccctaacggtccgtaaaccgtccgttaccggtcccgtaaccgtcgttaaccgtcgggtttaaactacccggtttacttaacccggttaaatttacccgttttaagttacccggttaaagtttacccgtaaaacgtttaaccctttaaaccgtttaaccccgttaaacccggtttaaccggtttacccgggggtttaaccgtaaccggggttaaccgggaacccgggtttaaagggtaaacggtaaacccggtttaaacggaaacctttaaccggggttacgaccggggtttcccgtaaacccgtaggttaccccaggttttaaccg

SEQ ID NO: 165993 - DNA, 815 bp, Homo sapiens
  misc_feature: GYAE6OF02G3638.15.67.G01.1.454.CMB.1.raw
  modified_base (215)..(215): a, c, t, g, unknown or other
  misc_feature (215)..(215): n is a, c, g, or t
  modified_base (315)..(315): a, c, t, g, unknown or other
  misc_feature (315)..(315): n is a, c, g, or t
  modified_base (326)..(326): a, c, t, g, unknown or other
  misc_feature (326)..(326): n is a, c, g, or t
  modified_base (373)..(373): a, c, t, g, unknown or other
  misc_feature (373)..(373): n is a, c, g, or t
  modified_base (770)..(770): a, c, t, g, unknown or other
  misc_feature (770)..(770): n is a, c, g, or t
tcagtctacgtagccacgaccggtgctcgatttagagtatacatattgggtttgggggcagggagtcagacccactcagtacacagcatggacatgagggtccccgctcagctcctggggctcctgctgctctcggcctcccgaggtcgaccagtatggtcgaccatacccagtagtccgaacccgtgtacctaccacctcccgtccttgtcgtnctatcgtaggtacggaagactgtacgtaccactactaccgtactcgggaccggactaacggtcgaacgaactaagttacgaacgtgtacgttaggtgtanacgagacgaanaacggtaccggaacctacccgtagtcctacgtagtacgtctacggtntcgtacctctaaccgtaccgttaacgttaacggtacggggttacccggtaccttaacgttaacggtaacggtcgacgggtacgacgggtacggtacgtaccgaaccgggttgggaacccttaagggttaacccgtttaacgttacccgtaccccttacgaaccccgttaacgtctacccggaagtacccggtacggtaccgtcggaaccgttcgttaacggacttaacggtttcctaaaccggttacttaaaccgtttaaaccgttcgttacgttaaaccccgtaagttaactttaaccctaaccgtttaacccggtccggtttaacccgggccgggtttaaccgtaccccgggtacgggtaaaacggtaacgggtttaaaccgaaacggtaaaccncggttaaccggtgaccgggtactacccgtaacctcgtttaaccgg

SEQ ID NO: 165994 - DNA, 659 bp, Homo sapiens
  misc_feature: GYAE6OF02F7Q7I.15.67.G01.1.454.CMB.1.raw
  modified_base (185)..(185): a, c, t, g, unknown or other
  misc_feature (185)..(185): n is a, c, g, or t
  modified_base (196)..(196): a, c, t, g, unknown or other
  misc_feature (196)..(196): n is a, c, g, or t
tcagtctacgtagccacgaccggtgctcgatttagagtatacatattgggtttgggggcaggagtcagacccactcagtacacagcatggacatgagggtcccgctcagctcctggggctcctgctgctctggctccaggtgccagatgtgccatccagatgaccagtctccatcctcctgtctncatctagtagngacagtcgtcaccatccagttcggaccggtacaacgtcgaggactaattagaactgacgttaggttaggtactacagtcaacggtaacgtaccggtaaccgacccgtaacgtcctacgtcgtaactcctggtacgtctcgtacacgttacctacgttttaagaacggttcgggtcctaagtaccgtaaagttccgaaggtccggtagtacggtagtacgtcgtcggacacgtaagtcttactacgtcgtacactatccgtagtaccacgtaccgtcgacgtactacggttactaacgtcttacgaactttacgttacttaaccttgttactaaacggtacgttaacttactaaaccttaccgttacggtaccgttccgggaacggtacgggtaaaccggtaacggtaggtaaaccttaaccggaaaggttcgtacgtcggtaccgtacgtacctacgttaccg

SEQ ID NO: 165995 - DNA, 845 bp, Homo sapiens
  misc_feature: GYAE6OF02IIRZL.15.67.G01.1.454.CMB.1.raw
tcagtctacgtagccacgaccggtgctcgatttagagtatacatattgggtttgggggcaggagtcagaccccactcagtacacagcatggacatggacgggtccccgctcagctccgtggggcctcctgctgcctcgtggcctcccgaggtcgccagtatggtcgccatccagactacgacccagtcctacctacgtccctccctgtctcgacctatcgtaggtaaggacgacgagtacgtaccacctataccgtacggttaccggaccggggaactaacggtccggtaagggtaaaccttaaggttaaaccgtaaacgttacggttaacggttttaacggggttacggtacctacgaacggaaccgtaaaacggtaaaccgggtaaccccggggtaaaacccgtcccccgtaaaagtcccgttacccgtaagtaaccgtttccgttggcgttaaccgttcggtaaccctacctttaaccccgttaaacgtttaacgggaaaccgggtttaccggggtaccctaacggttaaccgttaaccgggttccgacggggtaccgtacggtaggtaccgtacgtccgttacggaaccttaccgtagttacccgtttacgtaccttacccgtaccgtaacctacgtacgacgtacctccgccgtacgccgtaacgtaccgtaaggttacttacgtactaccgttaacgttctacgtacctaccgtaagttacgttaacgttaacctaccggttaccgtaccggtccgtaccgggtacggacggtaacggtacggtaacgtaaacgtaacgtaaaccggttgtaccggtcttccggacttccggactaccg

SEQ ID NO: 165996 - DNA, 700 bp, Homo sapiens
  misc_feature: GYAE6OF02IA1YJ.15.67.G01.1.454.CMB.1.raw
  modified_base (151)..(151): a, c, t, g, unknown or other
  misc_feature (151)..(151): n is a, c, g, or t
tcagtctacgtagccacgaccggtgctcgatttagagtatacatattgggtttgggggcaggagtcagacccactcagtacacagcatggacatgacgggtccccgctcagctccgtggggctcctgctgctcgtggacctcccgaggtcnccaggtatcgtcgaccatccagatcgacccagtcctaccactccctcctgtctagactagtcgtggtaggacacagtacgtacacctatactacggtccggacggataacgtcgaagactagttaacgagttacgacgtttaggtgtacacgtacgacgaaggtaaccggtaccgggaacctacccggtaacgtccctaccgtagactttccgaggtcgtcctagacctacttaaccgtacgtttaacggacgggttccggtacctaaggtaccgtacggcgtcgacgtgaggtcggattacgcggacctagtacgttactttacgacctacgaccctagacacgtacgctaccgctacgtactacgtacgtagtacttaccgtctaactttcgtttactacgtacgtacgtaacttacttaaccgttaccgttaccgttaccgtacccggtaccggttccggaaacccgggtacggtaacggacgggttaacaacccggtaactaccgggttccacggttaccgacccggttacaccgtccttaacgg

SEQ ID NO: 165997 - DNA, 774 bp, Homo sapiens
  misc_feature: GYAE6OF02H6HM6.15.67.G01.1.454.CMB.1.raw
  modified_base (281)..(281): a, c, t, g, unknown or other
  misc_feature (281)..(281): n is a, c, g, or t
  modified_base (396)..(396): a, c, t, g, unknown or other
  misc_feature (396)..(396): n is a, c, g, or t
tcagtctacgtagccacgaccggtgctcgatttagagtatacatattgggtttgggggcaggagtcagacccactcagtacacagcatggacatgagggtccccgctcagctcctggggctcctgctgctctggcctcccaggtgccagatgtgccatccagatcgacccagtcctccactccctccctgtctgctatcgtggtaggagacagacgtcaccatcgtacgtcggccggacaagtcaggactattaacgaactgtaacgttagggttagtacncgagacaagaacgtaccgggaacctcccctaagcctaccgtgacttctgtcgctgctactaccttaacttaagaacggttccggtaccagtacgtagtcgaggcgcgtagtcggntcgcgacagtagttcttacgactcacctacacgtacagaccgtacgccgtacgacccgtacgtacccgttaaaggtaacgttaccgtttccgtaaaacccgttttaacgtttaccgtttaacttaccgttaaaccgttaaacgttaaacccgtttaaacctttaaacccggtaaacccgtttaacccccggggttacccgggtttaaccgggttaccccccggggttaaaccgggggtaaacccgggggtaacccggtttaaaaccgggggttaaaccgtaaaaacccggttaaaccggtaaaaacccgggttacggttaacggggttacccggtaacccggtttaaccggaacccccgtttaaccgtttaaccccgg

SEQ ID NO: 165998 - DNA, 740 bp, Homo sapiens
  misc_feature: GYAE6OF01DFV01.26.42.D09.1.454.CMB.1.raw
  modified_base (150)..(150): a, c, t, g, unknown or other
  misc_feature (150)..(150): n is a, c, g, or t
  modified_base (378)..(378): a, c, t, g, unknown or other
  misc_feature (378)..(378): n is a, c, g, or t
tcagagactatactcacgaccggtgctcgatttagacacatacgcgaggggaaaggggatgggaaatactttctgagagtcctggacctcctgtgacaaagaacatagaaacacctgtggttccttcctcctgctggtgcagctcccagngtcgggtcctcgtccagttccagctgcgaggacgtccggctcgaggtacgtggagaacgccttcaacgacgccctcgtccctcacctgcactcgccttgtcggtcgcctccatcgtaagtggtcggtacgttccgtccggttgggcttacgggacgtccggacgacgtacccgacggaaggggacggtccgtagggacggttggtactcggactaactagttcttaanccgtaagttaccgagggaacctaccaaccttaacctaaccctaacccggtttacccaagaaaccgtacttaccgggaacttaaccgaaacctacttacgtaccaaacgttaacgaaactaaccggtaccaaacccgttaccttacgtacctacccgtaggactcgtacgtaacctgtacgaccgacccgcgggaccgaacggccgtacgtacgttaacgttcgacggttaccgaactaggaagtacggtacgggtcgtaaccgtcggaaacttattaaaacgttaaactttcttaaacgtttggtaactttacgggtacgggtaaccccgtaaggggttaacccgtcgtaccgtaaccccgg

SEQ ID NO: 165999 - DNA, 870 bp, Homo sapiens
  misc_feature: GYAE6OF01CJOTR.26.42.D09.1.454.CMB.1.raw
tcagagactatactcacgaccggtgctcgatttagacacatacgcagggaaaggggatgggaaatactttctgagagtcctggacctcctgtgcaagaacatagaaacacctgtggttcttcctcctgctggtggcagcctcccagatgggtcctcgtcccagttccagctgcgaggacgtccggctcgaggactgggtacgaacgtccttacaacgacgtaccctcgtccctacacctcgctactcgtcctcgtgggtcgcctaccatacgtaggtaggttcgggttacggttaccgttccgggtggggtctacgggtaccgtcccggagaccgaccccggaacgggaacgggggaaccgggtccgtagggaacggttggtaacgttcggaccttacgtactacctagttaccgaacgttacggtacgggaacctaccgttaaaccccttaacccgtaaaccccgtaacccccggttacccctaaaccgtaaaaccgttacggtacccgaaccgttaaccctaaaccctaattacccctaacgtaaccttaaaccggaaccgtaaaacccgtaacccttaaaaaccgtaaccccgtttacgttaacccctcccggtaacgtaacgttccgtaaacggtccttacggtcgtaccccgaccggccggtaaccggaccgtacccgggttacggtacgttaaccgttacgtacggtacgaaccggtaagaacgggtacggtaccggaccggttacgtaccggtaaccttaaaggtttaaaacgtaacttttaaccgttcgttttaaagtaaccgggtttacgggtacccgggaccggtaaaaccgggtacccgtttccgaaccggttaccccg

SEQ ID NO: 166000 - DNA, 664 bp, Homo sapiens
  misc_feature: GYAE6OF01A3BBU.26.42.D09.1.454.CMB.1.raw
  modified_base (267)..(267): a, c, t, g, unknown or other
  misc_feature (267)..(267): n is a, c, g, or t
  modified_base (272)..(272): a, c, t, g, unknown or other
  misc_feature (272)..(272): n is a, c, g, or t
  modified_base (280)..(280): a, c, t, g, unknown or other
  misc_feature (280)..(280): n is a, c, g, or t
tcagagactatactcacgaccggtgctcgatttagacacatacgcagggaaaggggatgggaaatactttctgagagtcctggacctcctggtgcaagaacatgaaacacctgtggttcttcctcctgctggtgcagctccagatgggtcctgtcccagttccagtctgcaggacgtccggctcaggtactggtagaaagtccttacacgacgtaccctgtccctcacctgcactgcctcgtggcgctcatcagtgtggtgtctcgngggcnggatccgnacgcctacgagggacggcgtggacgtggtactcggactacatactatacagtacgtggacgctaacctactaacccgtaacccgtcctacgaacgtacgtccgacgtacaccgatacctacaacgtacgactaacgtaccctaactaccgtatttacccgtacctagaacgtctcgaaccgttctcgggtaccgacccgcggtaccggaacggtaccggtcgttaggtacccgtttaccgcggtaccggtaacgaagggaccggtaacgggtcggaacccgggttactacggtaaccttaagttaaacttaaacgttacgtttaccgttagtaacgtttacggtacgggacccgtaaacggttcccgtacggtaccctacccgg

SEQ ID NO: 166001 - DNA, 664 bp, Homo sapiens
  misc_feature: GYAE6OF01BBP0R.26.42.D09.1.454.CMB.1.raw
tcagagactatactcacgaccggtgctcgatttagacacatacgcagggaaagggggatgggaaatactttctgagagtcctggacctcctgtgcaagaacatgaaacacctgtggttcttcctcctgctggtggcagctcccagatgggtcctgtcccagttccagctgcaggagtccggctcaggactggtgaagccttcacagaccctgtccctcacctgcactgcctctggtgctccatcagtagtggtgtactcgtgggctggatccggcagccacgagggaggcctggagtggattcggctacatctatcatacgtgggacgcacctacgtaccaacccgttccctacaaactacgtacgacgtccacctatcctacaactacgaactaacgtaccctaaaccttaccacgtttcctaccccgtagaacgtccttacgaccgttcttacggtaccgacccgtcccggacggtaaccgaccgggttcccgttaagttaacctttacgtcggttaccgaccgtaaggaacggtaacggttcggacgggtaacgttcgggaacccttaaagtttaactaaaacgttccgttaagtttacgtaattttaccggttacgggggacccttaaacggggtaacccctttggggtccctaacccgg

SEQ ID NO: 166002 - DNA, 685 bp, Homo sapiens
  misc_feature: GYAE6OF01A8QTE.26.42.D09.1.454.CMB.1.raw
  modified_base (241)..(241): a, c, t, g, unknown or other
  misc_feature (241)..(241): n is a, c, g, or t
tcagagactatactcacgaccggtgctcgatttagacacatacgcagggaaaggggatgggaaatactttctgagagtcctggacctcctgtgcaagaacatgaaacacctgtggttcttcctcctgctggtggcaactcccagatgggtcctgtcccagttccagctgcaggagtccggctcgaggactgggtgaagccttcacacgaccctcgtccctcacctgcactgccctcgtggnggctccatcagtgtggtgttactcgtgggctggatccggcacgccgaccgagggaaggcctgggagtggagtcggctacattcgtaactctaagtacgtgggacgacctaacctaccgtaacccaaccccgtccctacaaaccgtacgtaccgacgtaccaaccgtactcttaccaactaacgaacctaacgtaccaaacttaccgtacgttaccctaccctaagaaccgtcgttacgtaccgtctcggtacgaccccggccggaccgaccggtaccggtcccgtttaagtacgtttaccggtgtaccggtaccgaagggaaacgtaacggtcgggaccggtaccgttacggacccttaaagttaacgttaaaacttacgtttacgttacgtaagtttacggtacggggaaccgtacgggtaaccccttggacccgtcgtcccg

SEQ ID NO: 166003 - DNA, 891 bp, Homo sapiens
  misc_feature: GYAE6OF01C7IVS.26.42.D09.1.454.CMB.1.raw
  modified_base (251)..(251): a, c, t, g, unknown or other
  misc_feature (251)..(251): n is a, c, g, or t
tcagagactatactcacgaccggtgctcgatttagacacatacgcagggaaaggggatgggaaatactttctgagagtcctggacctcctgtgacaagaacatagaaacctacctggttcggttccttcctcctgcgtgggtcggcacgcctacccagagtcgggtcctcgtccctacgtcagctgacgaggacggtccggctacgacggtacgtggtagtaacgtccttacacacgtccctcgtcctacncctcgtactcgtcgtccgtgtacgggtcgtacctacgacgtacgtacggtagttacgggttacgttaccggtcggtcgggtacgtcggcgtaccgagaccggaccgaacgggaaggggtacggtaccggtaggtacggtggtacgtacggactacgtagtaccttaatacggtacgtacgggtacgggtacctaacctaaccgttaaaccgtaacccctaacccgttaacccaacgtaaccggtacgttaccggacgttaaccaaccgttacctaccggtaaccgtaaaacgtacgtaaccgtaaacccgtaaccctaaacccgtaaccgtttacccggtaccgttaacccgtaacgtaaccggttactaacccgggtacgttaccgtaaccgggttccccgggtaacccggtacccgggtaacccgaacccgggttacccgggtaaccgtttacggttaaccgtttaccggtacggtaccgggtaaccgaaaggtacggtacggttacgggaaccccggttagtaaccggttacttaaacgttaaacttaaaccgtttacggtttacttaacgggttacgtttaacggggtaccgggtaaacccggtacggttaacccgggttcgttacccgtacccgg

SEQ ID NO: 166004 - DNA, 598 bp, Homo sapiens
  misc_feature: GYAE6OF02HMWX3.26.42.D09.1.454.CMB.1.raw
  modified_base (336)..(336): a, c, t, g, unknown or other
  misc_feature (336)..(336): n is a, c, g, or t
  modified_base (358)..(358): a, c, t, g, unknown or other
  misc_feature (358)..(358): n is a, c, g, or t
  modified_base (362)..(362): a, c, t, g, unknown or other
  misc_feature (362)..(362): n is a, c, g, or t
tcagagactatactcacgaccggtgctcgatttagacacatacgcagggaaaggggatgggaaatactttctgagagtcctggacctcctgtgcaagaacatgaaacacctgtggttcttcctcctgctggtggcagctcccagatgggtcctgtcccagttccagctgcaggagtccggctcaggactggtgaagccttcacagaccctgtccctcacctgcactgcctctggtgctccatcagtagtggtggttactccgtggggctggatccggcagccaaccgaggggaacgggcctggagtggattggctacatctatcatacgtggggancaacctactacaacccgtcctnaacngtcgagtcaccatctacactagacaacgtccaaactaccagttctccctagaacgctagacgtctgtacgaccgccgacggacaccggccgtagttacttacgtgtcgaccagaagaaagtcgacggactacgggacctaagtttaaactaaaacgttaacttaaccgttttaggtaattttaacggttcggggggaaccctaaacgggggtaaccccttgggtacctaaccccgg

SEQ ID NO: 166005 - DNA, 609 bp, Homo sapiens
  misc_feature: GYAE6OF02JT9FG.26.42.D09.1.454.CMB.1.raw
  modified_base (256)..(256): a, c, t, g, unknown or other
  misc_feature (256)..(256): n is a, c, g, or t
  modified_base (325)..(325): a, c, t, g, unknown or other
  misc_feature (325)..(325): n is a, c, g, or t
  modified_base (373)..(373): a, c, t, g, unknown or other
  misc_feature (373)..(373): n is a, c, g, or t
  modified_base (447)..(447): a, c, t, g, unknown or other
  misc_feature (447)..(447): n is a, c, g, or t
tcagagactatactcacgaccggtgctcgatttagacacatacgcagggaaaggggatgggaaatactttctgagagtcctggacctcctgtgcaagaacatgaaacacctgtggttcttcctcctgctggtggcagctcccagatgggtcctgtcccagttccagctgcaggagtccggctcaggactggtgaagccttcacagaccctgtccctcacctgcactgcctctgtgctccatcagtagtgtgttacncgtgggctggatccggcagccacgagggaaggcctgggagtggagttgggctacgattctatcatacgngggtagccaacctactaccaacccgtcctcaacagtcgatcaccatcncactagacaacgtacctaactaccaattcctccctagaacgctacgacgttactgtcgacccgccgacggaccnccgggtccgtagttacttaccgtggttacgaccgagaacgtaagtcggtacgtaaccgtggtaaccgtaatttaacgtaaacgttaccttaacgtttaggttaacgtttacggttacggggacccgtaacggggtaaccccgttgggttacccgtaacccgg

SEQ ID NO: 166006 - DNA, 561 bp, Homo sapiens
  misc_feature: GYAE6OF02GS5YK.26.42.D09.1.454.CMB.1.raw
  modified_base (333)..(333): a, c, t, g, unknown or other
  misc_feature (333)..(333): n is a, c, g, or t
tcagagactatactcacgaccggtgctcgatttagacacatacgcagggaaaggggatgggaaatactttctgagagtcctggacctcctgtgcaagaacatgaaacacctgtggttcttcctcctgctggtggcagctcccgagatgggtcctgtcccagttccagctgcaggagtccggctcaggactggtgaagccttcacagaccctgtccctcacctgcactgcctctggtgctccatcagtagtggtgttactccgtggggctggatccggcagccaccgagggacggcctggagtggattggctacgatctatcatacgtgggacncacctactaccaacccgtcctacaacagtcgagtcacctatctacactagacaagtccaactaccagttcctcctagaacgctacgacgttctcgtcgacccgccgacgaccacgggtccgtagtacttacgtgtcgaccagagacgtgacggactggcctaagttaactaaatacttactttgaatttacgttcgggacctaacggggaacccttggtactacccgg

SEQ ID NO: 166007 - DNA, 527 bp, Homo sapiens
  misc_feature: GYAE6OF02GVKON.26.42.D09.1.454.CMB.1.raw
  modified_base (328)..(328): a, c, t, g, unknown or other
  misc_feature (328)..(328): n is a, c, g, or t
  modified_base (455)..(455): a, c, t, g, unknown or other
  misc_feature (455)..(455): n is a, c, g, or t
  modified_base (480)..(480): a, c, t, g, unknown or other
  misc_feature (480)..(480): n is a, c, g, or t
tcagagactatactcacgaccggtgctcgatttagacacatacgcagggaaaggggatgggaaatactttctgagagtcctggacctcctgtgcaagaacatgaaacacctgtggttcttcctcctgctggtggcagctcccagatgggtcctgtcccagttccagctgcaggagtccggctcaggactggtgaagccttcacagaccctgtccctcacctgcactgcctctggtgctccatcagtagtggtggttactcctggggctggatccggcagccaccagggaaggcctggagtggattggctacatctatcatactgggancacctactacaaacccgtcctcaacagtcgagtcaccatctcactagacaagtccaactaccagttcctccctgaacgctagaccgttctgtcgaccgccgcgacaccgggcctagtattacgtgtnccagacgagtgcgactggccattanaaatactactttgatttagtcgggacctagggaccctggactacccg

SEQ ID NO: 166008 - DNA, 559 bp, Homo sapiens
  misc_feature: GYAE6OF02FSLF6.26.42.D09.1.454.CMB.1.raw
  modified_base (328)..(328): a, c, t, g, unknown or other
  misc_feature (328)..(328): n is a, c, g, or t
tcagagactatactcacgaccggtgctcgatttagacacatacgcagggaaaggggatgggaaatactttctgagagtcctggacctcctgtgcaagaacatgaaacacctgtggttcttcctcctgctggtggcagctcccagatgggtcctgtcccagttccagctgcaggagtccggctcaggactggtgaagccttcacagaccctgtccctcacctgcactgcctctggtgctccatcagtagtggtgttactcgtggggctggatccggcagccaccgagggagggcctggagtggattggctacatctatcatactgggancacctactacaacccgtcctcaacagtcgagtcaccatctcactagacaagtccaactaccagttcctaccctagaacgcctgaccgttctagtcgacccgtccgcggaccaccgggcgttcgtacttacgtgtcgaccagacgaagtgcggactggacctagttaactaaattccttaacgtttgagtttacgttcggggacctacggggtacccttgggtccctaccgg

SEQ ID NO: 166009 - DNA, 559 bp, Homo sapiens
  misc_feature: GYAE6OF02IWBFL.26.42.D09.1.454.CMB.1.raw
tcagagactatactcacgaccggtgctcgatttagacacatacgcagggaaaggggatgggaaatactttctgagagtcctggacctcctgtgcaagaacatgaaacacctgtggttcttcctcctgctggtggcagctcccagatgggtcctgtcccagttccagctgcaggagtccggctcaggactggtgaagccttcacagaccctgtccctcacctgcactgcctctggtggctccatcagtagtggtggttactcctggggctggatccggcagccaccagggaagggcctgggagtgggattggctacatctatcatactgggagtcacctactacaacccgtccctcaacagtcagtcaccatctcactagacaagtacccaactaccagttcctccctgaagctgaccgtctgtgaccgccgacgaccgacggccgtgtaacttactgtgaccagagaaagtgacggactgggccagttaactaaaattacttaactttgtaatttaacgttgggggtacccaaggggaacccctgggttacctaaccgg

SEQ ID NO: 166010 - DNA, 603 bp, Homo sapiens
  misc_feature: GYAE6OF02GR6WI.26.42.D09.1.454.CMB.1.raw
  modified_base (278)..(278): a, c, t, g, unknown or other
  misc_feature (278)..(278): n is a, c, g, or t
  modified_base (329)..(329): a, c, t, g, unknown or other
  misc_feature (329)..(329): n is a, c, g, or t
  modified_base (348)..(348): a, c, t, g, unknown or other
  misc_feature (348)..(348): n is a, c, g, or t
  modified_base (353)..(353): a, c, t, g, unknown or other
  misc_feature (353)..(353): n is a, c, g, or t
  modified_base (363)..(363): a, c, t, g, unknown or other
  misc_feature (363)..(363): n is a, c, g, or t
  modified_base (366)..(366): a, c, t, g, unknown or other
  misc_feature (366)..(366): n is a, c, g, or t
tcagagactatactcacgaccggtgctcgatttagacacatacgcagggaaaggggatgggaaatactttctgagagtcctggacctcctgtgcaagaacatgaaacacctgtggttcttcctcctgctggtggcagctcccagatgggtcctgtcccagttccagctgcaggagtccggctcgaggactggtgaagccttcacagaccctgtccctcacctgcactgcctctggtgctccatcagtagtggtgttactccgtggggctggatccggnacgccacgagggaggcctggagtggattggctacatctatcatacgtggancacctactacacccgtccncaacngtcagtcacntcncactagacacgtaccaactacagttcctccgtgaactctacgacgtctgtcgacccgccggtacgaccacgggtcctagttaacgttccgtgtccgaccgagacgtaacggtgaccggtacgtacggtaccctaagtttaaactaaacgtttaccgttaacgttttaggtaacgttttacggttaccgggggtaccccgtaacggggttaacccccgtttggtaccccgtaccccgg

SEQ ID NO: 166011 - DNA, 619 bp, Homo sapiens
  misc_feature: GYAE6OF02F9L4U.26.42.D09.1.454.CMB.1.raw
  modified_base (345)..(345): a, c, t, g, unknown or other
  misc_feature (345)..(345): n is a, c, g, or t
  modified_base (372)..(372): a, c, t, g, unknown or other
  misc_feature (372)..(372): n is a, c, g, or t
  modified_base (422)..(422): a, c, t, g, unknown or other
  misc_feature (422)..(422): n is a, c, g, or t
  modified_base (504)..(504): a, c, t, g, unknown or other
  misc_feature (504)..(504): n is a, c, g, or t
tcagagactatactcacgaccggtgctcgatttagacacatacgcagggaaaggggatgggaaatactttctgagagtcctggaccctcctgtgcaagaacatgaaacacctgtggttcttcctcctgctggtggcagctcccagatgggtcctgtcccagttccagcctgcaggagtcccggctcgaggactggtgaagcccttcacacgacccctgtccctcgacctgccactcgcctctggtgcctccatcagtagtggtgttacctccgtggggctggatccggcagccaccgagggaacgggcctgggagtggattggctagatctatcatacgtgggancacctacgtaccacccgtcctcgaacngtcgacgtcaaccatcctacactacgacaagtcccaaactcctatttccnccctagaacgctagaccgttctgtacgacccgccggaccggtaccacgggccgtttatattaccgtgtccgacctaaggtanacggtgaccggtagtcggcctaagttaacgttaaactactttaacgtttaagtaccgttttaagttaccgggggtacccgaacgggttaacccccttgggtacccgttaccccgg

SEQ ID NO: 166012 - DNA, 669 bp, Homo sapiens
  misc_feature: GYAE6OF02HDABA.26.42.D09.1.454.CMB.1.raw
  modified_base (262)..(262): a, c, t, g, unknown or other
  misc_feature (262)..(262): n is a, c, g, or t
  modified_base (278)..(278): a, c, t, g, unknown or other
  misc_feature (278)..(278): n is a, c, g, or t
  modified_base (318)..(318): a, c, t, g, unknown or other
  misc_feature (318)..(318): n is a, c, g, or t
tcagagactatactcacgaccggtgctcgatttagacacatacgcagggaaagggggatgggaaatactttctgagagtcctggacctcctgtgcaagaacatgaaacacctgtggttcttcctcctgctggtggcagctcccagatgggtcctgtcccagttccagctgcaggagtccggctcaggactgggtgaagccttcacacgaccctgtccctcacctgcactgcctctggtgcctcatcgagtagtggtgttacncgtgggctggctcgcncgccacggagggacggccgtggaggtggagtcggctacgntctactactagtacggtgggactacctacctaaccacccgtaaccccgtcctaccaacgtacgtaccgacgtaccaaccgtactctaccaacgtacgaactaactaccctaaactaaccgttacgttccctacccgtagaaccgttcacgtacgttcgttacggtacggacccgccggccggtaccgaccgggtcgttacgttacgttacggtcgacgtaccgaagggtacgtaacggtccggacgtaccgtacggaaccttagtttaaacttaacgttactttaacgtttaaggtagttttacgggtacggggtaccctaacggggtacccgttacggtcccgtaacccg

SEQ ID NO: 166013 - DNA, 716 bp, Homo sapiens
  misc_feature: GYAE6OF02H4H29.26.42.D09.1.454.CMB.1.raw
  modified_base (190)..(190): a, c, t, g, unknown or other
  misc_feature (190)..(190): n is a, c, g, or t
  modified_base (200)..(200): a, c, t, g, unknown or other
  misc_feature (200)..(200): n is a, c, g, or t
  modified_base (353)..(353): a, c, t, g, unknown or other
  misc_feature (353)..(353): n is a, c, g, or t
  modified_base (428)..(428): a, c, t, g, unknown or other
  misc_feature (428)..(428): n is a, c, g, or t
tcagagactatactcacgaccggtgctcgatttagacacatacgcagggaaaggggatgggaaatactttctgagagtcctggacctcctgtgcaagaacatgaaacactgtgttcttcctctgctggtggcagctcccagatgggtcctgtcccagttccagctgcaggagtccggctcaggactggtnaagccttcanacgaccctgtcccctacgacctgcctacgtcgcctcgttgggtcggaccttccgattccgaggttaggttcggttacggttacctccggtcgggggcttgggacgtcccggacacgtccgaaccggaggggaacgggccgtagggagttgggnttacgggctaacacgttctaattcaagttcggtggacacctaccgtaacgtacccgaacccttcccgtacaacgngtaccgtacgtacacctaattccactaacgtacggtaaaccacgttaaccctaacctaaccgtacgttaccctaccgtacgtaacgcttacggtaccgttcgttcggtaccggtacccggtccggtaacgccgtaccgggtaccggttcgttaacgttaaccgtcgttacgacgtacgtacggtagtccgggacgtaccgtcggacctaagttacgtaaacgttcttaagtttcgtaaggttttcgtacggggtacccgtaacgggtaacccgttggtcccgttaccg

SEQ ID NO: 166014 - DNA, 776 bp, Homo sapiens
  misc_feature: GYAE6OF02GRSHN.26.42.D09.1.454.CMB.1.raw
  modified_base (301)..(301): a, c, t, g, unknown or other
  misc_feature (301)..(301): n is a, c, g, or t
tcagagactatactcacgaccggtgctcgatttagacacatacgcagggaaaggggatgggaaatactttctgagagtcctggacctcctgtgcaagaacatgaaacacctgtggttcttcctcctgctggtggcagctcccagatcgggtcctgtcccagttccagctgcaggagtcccggctcgaaggactgggtagaacgtccctttcaacacgacccctgtccctcaccctgcactcgccctcgtggtcgcctccatcgagtaggtggtggttacctcgtgggctaggactccggcncgccaccggagggacggcgtggaggtcggacgttggctacgtatctatacagttacgtggactcctaaccctaactaacccgtaaccccgtcctaacccgaacgtaccggtaccgaacgttaccctaacctacgttcctaccttaacgtaaccggaacctaaaccgttaccccctaaaacgttccccttaaccgtttccctacccgtaagaacgtccgtacggtaccgttacgttccggaccggtaccccggcccggaaccgggaccctaccggggtcctttaaacggttactttaccggtcggtaccgtaccgaaagggtaacgggtaaggtaccggaccggttaagttacccgggaaccttaagttttaaaacgtaacctttaaaccggttttattaacggttaacggttttacgggtccggggttaacccggaacccggggtttacccggttccgggtacccttaaccccgg

SEQ ID NO: 166015 - DNA, 737 bp, Homo sapiens
  misc_feature: GYAE6OF02IJWYK.26.42.D09.1.454.CMB.1.raw
  modified_base (612)..(612): a, c, t, g, unknown or other
  misc_feature (612)..(612): n is a, c, g, or t
tcagagactatactcacgaccggtgctcgatttagacacatacgcagggaaaggggatgggaaatactttctgagagtcctggacctcctgtgcaagaacatgaaacacctgtggttcttcctcctgctggtggcagctcccagatcgggtcctgtcccagttccagctgcgaggacgtccggctcgaggactggtgaagtcccttcaacacgaccctgtccctcacctgcactcgcctcgtggtcggtcctcgatcgagttacgtggtcggttactccgtgggctggacgtccggcacgccacggagggaacggccgtaggaggtggtagttcggctacacttacgtaactactagtaacgtcggggacaccgtaacctaaccgtaacccgtaacccgttccctaacgaacgtaacgtacgtaacgtacctaaccgtacttaccgtctaaaccgtaacgaactaaaccgtccctaaaacgtacccgttacgtttacccaccgttaagacgtccgtacggtaaccttcgaacggtacgcccggaccgaccgggtacgaccggtccgtttataacgtttacgccgtacgtaccgaaaggtaaccggtaaacgnggtaccgtaaccgtcgtaaccctttaagtttaaactaaaaccgttacgttttaacgttacggttaagttttaccgggaccggggtaacccgtaaagggttccccttagggtaccccttaacccgg

SEQ ID NO: 166016 - DNA, 800 bp, Homo sapiens
  misc_feature: GYAE6OF02IEDLV.26.42.D09.1.454.CMB.1.raw
  modified_base (226)..(226): a, c, t, g, unknown or other
  misc_feature (226)..(226): n is a, c, g, or t
tcagagactatactcacgaccggtgctcgatttagacacatacgcagggaaagggggatgggaaatactttctgagagtcctggacctcctgtgcaagaacatgaaacacctgtggttcttcctcctgctggtggcagcctcccagagtcgggtcctcgtccctagttccagctgcagggcgtcgctcgaggcgtggtgacgccttcacacgacctcgtcccaccncctgctactcgtcctgtcggtcgtcttcgatcgtagtggttcggtacggttccgtccggtgggtcgtacggtcgtccgggacgccgcccgaaccggtacgggggaacggtccgtagggtacggtgggtacgtcggtctaacgtatctacgtcgtacgtacggtcggaacgaccttaaccgtaccgtaacccgtaacccccgtaccgtacaaaccggtcgtaccggactacctaccctacttacctccgtaacctaacgtaacccgtaacgttaccctaacccgtttaaaccgcccgtttacccttccgtaaacgtaccgtacggttaccggtaaccgtccgttccgggtaccggaaccccgggtccgggtaacccgggaccctacccggggtttaccgttaccgtaacttttccggcgttaaccgaccgaagtaaccgggttacgccgggtaccgtacgggaccgttacgttaaacgtaacgttaaaccgtttaccttaacggttacgttaaggtttaccgggtacggggttaacccgaacccgggttacccgttccgggtacccttaccccgg

SEQ ID NO: 166017 - DNA, 510 bp, Homo sapiens
  misc_feature: GYAE6OF01DJVWV.36.71.G05.1.454.CMB.1.raw
  modified_base (503)..(503): a, c, t, g, unknown or other
  misc_feature (503)..(503): n is a, c, g, or t
tcagtacgctgtctcacgaccggtgctcgatttagtgtcgtcgcaagagagagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagagccaccctctcctgccagggccagtcagagtgttaacaataacttagcctggtaccaacagacacctggccaggcctcccaggctcctcatctatggtgcatcccaccgagggccactggtactcccagccaggttcagtggcagtggtctgggacagagtcactctcaccatcagcacctgcagtctgaagtatttgctagtttattactgtcagctagtataatgacacggtccgtcggtacgtttcggccgacggggccgagcgtaggagagtacaaacgtactgtgcgtgacacnctctgtc

SEQ ID NO: 166018 - DNA, 558 bp, Homo sapiens
  misc_feature: GYAE6OF01BGEDA.36.71.G05.1.454.CMB.1.raw
  modified_base (203)..(203): a, c, t, g, unknown or other
  misc_feature (203)..(203): n is a, c, g, or t
tcagtacgctgtctcacgaccggtgctcgatttagtgtcgtcgcaagagagaggggggaggaactgctcagttaggacccagacggaaccatggaagccccagcgcagcttctcttcctcctgctactctggctcccagatatcactggagaaatagtgatgacgcagtctccaggcaccctgtctgtgtctccaggggaaanagccaccctctcctgcagggccagtcagagtgttagtaccgacttggcctggtaccagcagaacctggccaggcctccaggctcctcatctatggtgcatccaccgagggccactggtactccccgagggtcccggttcaggtcggctaggtcggggtctgggacaggtacgttcacgctcaccatcagcacgcctgcagagtagaagtatttcgctagtttattattgtcagtactagttaataagtagacgtacggtaccgttaccgggtaacgtttcggaccgtacggggacctaaggcgtaggacgagtacgaaacgacgtggtacggtcgtacgaccacctagtcgtacg

SEQ ID NO: 166019 - DNA, 520 bp, Homo sapiens
  misc_feature: GYAE6OF01BBTM6.36.71.G05.1.454.CMB.1.raw
  modified_base (513)..(513): a, c, t, g, unknown or other
  misc_feature (513)..(513): n is a, c, g, or t
tcagtacgctgtctcacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggtggagtctggggggaggcgtgatccagcctgggagtccctgagactctcctgtgcagcctctggaatcaccttcaatagctatggcatgcacgtgggtcccgccaggcctccgagggcaaggggctgggaggtgggtgtcttttattcatatgatggagatattgaaagactatgcagtactccgtgaaggccgatcacatctccagagacaataccaagaacacgctagtatctagacaatagagacacctagagagttagaggacgacggctgtgtattacgtgtcgtcccggtcccccgtggggactcgnggttcgg

SEQ ID NO: 166020 - DNA, 644 bp, Homo sapiens
  misc_feature: GYAE6OF01CKWJI.36.71.G05.1.454.CMB.1.raw
  modified_base (209)..(209): a, c, t, g, unknown or other
  misc_feature (209)..(209): n is a, c, g, or t
  modified_base (271)..(271): a, c, t, g, unknown or other
  misc_feature (271)..(271): n is a, c, g, or t
  modified_base (303)..(303): a, c, t, g, unknown or other
  misc_feature (303)..(303): n is a, c, g, or t
  modified_base (438)..(438): a, c, t, g, unknown or other
  misc_feature (438)..(438): n is a, c, g, or t
tcagtacgctgtctcacgaccggtgctcgatttagtgtcgtcgcaagagagaggggggagaactgctcagttaggacccagacggaaccatggaagccccagcgcagcttctcttcctcctgctactctggctcccagataccactggaagaaatagtgatgacgcagtcctccagcccaccctgtctgtcgtctccgaagggggaaangcccaccctctcctgcgagggccagtcagagtagttaacaataacttgcctaggtaaccaanacgacaccgtggccaggcctcccaggcctccncatctagttcggcacctactcccgaacgtacgggccctaacgttcgggtaaccttccccgaaggccccgtaagggtttccaaggtcgggactaggggtcgggtctaggggacctagggtacgtttccacgttccncaaaccagttacacgtaccaaccgtacgctaacgtacgtagtaacgttagtttcgtacgttaagtttattacgtagtacacgtataagttaatagtaaacgtcgacggtccgtaccgggtaacgtttcgggacggtacgggaccgagtcgtaggtagaacgtacgaaacggtcgtaggtacggactcgacacactcgtcgttaccg

SEQ ID NO: 166021 - DNA, 540 bp, Homo sapiens
  misc_feature: GYAE6OF01CHPIW.36.71.G05.1.454.CMB.1.raw
  modified_base (203)..(203): a, c, t, g, unknown or other
  misc_feature (203)..(203): n is a, c, g, or t
  modified_base (300)..(300): a, c, t, g, unknown or other
  misc_feature (300)..(300): n is a, c, g, or t
tcagtacgctgtctcacgaccggtgctcgatttagtgtcgtcgcaagagagaggggggaggaactgctcagttaggacccagacggaaccatggaagccccagcgcagcttctcttcctcctgctactctggctcccagataccactggagaaatagtgatgacgcagtctccagccaccctgtctgtgtctccgaggggaanacgccaccctctcctgcagggccagtcagagtgttaacaatacttgcctggtaccaacagacacctggccaggctcccaggctcctcatctatggtncatcccacgagggccacgtggtactcccagccaggttcagtggctaggtgggtctgggacagtagttcacttctcaccatcacgcaacctgcagtctagaagtatttgactagtttattactgtactagtctagtaatatagacgacggtccgtacgggtaacgtttcgggaccgtaggggaccgtaggcgtgggagactacgaaacggtacgtgtagcgtacgacactactcgtgttcc

SEQ ID NO: 166022 - DNA, 547 bp, Homo sapiens
  misc_feature: GYAE6OF01CJEHA.36.71.G05.1.454.CMB.1.raw
  modified_base (202)..(202): a, c, t, g, unknown or other
  misc_feature (202)..(202): n is a, c, g, or t
  modified_base (287)..(287): a, c, t, g, unknown or other
  misc_feature (287)..(287): n is a, c, g, or t
tcagtacgctgtctcacgaccggtgctcgatttagtgtcgtcgcaagagagaggggggaggaactgctcagttaggacccagacggaaccatggaagccccagcgcagcttctcttcctcctgctactctggctcccagataccactggagaaatagtgatgacgcagtctccagccaccctgtctgtgtctccaggggaangccaccctctcctgcagggccagtcagagtgttaacaataacttgcctggtaccaacagacacctggccaggctcccaggctccncatctatggtgcatcccaccgagggccactggtactccccagcccaggttccaggtcggcgaggtggggtctggggacaggagttcactctcaccatccagccaacctcgacagtctagtaagtattttgacttagttttattactgtctagctaagtataatgacgagggtcctaccgggtactttcggccgacggggccaaggcgtaggacgtacgtacgaaacggacgttagtggcgtacgaccaccatcgtgttcc

SEQ ID NO: 166023 - DNA, 565 bp, Homo sapiens
  misc_feature: GYAE6OF01AOAPS.36.71.G05.1.454.CMB.1.raw
  modified_base (206)..(206): a, c, t, g, unknown or other
  misc_feature (206)..(206): n is a, c, g, or t
tcagtacgctgtctcacgaccggtgctcgatttagtgtcgtcgcaagagagaggggggaggaactgctcagttaggacccagacggaaccatggaagccccagcgcagcttctcttcctcctgctactctggctcccagataccactggagaaatagtgatgacgcagtctccagcccaccctgtctgtgtctccgaaggggaaangcccaccctctcctgcagggccagtcagagtgttaacaataacttagcctaggtaccaacagacacctggccaggcctcccaggcctcctcatctatggtgcatcccaccgagggcccacgtggtactccccgagcccaggttcagtggctaggtgggtctgggacaggagttcactctacaccatcacgcaacctgctagtctagaagtattttgacttagtttattacgtgtctagctagtataatgacgaggtaccgtaccgggttaacgtttcggaccggacggggaccaggcgtagggagacgtacgaaacggtacgttggtacggcgtacgacctaacctctcgtcggttacc

SEQ ID NO: 166024 - DNA, 662 bp, Homo sapiens
  misc_feature: GYAE6OF01DOX8N.36.71.G05.1.454.CMB.1.raw
  modified_base (176)..(176): a, c, t, g, unknown or other
  misc_feature (176)..(176): n is a, c, g, or t
  modified_base (289)..(289): a, c, t, g, unknown or other
  misc_feature (289)..(289): n is a, c, g, or t
  modified_base (322)..(322): a, c, t, g, unknown or other
  misc_feature (322)..(322): n is a, c, g, or t
tcagtacgctgtctcacgaccggtgctcgatttagtgtcgtcgcaagagagagggggggagaggagcccagcactagaagtcggcggtgtttccattcggtgatcagcactgaacacagaggactcaccatggagtttggctgagcttgggttttcctcgttgcttacttttaagnggtgtccagtgtcaggtgcaacgtggtggagtcgtgggggagcgtgatccagccgtgggacgtccctagacgacctcctcctgtgccacgtccctcgtaggaactccaccttnaaatagctatggcatcgcctacgtcgggtcccnccgaggcctcgaggcgaaggggtctgggtaggtgggtcgtcttttagttcattagtggatggagtattagttagaaagtactagtgactagtaccgtacggtaggaacggtccgtattccgacctactaccgtaccgaagaacgtaactaacttaccgaaacgaaccgacgtacttagtaactccgtagtaaccgaaagttacggaacgtaacctaaccgtaggaaggtcggttaaggaacggtaacgaccggtacgttggttaacggtttacgttaccgttcggtacccggtcccccggttacccccggtagggggtaccttacgggtgggttaccggg

SEQ ID NO: 166025 - DNA, 778 bp, Homo sapiens
  misc_feature: GYAE6OF01D83DL.36.71.G05.1.454.CMB.1.raw
  modified_base (235)..(235): a, c, t, g, unknown or other
  misc_feature (235)..(235): n is a, c, g, or t
tcagtacgctgtctcacgaccggtgctcgatttagtgtcgtcgcaagagagagggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggtggagtcgtgggggagcgtgatccgagccgtgggngtccctgagactctcctgtgcagcctcgtggacttctaccttttagtaacttagttggatggaggtttcgggtcccgccgttggccttcccgaagggttaacggggccctgggaggttcggggtacgacccaaagtagttaaccgacggcccgggtaagtgggaaagtggaaacgaaaaccacttaagttggtagggaacgttccgtagggttacggaaaggggtccctaatttacccaaccctacgttacccgtaccgaaggaacgaacccgaaaccgaacccgaaaacgtaaacccttacgtaacctttacgtttaccgtacgaaacgtacgtacgaacccgtaacggtacccttagggaacggtaccggacccggtaacgggtacccgttccgggtacccttaccgttaccgttaacgtttaccgttcggttaacggtccgggtaagggtagggtaacgggttaccgttaacggttttttagggtaccggtttacgttaccgtttttccccgtttacccccgttttgggttaaccccggg

SEQ ID NO: 166026 - DNA, 940 bp, Homo sapiens
  misc_feature: GYAE6OF01EJNBI.36.71.G05.1.454.CMB.1.raw
  modified_base (194)..(194): a, c, t, g, unknown or other
  misc_feature (194)..(194): n is a, c, g, or t
tcagtacgctgtctcacgaccggtgctcgatttagtgtcgtcgcaagagagaggggggggagaggagcccagcactagaagtcggcggtgtttccattcggtgatcagcactgaacacagaggactcaccatggagtttgggctgagcttgggttttcctcgttgctcttttaagaggtgtccagtgtaaggtncaactggtggagtcgtgggggagcgtgatcccaaccgtggggacgtccctgagacctctcctgtgcacgcctcgtggaactcctaaccttcaattagcttagtggccagtcgacctacggtcggggtccccgcccgaaggggtccctacccggagggacccgaaacgggggggtccttagggggaagggtttcggggggtttacggttacctttttttttaaacgttttacccgaaagtttaacggtaggtaaagttgggggtaaagttaaagttttaaaggtttaacggggaaaacgtaaaccgtttaaggtacgggtacccgtaaacgggtaacccgtttacccggggtaaggggtaaaccgggggtacccgtaaacgtttaacccgtaaccccgtaaccttaccccgtacccggtaaacggaaccgtaaaccgttaaaccgtttaaccccgaaaacggtaaaacccgtaacccgggtaccgtttaacgggtttaaccttaccgttaacggtaacgtaaaaccggttacgggtaaacggtaccccgtaaaacccggttaagggtaaaccgggtaacgggtttaaccgggaaacgggtaaccggtaacccgggtacgtttaacgggttagtttaacgtttaaccggttcgggttaacccgggttccccccgggtttaacccccccggggtaggggggttaaaccttaacccggggttaagggttccgggttccgggttaaaccgg

SEQ ID NO: 166027 - DNA, 584 bp, Homo sapiens
  misc_feature: GYAE6OF01DHWEP.36.71.G05.1.454.CMB.1.raw
  modified_base (204)..(204): a, c, t, g, unknown or other
  misc_feature (204)..(204): n is a, c, g, or t
  modified_base (316)..(316): a, c, t, g, unknown or other
  misc_feature (316)..(316): n is a, c, g, or t
tcagtacgctgtctcacgaccggtgctcgatttagtgtcgtcgcaagagagaggggggaggaactgctcagttaggacccagacggaaccatggaagccccagcgcagcttctcttcctcctgctactctggctcccagataccactggagaaatgtgatgacgcagtctccagccaccctgtctgtgtctccgaaggggaaancgccaccctctcctgcagggccagtcagagtgttaacaataacttagcctaggtaaccaacagacacctggccaggcctccaggctcctcatctatggtgctatcccaccgngggccacgtggtactcccagccctaggttcaggtggcaggtcgggtctggggacagtacgttcactctcaccatcagcacctgcacgtctagaagtatttcgtacttagtttacttacgttgtacgtagtactaagtataagtcgaacgtacgggtaccgttaccgggttaacgtttcgggaccggtacggggtaccaaggtcgtaggacgtaacgtaacgaaacggtaacgtacggtacggacgtcgaccacctactcgttgttacc

SEQ ID NO: 166028 - DNA, 593 bp, Homo sapiens
  misc_feature: GYAE6OF01C0BHM.36.71.G05.1.454.CMB.1.raw
  modified_base (205)..(205): a, c, t, g, unknown or other
  misc_feature (205)..(205): n is a, c, g, or t
  modified_base (219)..(219): a, c, t, g, unknown or other
  misc_feature (219)..(219): n is a, c, g, or t
  modified_base (311)..(311): a, c, t, g, unknown or other
  misc_feature (311)..(311): n is a, c, g, or t
  modified_base (339)..(339): a, c, t, g, unknown or other
  misc_feature (339)..(339): n is a, c, g, or t
tcagtacgctgtctcacgaccggtgctcgatttagtgtcgtcgcaagagagaggggggaggaactgctcagttaggacccagacggaaccatggaagccccagcgcagcttctcttcctcctgctactctggctcccagataccactggagaaatagtgatgacgcagtctccagcccacctgtctgtgtcctccgaaggggaangcccaccctctccngcagggccagtcagagtgttaacaataacttgcctaggtaaccaacagaccacctggacccaggcctcccaggcctcctcatctagtggtcncactcccaccgagggcctacgtggtacnccccgagcctaggttcaggtcggctaggtcgggtctgggactaggtacgtcactctacacctatcacgacctacctacgacgtacgtcgtacgtaagtattttgacttagttttacttacgtagtactagtactagttaataacgtagtacgtacggtccggttaccgggtacgtttacgggccggtacggggaccaaggcgtaggagtaactacgaaacgtacgtcgtcggctacgacacctactcgttgtcc

SEQ ID NO: 166029 - DNA, 697 bp, Homo sapiens
  misc_feature: GYAE6OF01DFX5Y.36.71.G05.1.454.CMB.1.raw
  modified_base (206)..(206): a, c, t, g, unknown or other
  misc_feature (206)..(206): n is a, c, g, or t
  modified_base (222)..(222): a, c, t, g, unknown or other
  misc_feature (222)..(222): n is a, c, g, or t
  modified_base (325)..(325): a, c, t, g, unknown or other
  misc_feature (325)..(325): n is a, c, g, or t
tcagtacgctgtctcacgaccggtgctcgatttagtgtcgtcgcaagagagaggggggaggaactgctcagttaggacccagacggaaccatggaagccccagcgcagcttctcttcctcctgctactctggctcccagactaccactggagaaatagtgatgacgcagtctccagcccacctgtctgtgtcctccgaaggggaanacgcccaccctctccngcgagggccagtcaagagttagttaaacaataacttagccctaggtaaccaacacgaaccaccgtggcccaggcctcccgaggtcctcctcatctagtggtcncactcccaccgacgggcccctacgttcggtaacctccccgaaggccctaggttccaggtcggctaggttgtgtcgtgggaaccaggtcttccaccttctaccaccatacgacgaccctaaccgtcgactagttcgtaaggtaaagttgttttacgtacgtttaagtttttacttacgttcgttaacgacgtaccgttaagttaaacgttaacgtacggaaccggttacgggttaccccggttacccgggtttaacggttttcgggacccggggtaacgggggaccctaacgggtcgtaacgggaacggtaacgtaaccggtaaaacggaacgttgggtacggtaccgtacgtaccaacctcgttccgttccg

SEQ ID NO: 166030 - DNA, 709 bp, Homo sapiens
  misc_feature: GYAE6OF01B74K6.36.71.G05.1.454.CMB.1.raw
  modified_base (204)..(204): a, c, t, g, unknown or other
  misc_feature (204)..(204): n is a, c, g, or t
tcagtacgctgtctcacgaccggtgctcgatttagtgtcgtcgcaagagagaggggggaggaactgctcagttaggacccagacggaaccatggaagccccagcgcagcttctcttcctcctgctactctggctcccagactaccactggagaaatagtgatgacgcagtctccagccacctgtctgtgtctccgaaggggaanacgccaccctctcctgcgacgggccagtcagagtagtaacaataactgcctaggaccaagagacacctcggccacggcctcccgaggtcctcctcattccgtagtcggtgcctactcccgaaccgacggggtccctaacgttcgggtaacctccccgacggacccgtagggttccgacggtcgggacgtaggggttcggggttacgagggggtaacctagggtaccgtttaccacccgttcaccctaccgtataccgaacgtacccgtaaccgtagaccgtactccgttaaggtaacgttacgttttcgaacgttaacgttttaacttaccgtaggttcaacgtactaagttaagtaagtacgtaacggtaccgggtacccggtacgggttaacgtttccgggaccggtacggggtacccgtaacggtcgtaacggacgtaacgtaaccgaaacgttcggtacgtacggtacgtacggacccttaacgtacgtcgttcgttaccg

SEQ ID NO: 166031 - DNA, 711 bp, Homo sapiens
  misc_feature: GYAE6OF01BCBY9.36.71.G05.1.454.CMB.1.raw
  modified_base (400)..(400): a, c, t, g, unknown or other
  misc_feature (400)..(400): n is a, c, g, or t
  modified_base (476)..(476): a, c, t, g, unknown or other
  misc_feature (476)..(476): n is a, c, g, or t
  modified_base (516)..(516): a, c, t, g, unknown or other
  misc_feature (516)..(516): n is a, c, g, or t
tcagtacgctgtctcacgaccggtgctcgatttagtgtcgtcgcaagagagaggggggaggaactgctcagttaggacccagacggaaccatggaagccccagcgcagcttctcttcctcctgctactctggctcccagataccactggagaaatagtgatgacgcagtcctccacgcccaccctgtctgtcgtctccggaaggggaacacgcccaccctctcctgacgacgggccagtcgaaggagttacgttaaacaagttaacgttacgaccgtacggtaaccaaacaacggaacctaccgtacggacccacggtccctaccccgaggtcctacacgttctactccgtagtcggtcacctactcccgaccggacgggacctacggtacggttacccncccgagttaccctacgtttaggcggacgtagggttgggtcgtacgggactacgtacttacctactcctacaacctntacgacgcacgtcgtacgacttacgtacgtagtaagtttntttacgtctttaacgtttctaaccttagactaaacgttagtactaagtacgtacgttaccgtcttaccgtacggttaccggttacggggaaccgggtaagggtaccggtaacgggaaggttaacgaccggttaaacaaccgggttgtaccggttcggaccgtacgtaccgtacttagtttccgttcttaccccgg

SEQ ID NO: 166032 - DNA, 692 bp, Homo sapiens
  misc_feature: GYAE6OF01BWOIN.36.71.G05.1.454.CMB.1.raw
  modified_base (200)..(200): a, c, t, g, unknown or other
  misc_feature (200)..(200): n is a, c, g, or t
  modified_base (260)..(260): a, c, t, g, unknown or other
  misc_feature (260)..(260): n is a, c, g, or t
tcagtacgctgtctcacgaccggtgctcgatttagtgtcgtcgcaagagagaggggggaggaactgctcagttaggacccagacggaaccatggaagccccagcgcagcttctcttcctcctgctactctggctccagatactaccggagaaattgtgttgacacagtctccagccaccctgtctttgctcgaggggaanacgccacctctcctgcagggccagtcagagttgtagcagctactagcctaggtaaccaanaacgaacctcgggaccaggctcccaggcctcctcatctatgatacatcctacgacggtaccacgtcggccactccccgaagtccgtaaggttcaacggtcggacgtaggtacgggtcgtagggactacgtacttcgacctctacgacctagtcacgactacgtacctaacgaccgtagtaacgttattttcggaccttaagttttacttacgttacgtacgtacggtcgtaagcggtaacggtacgggttccgttacccgggtacccggtacggggtaacctaaagggttcggaacgttaacgttaacggaaaccggttaacggtacggttacggtaccgtacgtacccgtaaaccgttacgttaccgtacggttttacccttacgttaacccgtttccccgttacccccgtaccgtaacgtttaacccggg

SEQ ID NO: 166033 - DNA, 628 bp, Homo sapiens
  misc_feature: GYAE6OF01B3XIQ.36.71.G05.1.454.CMB.1.raw
  modified_base (207)..(207): a, c, t, g, unknown or other
  misc_feature (207)..(207): n is a, c, g, or t
  modified_base (307)..(307): a, c, t, g, unknown or other
  misc_feature (307)..(307): n is a, c, g, or t
tcagtacgctgtctcacgaccggtgctcgatttagtgtcgtcgcaagagagaggggggaggaactgctcagttaggacccagacggaaccatggaagccccagcgcagcttctcttccctcctgctactctggctcccagataccactggagaaatagtgatgacgcagtctccagcccaccctgtctgtgtctccgaaggggaaangcccaccctctcctgcagggccagtcagagtgtaacaataactagcctggtaccaacagacacctggccaggcctcccgaggcctcctcatctagtggtnccactcccaccgagggcccacgtcggtactccccgagcccgtaggttccaggtcggctagggtcgggtcgtggggacaggtacgtttccacgttctaccaacctatccacgccaaccctgctagtctaggtaagtattttacgacttagttttacttacgtcgtactagtactagttaataagtacgacgacggtacccgttaccgggttaacgttttcgggaccggtacgggggtacccaaggtccggtagggtaacgtacgtaacgaaacggtacgtacggtcggacgtcgacccgtaccgtacgttccgtgtttaccc

SEQ ID NO: 166034 - DNA, 584 bp, Homo sapiens
  misc_feature: GYAE6OF01DQ6KD.36.71.G05.1.454.CMB.1.raw
  modified_base (206)..(206): a, c, t, g, unknown or other
  misc_feature (206)..(206): n is a, c, g, or t
  modified_base (263)..(263): a, c, t, g, unknown or other
  misc_feature (263)..(263): n is a, c, g, or t
  modified_base (300)..(300): a, c, t, g, unknown or other
  misc_feature (300)..(300): n is a, c, g, or t
  modified_base (310)..(310): a, c, t, g, unknown or other
  misc_feature (310)..(310): n is a, c, g, or t
  modified_base (401)..(401): a, c, t, g, unknown or other
  misc_feature (401)..(401): n is a, c, g, or t
tcagtacgctgtctcacgaccggtgctcgatttagtgtcgtcgcaagagagaggggggaggaactgctcagttaggacccagacggaaccatggaagccccagcgcagcttctcttcctcctgctactctggctcccagataccactggagaaatagtgatgacgcagtctccagcccaccctgtctgtgtcctcgaaggggaaancgcccaccctctcctgcagggccagtcagagtgtaacataactgcctaggtaccaangacactggccaggcctccagctcctcatctatggtcncatccaccgnggcccagtggtactcccgagccaggttcaggtgcaggttcgggtctgggaactaggtacttcgacttcgtaccaacatcacgaccaccgtnactacgtctagtaacgttatttcgtattagtttacttactcgtactgtactagtataagtacgaacgtacggtaccgtaccgggttaacgtttcggaccggtacggggtaccacggtcgtaggacgtaacgtaacgtaaacggtacgtacgtcggtacctcgactacctactcgttgttaccg

SEQ ID NO: 166035 - DNA, 681 bp, Homo sapiens
  misc_feature: GYAE6OF01DFV4H.36.71.G05.1.454.CMB.1.raw
  modified_base (213)..(213): a, c, t, g, unknown or other
  misc_feature (213)..(213): n is a, c, g, or t
  modified_base (230)..(230): a, c, t, g, unknown or other
  misc_feature (230)..(230): n is a, c, g, or t
tcagtacgctgtctcacgaccggtgctcgatttagtgtcgtcgcaagagagaggggggagaactgctcagttaggacccagacggaaccatggaagccccagcgcagcttctcttcctcctgctactctggctcccagactaccactggaagaaatagtgatgacgcagtcctccagcccaccctgtctgtcgtcctaccggaaggggaaacncgccctaccctctccgngcgagggccagtcaaggtagtagttaaacaataacgttgaccgtaggtaaccaagacgaccaccgtggacccagggccctacccgaggccctcctacgattaccgtagtcgggtcacctaacgtaccccaaccggacgggtaccctaacggttcgggaaccttcccccggaagtcccgtaagggtttccgaagggttcggacgtaaggggttcggggtccgtacgggaaacctaggtacgtttacccaccgttccaaccaacctagtccacgtaccgaacgttcgactaggtacgtaagtaagttacgtttagactttagtttactacgtctacgagtactaagtactagtacgacgacgtccgtaccggttaggttcggacggacgggaccaggacgagaacgtacgtaacgaaacggtcgagtcgacgtacgactactcgtgtcgtacc

SEQ ID NO: 166036 - DNA, 656 bp, Homo sapiens
  misc_feature: GYAE6OF01DKTX2.36.71.G05.1.454.CMB.1.raw
  modified_base (209)..(209): a, c, t, g, unknown or other
  misc_feature (209)..(209): n is a, c, g, or t
  modified_base (224)..(224): a, c, t, g, unknown or other
  misc_feature (224)..(224): n is a, c, g, or t
tcagtacgctgtctcacgaccggtgctcgatttagtgtcgtcgcaagagagaggggggaggaactgctcagttaggacccagacggaaccatggaagccccagcgcagcttctcttcctcctgctactctggctcccagactaccactggaagaaatagtgatgacgcagtctccacgcccacctgtctgtgtcctaccgaaggggaancgcccaccctctccngcgacggccagtcagtagtacgttaaacaataacttacgcctacggtaaccaaacgacgaacctaccgtcggaccgacggtcctacccgaacggtcctccctactacgttactacgttcgggtcgacctaacctcccgaaccgacgggtaccctacgtacggtaccacccgacgtacccgtaggttccaggtcggacgtagggtcggtacggacggtacacggtacgttcacgtcaccacactcgacgtaccacgtcgtactagtacgttagtaagttcgtttacgtacttaagtttacttacgtacgtacgagtactaatactaacgtacgacggtacgtccgtacgggttacgttcgggacggacgggtacagcgtaggacgacgtacgaacgtcgtaggtcgacgtacgtaccactcttgtcgttaccg

SEQ ID NO: 166037 - DNA, 602 bp, Homo sapiens
  misc_feature: GYAE6OF01AVUUI.36.71.G05.1.454.CMB.1.raw
  modified_base (206)..(206): a, c, t, g, unknown or other
  misc_feature (206)..(206): n is a, c, g, or t
  modified_base (266)..(266): a, c, t, g, unknown or other
  misc_feature (266)..(266): n is a, c, g, or t
  modified_base (299)..(299): a, c, t, g, unknown or other
  misc_feature (299)..(299): n is a, c, g, or t
  modified_base (311)..(311): a, c, t, g, unknown or other
  misc_feature (311)..(311): n is a, c, g, or t
tcagtacgctgtctcacgaccggtgctcgatttagtgtcgtcgcaagagagaggggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaacngcccaccctctcctgcagggccagtcagagtgttaacaataacttagcctaggtaccaanagaccacctggccaggcctcccgaggcctcctnatctagtggtcncatcccaccgagggccctagtggtactcccgagcctaggttcaggtggcaggtcgggtctgggacagtcgttcacttctacacctataccacgaccaacctcgactacgtcgtagtaagtagtttcgtacttagtttattacgtcgtacagtctaagttataagtacgacgtacggtacccgttaccgggttaacgtttcggaccggtacggggaccacggtccgtaggtacgtacgtacgaaacggtacgtaggtacggtacgtacgacctaacctacttcgtcgttacc

SEQ ID NO: 166038 - DNA, 749 bp, Homo sapiens
  misc_feature: GYAE6OF01BMC95.36.71.G05.1.454.CMB.1.raw
tcagtacgctgtctcacgaccggtgctcgatttagtgtcgtcgcaagagagaggggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggtggagtcgtgggggagcgtgatccagccgtgggagtccctgacgacctctcctgtgcacgcctctgggaactccaccttacaatacgcctagtggctatgaccacgttcggggtcccgccaggcctccgagggcgtaaggggcgtgggaggttggggttggttactttttatttacgattagtgagttagggagtaactttagttaggaaagtacttagtacgaccgtaaggtacccgttaccggtagggaacgggtacccggtaactttacccgaccctaacgttaccgtaccgaaaggtaccgtaaacttaaacttaaccccgaaaacgtaaacccgaacccgtcttaacgttacttacgtaacggtactaaacgtacggaacgtaaccgaaccgttagggaaggttaggtaacgggaacggaaccggtaccgggtacgttagggtttaacggtttaacgtttaccgttacgggttccccgggttacccccgggttcccccggggtaaggggggtaacccttacggggttggggttaacccggg

SEQ ID NO: 166039 - DNA, 621 bp, Homo sapiens
  misc_feature: GYAE6OF01EWE81.36.71.G05.1.454.CMB.1.raw
  modified_base (205)..(205): a, c, t, g, unknown or other
  misc_feature (205)..(205): n is a, c, g, or t
  modified_base (316)..(316): a, c, t, g, unknown or other
  misc_feature (316)..(316): n is a, c, g, or t
  modified_base (326)..(326): a, c, t, g, unknown or other
  misc_feature (326)..(326): n is a, c, g, or t
tcagtacgctgtctcacgaccggtgctcgatttagtgtcgtcgcaagagagaggggggaggaactgctcagttaggacccagacggaaccatggaagccccagcgcagcttctcttcctcctgctactctggctcccagataccactggagaaatagtgatgacgcagtctccagccaccctgtctgtgtctccgaaggggaaancgcccaccctctcctgcgagggccagtcagagtgttaaacaattaacttagccttaggtaaccaacagaccaccgtggccaggcctcccaggcctcctcatctagtcggtncactcccacncgggccacgtggactcccagcctaggtcagtggctaggtcggtcgtgggacaggtacgttcacttcacacctatcacgaccaacctcgacgtagtctagtaagttagtttagacttagtttatttactgtacagtactaagttaataagtacgtacggtaccgggtaccgttaccgggttaacgtttcgggaccggtaaccgggggtacgtaacggtcgtaggtacggtagtaaccgaaacggtaacgtcggtacggtacgtaccgacgtaacccgtacgttccgttcgttaccg

SEQ ID NO: 166040 - DNA, 562 bp, Homo sapiens
  misc_feature: GYAE6OF01A70LI.36.71.G05.1.454.CMB.1.raw
  modified_base (204)..(204): a, c, t, g, unknown or other
  misc_feature (204)..(204): n is a, c, g, or t
tcagtacgctgtctcacgaccggtgctcgatttagtgtcgtcgcaagagagaggggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtagttaacataacttgcctggtaccaacagacacctggccaggctccaggctcctcatctatggtgcatccaccagggccacgtgtactcccagccaggtcagtgcagtggtctgggactagacgttcactctacaccatcagccaaccgtgcagtctagaagtatttgcttagtttactacgtgtactacgtctaagtattagtacgacgtaccgtccgtacgggttacgttcgggaccggtaccggggacgtacggtcgtaggaacgtacgtaaccggtaaacgtacgtacggtacgtcgtacgacctacgtacttcgtcggttacc

SEQ ID NO: 166041 - DNA, 714 bp, Homo sapiens
  misc_feature: GYAE6OF01CLZ5P.36.71.G05.1.454.CMB.1.raw
  modified_base (205)..(205): a, c, t, g, unknown or other
  misc_feature (205)..(205): n is a, c, g, or t
  modified_base (215)..(215): a, c, t, g, unknown or other
  misc_feature (215)..(215): n is a, c, g, or t
  modified_base (311)..(311): a, c, t, g, unknown or other
  misc_feature (311)..(311): n is a, c, g, or t
  modified_base (324)..(324): a, c, t, g, unknown or other
  misc_feature (324)..(324): n is a, c, g, or t
  modified_base (355)..(355): a, c, t, g, unknown or other
  misc_feature (355)..(355): n is a, c, g, or t
tcagtacgctgtctcacgaccggtgctcgatttagtgtcgtcgcaagagagaggggggaggaactgctcagttaggacccagacggaaccatggaagccccagcgcagcttctcttcctcctgcctactctggctcccagactaccactggaagaaatagtgatgacgcagtctccagccacctgtctgtgtctccgaagggaancgccaccctntcctgacacgggcagtcagagtacgttaaacaattaacttcgcctaggtaacccaagacgaccgaccgtggcccgaaggtcctccgaaggctcctnacgtctagtcggnctactccgaccgtagggcctagtcggtaacncccgagccgtagttccgaggtcggcgtagggtcgtacgtaggactagggtacttctaacgtccttaacacccgtagtacgacgtacccgtaaccgtcgaccgtaacgtacgttaaggtaacgtttagttttaccggtactttaagttttaattaaccgtggttaaccgtaagtaacgttaaaggtttaacttaacgtacgggtaaccggtacccgggttacccgttaacccggggttttaacgtttaccgggggacccggtaaccgggggacgtaacggtaccggtaaggaacgtaaccgttaacggaaaacggtcggtcgggtacgccgtacgaactaccgtacttccgttgttaccc

SEQ ID NO: 166042 - DNA, 745 bp, Homo sapiens
  misc_feature: GYAE6OF01EDKTL.36.71.G05.1.454.CMB.1.raw
  modified_base (207)..(207): a, c, t, g, unknown or other
  misc_feature (207)..(207): n is a, c, g, or t
  modified_base (332)..(332): a, c, t, g, unknown or other
  misc_feature (332)..(332): n is a, c, g, or t
tcagtacgctgtctcacgaccggtgctcgatttagtgtcgtcgcaagagagaggggggaggaactgctcagttaggacccagacggaaccatggaagccccagcgcagcttctcttcctcctgctactctggctcccagataccactggaagaaatagtgatgacgcagtcctccagccaccctgtctgtgtctccgaaggggaaancgcccaccctctcctgcgacgggccagtcagtagtagttaaacaattaacgttacgccgttacggtaaccaacgagaaccaccgtggcccaaggcctcccgaggcctccgtcatctagtgggtcncactcccgaccgacgggcctacgtggtacctcccgagtccctagggttccaggtcggacgtagggttcgggtcgtaggggaactaggtacgtttcccacttaccgtaccacctaacgtacgaccgtaaccgtaacccgttacgacgtaacggttaccgtaggtaacgtttacgttttacgtacgtttaagtttttaacttacgtttcgtacgagtactaagttaacgtaagtacggtaacgtacccggggttacccggtttaaccggggtttaacggttttccgggaccgggtaaccgggggtccgtaaacggtacggtaacgggtaacggtaaacgtaacggtaaaaccggttacggtacgggttcggtacgtaccggacctacccgttaacgttccgtttcggtttacccg

SEQ ID NO: 166043 - DNA, 565 bp, Homo sapiens
  misc_feature: GYAE6OF01ALH79.36.71.G05.1.454.CMB.1.raw
  modified_base (204)..(204): a, c, t, g, unknown or other
  misc_feature (204)..(204): n is a, c, g, or t
  modified_base (439)..(439): a, c, t, g, unknown or other
  misc_feature (439)..(439): n is a, c, g, or t
  modified_base (503)..(503): a, c, t, g, unknown or other
  misc_feature (503)..(503): n is a, c, g, or t
tcagtacgctgtctcacgaccggtgctcgatttagtgtcgtcgcaagagagaggggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgcccaccctctcctgcagggccagtccagagtgttaacaattaacttagccgtaggtaaccaacagacaccgtggccaggcctcccgaggtcctcctcactctatgatacactaccaacgcgggcccacgtcggccgtcccagaccgtaggttcaggtcggcgaggtgggtctgggactagtaccttcacttctcacctatcgagcacgtcctgggactcgtagaagtcttcgngtacttagtttactacgtgtcagcagtccgttacgtcgttccgcctccgctccgtacgttcggnggtacggtccgagggtggaacgtacgtaacgaaacgtcgtggacgtcagaccactgtcttcg

SEQ ID NO: 166044 - DNA, 882 bp, Homo sapiens
  misc_feature: GYAE6OF01EWILO.36.71.G05.1.454.CMB.1.raw
tcagtacgctgtctcacgaccggtgctcgatttagtgtcgtcgcaagagagaggggggaggaactgctcagttaggacccagacggaaccatggaagccccagcgcagcttctcttcctcctgctactctggcctcccagactaccactggagaaatgtgatgacgcagtcctccagcccaccctgtctagtcgtcctccgaagggggtaaacacggtccaacccgttctcctgccgacgggcctaggttccaaggtacgttagttaaacaagttaaccgtttagcccgttacggtaccaacacgaacaccgttcggccacggccgttacccagggtcctcctacgtactccgtaagtcgtagtcgtacctttaccgaaaaccgggtcccctggacctaactccccgtaaaccgtacggtcgtaacgtcgtacccgtaggtcgggtcgtacggaccgtacggtacgttacgaccttactacgaccgtactccgacgcctaacggtcccgttaacggacggttaccttaggtaaacgtttacggtttacgtaccgtttaacgttttactttaccggttacgttaacgtaacccgtaacgtacccggtttaacccaaaccgggttcggggtaaccccgggttaccggggtttaaccccggggaacccgggtaaaacccggggggttaaccccgggtaaacgggttacccggggtaaacccggggttaaccgtaaaaacccgggtaccgggttacgggttaaacccgtcggggttacccgtaacccgttaacccggccttttaaacccggggttccgtttaacccgtttaaacccttcggtttaaacccccttcccccgggttaaactcccgttttaaacccggg

SEQ ID NO: 166045 - DNA, 729 bp, Homo sapiens
  misc_feature: GYAE6OF01BAAWA.36.71.G05.1.454.CMB.1.raw
  modified_base (205)..(205): a, c, t, g, unknown or other
  misc_feature (205)..(205): n is a, c, g, or t
  modified_base (719)..(719): a, c, t, g, unknown or other
  misc_feature (719)..(719): n is a, c, g, or t
tcagtacgctgtctcacgaccggtgctcgatttagtgtcgtcgcaagagagaggggggaggaactgctcagttaggacccagacggaaccatggaagccccagcgcagcttctcttcctcctgctactctggctcccagactaccactggagaaatagtgatgacgcagtctccagcccaccctgtctgtgtctacgaggggaancgccaccctctacctgaccagggccagtacagagttagttaaacaattaactacgacctaggtaaccaacacggtacctaccgtaggaccacggcctaccgacggccttacctactacttaccgtagtcggtagaccactaccgaaccgacgggacctagtacggtactcccgacgccgtagtacgagtcgagtaggtcggtcgtacggatagtacgtacacgttcacacctatcgaacgacctacgtcgacgtacgttacgtagtaacggttactttacgtacttaagttttaccgttaacggtacttaacgtacggtacttaagttaacgtaaacggttacggtaaccggtacggttaaccccgggtttaccgggttaacggttttaccggggacccgggttaaacggggacccgttaacgggtacgggtaacggtaacgtaacgttaaacccggaaacggttaacggtacggtacgtaccctacggtaccttaaccggactttccgggttnttaaccccgg

SEQ ID NO: 166046 - DNA, 646 bp, Homo sapiens
  misc_feature: GYAE6OF01CJ2WU.36.71.G05.1.454.CMB.1.raw
  modified_base (206)..(206): a, c, t, g, unknown or other
  misc_feature (206)..(206): n is a, c, g, or t
  modified_base (356)..(356): a, c, t, g, unknown or other
  misc_feature (356)..(356): n is a, c, g, or t
tcagtacgctgtctcacgaccggtgctcgatttagtgtcgtcgcaagagagaggggggaggaactgctcagttaggacccagacggaaccatggaagccccagcgcagcttctcttcctcctgctactctggctcccagataccactggaagaaatagtgatgacgcagtctccagcccacctgtctgtgtctaccgaggggaaancgcccaccctctccgtgcagggccagtcagagttagttaaacaataacgttgcctaggtaaccaagagaccaccgtgggaccaaggcctacccgagccttccgtcatccgtagtcggtcaccactcccgaacgaggcccagttcggtacncccgagccgtaggttcaggtcggacgtaggtcgggtctagggactaggtacgttcacgttcaccacgtactacacgtaccaaccgtgaccgtacggtacgttaaggtaacgtttacttttcgtacgttagttttaacgtacttacgtacgtagtactaagttaactagacgtacgtacgggttccgttaccgggtttaacgttacgggaccgggtacgggtaccgaagccggtagaacggtacgtaacgtaacgtacggtgtacgcgtacgaccaagtcttgtcttaccg

SEQ ID NO: 166047 - DNA, 843 bp, Homo sapiens
  misc_feature: GYAE6OF01D002N.36.71.G05.1.454.CMB.1.raw
  modified_base (208)..(208): a, c, t, g, unknown or other
  misc_feature (208)..(208): n is a, c, g, or t
tcagtacgctgtctcacgaccggtgctcgatttagtgtcgtcgcaagagagaggggggaggaactgctcagttaggacccagacggaaccatggaagccccagcgcagcttctcttcctcctgctactctggctcccagactaccactggagaaatagtgatgacgcagtctccagccacctgtctgtcgtctaccgaaggggaaacncgcccacccttctcccgtggaccgacggggtcccaaggttccaaggtaacgttacgttaaaaacaaacgtttaaaccgtttacggacccgttaagggtaaacccaaactaacggaaccctaaccccggttggggacccccgtaagggtcccctttaaccccggaacgggtcccttaccccttacctaatttccgttaaggttcggggttacacctaccgttaccccggaaccgttaacggggcccctaacggtttacgggttaaacctccccccggaaggtccccgtaaggggtttaccaacgggttggggacctaggggttcgggggtaccgtagggaactaggtacgtttccgactttcgacctacccagttaccgacgtacctaaccgtcggactacggttacgttagtaaacgttacttttacgacgtttaagttttaaccttacgttacggtaacgtacgtactaacgtttaacgtaaacgtacggtaaccgtaccgggttacccgttaccgggtttaaccgttttccggggaccggtaacggggacccgtaaggtaccggtaggtaacggtacttaaccgaaaccggtacgtcggtacgacgtacgacctacgtactcgttcgttaccg

SEQ ID NO: 166048 - DNA, 685 bp, Homo sapiens
  misc_feature: GYAE6OF01CMPLA.36.71.G05.1.454.CMB.1.raw
  modified_base (195)..(195): a, c, t, g, unknown or other
  misc_feature (195)..(195): n is a, c, g, or t
  modified_base (283)..(283): a, c, t, g, unknown or other
  misc_feature (283)..(283): n is a, c, g, or t
  modified_base (291)..(291): a, c, t, g, unknown or other
  misc_feature (291)..(291): n is a, c, g, or t
tcagtacgctgtctcacgaccggtgctcgatttagtgtcgtcgcaagagagaggggggggagaggagcccagcactagaagtcggcggtgtttccattcggtgatcagcactgaacacagaggactcaccatggagtttgggctgagcttgggttttcctcgttgcttcttttaagaggtgtccagtgtcaggtncaactggtgagtcgtgggggagcgtggactccgagccgtgggacggtccctgagtactctcctgtgcagcctctggaactcaccttanaatgctanggcatcgacacgtcgggtcccgcgaggtcctccgaagggccgaaggggctggaggtgggtgttcttttagttcagttaatcggtaagtcgaagtatagttacggaaagtacttagtcggactaaggtcccgttaccggtaggtaacgggtcccgtacgttaaccgtaccctacgtaccctaccgaaggaacgtaaccgtaaaaccgttaccgaaaacggtaaccctaacggtacgttacggttaacttaccgtacgtaacgtaaagtacggtaacgtaacccgtaaccgtagacggtaacggttagggaagtaccggacggtacgttaggttagttacttacgtcggtacccgtcccggtacccccgggtagggaacgttcggtaggttacggg

SEQ ID NO: 166049 - DNA, 729 bp, Homo sapiens
  misc_feature: GYAE6OF01B2L9M.36.71.G05.1.454.CMB.1.raw
  modified_base (97)..(97): a, c, t, g, unknown or other
  misc_feature (97)..(97): n is a, c, g, or t
  modified_base (145)..(145): a, c, t, g, unknown or other
  misc_feature (145)..(145): n is a, c, g, or t
  modified_base (151)..(151): a, c, t, g, unknown or other
  misc_feature (151)..(151): n is a, c, g, or t
  modified_base (213)..(213): a, c, t, g, unknown or other
  misc_feature (213)..(213): n is a, c, g, or t
  modified_base (373)..(373): a, c, t, g, unknown or other
  misc_feature (373)..(373): n is a, c, g, or t
  modified_base (428)..(428): a, c, t, g, unknown or other
  misc_feature (428)..(428): n is a, c, g, or t
tcagtacgctgtctcacgaccggtgctcgatttagtgtcgtcgcaagagagaggggggaggaactgctcagttaggacccagacggaaccatggaanccccagcgcagcttctcttcctctgctactctggcctcccagataccnctgganaaatgtgatgacgctagtctccagccctaccctgtcctgtacgtcctaccggaggggtaacncgccctaccctcgtcctcggcggtacggcctagtaccgaaggtacgtttaacgttaaaactaagttaaccggttgaccccggttaaggtaaacccaaacggacgtaacccgtaccggttcggaccctaacgggtccctaccgacggtccctaccgttacncgttcgtacggtgtcgtacctactacccgaacggaccggacctagtcggtacccncccgtaaggtcccggtaacgtcggtacggtagtccggttaaggggtcggtcgtaaggggccttaacggtacgtttacctacgttaacccgtacccgaactaggtacctaccgacctaccgtgacttacgtcgtagtacgtgtctacttgttactcgtctacgtagtacgtagtatacgtacggaccgtcggttaccgttacggttcgtaccggcgtaccgggacgtaggtccgacggtaacgtacgtacggaacgtacgtcgtacggtccgtaacacgttacctcgttccggtcttaccgg

SEQ ID NO: 166050 - DNA, 1005 bp, Homo sapiens
  misc_feature: GYAE6OF01DAU5Z.36.71.G05.1.454.CMB.1.raw
  modified_base (150)..(150): a, c, t, g, unknown or other
  misc_feature (150)..(150): n is a, c, g, or t
tcagtacgctgtctcacgaccggtgctcgatttagtgtcgtcgcaagagagaggggggagaactgctcagttaggacccagacggaaccatggaacgccccagcgcagcttctcttcctcctgctactctgctccagactaccatggaanaaatgtgatgacgctagtcctcacgccctacccgtgtcctgttgtcctaccggaaggggaacaccgtccccctaccccgttctccccgtagggacccgtacgggacctaggttaccgaaggtaacgtttacgttaaaaaccaaacgtttaaaccgttcggtaccccgttaggtaaaccccaaacgacggtaaccctaccggttccgggaccccgaacgggtccccttaccccggacggtcccttaccccgtcgttaagttacccgttaggtcgggttacccacctttaacccgtacccccggaacccggggaacggggtcccccttaaacgggttttacgggaacccccttaccccccgggtaaggtaaccccggttttaggggtttaacccctaagggggtttcccggggaccgtttaagggggggttttcccggggtacccgggtttaaaggggtaaacccgttaaacggggtttaaccctttttcccccgttaaaacccgttcccccttaacccgtaaaaccccggtacgttaacccgaaccggttaaccccttaaacccggttccgggtaaccggttaccggtttaacccggttaagtttaaacggttttacgttttccgttaaacgtttaaccgtttttaacgtttaacgttacggttacgtaacgtacgttaaagttaacgttaaacgtacggaaccggttacgggtacccggttaaccgggtttacccggtttacgggaccggggtaacggttaccgtacggtacggtacggtaactaacggtaaactaaaccgggtgttaccgggtgtacggtactaccgtacgtttaccgtcgttaccgtttaccc

SEQ ID NO: 166051 - DNA, 703 bp, Homo sapiens
  misc_feature: GYAE6OF01CIEPD.36.71.G05.1.454.CMB.1.raw
  modified_base (157)..(157): a, c, t, g, unknown or other
  misc_feature (157)..(157): n is a, c, g, or t
  modified_base (392)..(392): a, c, t, g, unknown or other
  misc_feature (392)..(392): n is a, c, g, or t
  modified_base (531)..(531): a, c, t, g, unknown or other
  misc_feature (531)..(531): n is a, c, g, or t
  modified_base (537)..(537): a, c, t, g, unknown or other
  misc_feature (537)..(537): n is a, c, g, or t
  modified_base (618)..(618): a, c, t, g, unknown or other
  misc_feature (618)..(618): n is a, c, g, or t
  modified_base (691)..(691): a, c, t, g, unknown or other
  misc_feature (691)..(691): n is a, c, g, or t
tcagtacgctgtctcacgaccggtgctcgatttagtgtcgtcgcaagagagaggggggaggaactgctcagttaggacccagacggaaccatggaacgcccagcgcgagcttctccttcctcctgctactcgtggctcccagactaccacgtggaanaaattaggtgactaggaccgcgtacgtcctaccacgccctaccgtgttccttgttcgtccgtaccggaaaggggaaacgccgccctacccttcgtccgtaggaccgacgggcctagtacgaaggtacgtttaagttaaaactaaacgtttaaccgttaggtacccgttacgtaaccgaaacgtacgaacctaccggtcggaccgaacggtacctcccgaacgtccttaccgtacncgttaccgttagtcggtacaccgtaacgccgtaaccggacggtccgaacgtcggacctaaccgtccgacggtacgtacggttacgacggttcgacggtacggtcgggtcgaacgggtactacgtactcgacctcgtacnccgtanacgcgacgacgtacgtacgacgtacgagttacgttcttcgtacgttcttacgtacgtcactactacgtcgtctacttcgtnttacgtaccttgttaccggacgtacggactacgcgtagacgtacgtacaacggtcgtcgcgtcgcacgttacnctcgtcttaccg

SEQ ID NO: 166052 - DNA, 998 bp, Homo sapiens
  misc_feature: GYAE6OF01ENOQ2.36.71.G05.1.454.CMB.1.raw
  modified_base (193)..(193): a, c, t, g, unknown or other
  misc_feature (193)..(193): n is a, c, g, or t
  modified_base (218)..(218): a, c, t, g, unknown or other
  misc_feature (218)..(218): n is a, c, g, or t
  modified_base (299)..(299): a, c, t, g, unknown or other
  misc_feature (299)..(299): n is a, c, g, or t
tcagtacgctgtctcacgaccggtgctcgatttagtgtcgtcgcaagagagagggggggtagaggagcccagcactagaagtcggcggtgtttccattcggtgatcagcactgaacacagaggactcaccatggagtttggctgagcgttggtttcctgttgcttacttttaagaggtctcgagtgtaaggtnactaagtggtggagtcgtagggggngtcgtgatccgagtcgtagggacgtccctggacgaccttcctccgtgtcgcaacgtccctgtaggaactcctaccgttaanaacgttggacctagtcgacctacgttacgacccgtacggtccggggtcccgtaccggtaacggtcccgttaccgggtaacgggaccgggaacgggggttccgttaagggggttaacggggttttcgggggaaccgttttccgttttttttaaacgttaccggtaatttaagggtaaccggttaggggttaacggggtaaacgttaaggttttaaccggtttaaaccgggtaaaaacggtttccgtttaaaacgggtaccgggtaaaccgttaaacccgggtttacccgggtttaaccccggggtaacggggtaacccggggttaccccggttaacctttaccccggtaaacccgttaacccgtttaacccggttaccgaacgttaaaccccggtaaactttaaacccgtaaccggaaaacccgtaccgttaacccgggtaaccgttttacggtacttaacggtaacccgttaaacgaaggtttaaccgaaacccgggtaccgttaaacggttaaccggaaagggtttaccggttacggggaaaacccggttaccgggtaccggttaacggtttaggtttaaccggttaaaccgttttccgggtaccccgggtttaaccccggtaccccggggttccccccgggggtttaaagggtaaacggttaccccggggtttagggttacccgggtttaaaccggg

SEQ ID NO: 166053 - DNA, 508 bp, Homo sapiens
  misc_feature: GYAE6OF02IAPD6.36.71.G05.1.454.CMB.1.raw
  modified_base (201)..(201): a, c, t, g, unknown or other
  misc_feature (201)..(201): n is a, c, g, or t
  modified_base (356)..(356): a, c, t, g, unknown or other
  misc_feature (356)..(356): n is a, c, g, or t
tcagtacgctgtctcacgaccggtgctcgatttagtgtcgtcgcaagagagaggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccacctctcctgcagggccagtcagagtgttaacaataacttagccttggtaccaacagacacctggccaggctcccaggctcctcatctatggtgcatccaccagggccactggtactcccagccaggttcagtggcagtgtgtctgggacngagttcactctcaccatcagcaacctgcagtctgaagtattttgctagtttattacttgtcagcagttataatgacaggcctacgggtactttggccgaggggccagcgtaggagagtcaaacgtaacgtgtacggctggacacctatctcg

SEQ ID NO: 166054 - DNA, 541 bp, Homo sapiens
  misc_feature: GYAE6OF02IDBUF.36.71.G05.1.454.CMB.1.raw
  modified_base (204)..(204): a, c, t, g, unknown or other
  misc_feature (204)..(204): n is a, c, g, or t
  modified_base (304)..(304): a, c, t, g, unknown or other
  misc_feature (304)..(304): n is a, c, g, or t
  modified_base (355)..(355): a, c, t, g, unknown or other
  misc_feature (355)..(355): n is a, c, g, or t
tcagtacgctgtctcacgaccggtgctcgatttagtgtcgtcgcaagagagaggggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccacctctcctgcagggccagtcagagtgttaacaataacttagcctaggtaccaacagaccacctggccaggcctcccaggcctcctcatctatggtncatccaggaggccagtggcactcccagactaggttcagtgcaggtgggtcngggacagacttcactctcaccatcagcacgactggagaccgtagaagtagttttgactagtgttattactgtcagtacagttagtcggtacgtcccgttcgggacggtacgggaccgaagggtggacgacgtacgaacgtaacgtggtacggcgtacgctacgtatccgttgtcttctacttcccg

SEQ ID NO: 166055 - DNA, 724 bp, Homo sapiens
  misc_feature: GYAE6OF02I1DGM.36.71.G05.1.454.CMB.1.raw
  modified_base (205)..(205): a, c, t, g, unknown or other
  misc_feature (205)..(205): n is a, c, g, or t
  modified_base (315)..(315): a, c, t, g, unknown or other
  misc_feature (315)..(315): n is a, c, g, or t
  modified_base (325)..(325): a, c, t, g, unknown or other
  misc_feature (325)..(325): n is a, c, g, or t
  modified_base (340)..(340): a, c, t, g, unknown or other
  misc_feature (340)..(340): n is a, c, g, or t
tcagtacgctgtctcacgaccggtgctcgatttagtgtcgtcgcaagagagaggggggaggaactgctcagttaggacccagacggaaccatggaagccccagcgcagcttctcttcctcctgctactctggctcccagataccactggagaaatagtgatgacgcagtctccagccaccctgtctgtgtctccgaaggggaaancgcccaccctctcctgcacgggccagtcagagtgttaacaattaacttagcctaggtaaccaacacgacaccgtggaccaaggcctcccgaggcctcctcatctagtggncactccacgnggccacgtggtaccncccgagcctaggttcaggtcggactagggttcgggtcgtagggaactaggttacttacccaaccttccgtaccaactacgtaccgaacgtacctaaccgtacgtacgtacgttacgtaacgtaaacgttacgttttacgtacgtttaacgtttaacgtttacgttacgtaaccgtagtacgtaacggttaacgttaacgttaacggtaacgtaccgggttacccggttaccggggtttaaccggtttaccgggaacccgggtaaccgggggtaaccgtaaccggtacgggttaacgggtaacggtaacggtaaccgtaaacggtaacggttacggttacggtaccggttacgaccgtaaccgtacgttaccggttacgttaccg

SEQ ID NO: 166056 - DNA, 550 bp, Homo sapiens
  misc_feature: GYAE6OF02GROLA.36.71.G05.1.454.CMB.1.raw
  modified_base (205)..(205): a, c, t, g, unknown or other
  misc_feature (205)..(205): n is a, c, g, or t
tcagtacgctgtctcacgaccggtgctcgatttagtgtcgtcgcaagagagaggggggaggaactgctcagttaggacccagacgggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttaacaatacttagcctggtaccaacagacacctggccaggcctcccaggcctcctcatctagtggtgcatccaccgagggcccacgtcggtactcccgagccaggttcagtggctaggtgggtctgggactaggacgttcactctacaccatcacgacaacctgctagtctagaagtattttgacttagtttattactgtcagtctagtataatagacgtacggccgtacgggtaacgtttcggccggacggggacctaggtcgtaggagtactacgaaacgtaacgtgtacggctcgaccactatctgttcc

SEQ ID NO: 166057 - DNA, 625 bp, Homo sapiens
  misc_feature: GYAE6OF02JWTIB.36.71.G05.1.454.CMB.1.raw
  modified_base (318)..(318): a, c, t, g, unknown or other
  misc_feature (318)..(318): n is a, c, g, or t
tcagtacgctgtctcacgaccggtgctcgatttagtgtcgtcgcaagagagagggggggaggaggaacccagcactagaagtcggcggtgtttccattcggtgatcagcactgaacacagaggactcaccatggagtttgggctgagctgggttttcctcgttgctctttaagaggtgtccagtgtcaggtgcaactggtggagtcgtgggggaggcgtgatccagccgtggggacggtccctgagactctccgtgtgcacgtcctcgtaggaatccgaccttacaaatagctagtcggcatgcctagtcgggtcccnccgaggcctccgaggcgacggggctggaggtgggtgtacttttattcattatgtagtggatagttataggaatacgtagtcgacagtaccgtaccggtaggaacgggccgtattaccgacctacgttacctaccgaagaacgtaactaacgttaccaaacgaacacgtacgtatacgtacgtacgaacgtaacgtagaacgaccgtaacgtcggtaaagtaggtagacggacgacggtacgtggttacgttagtaccgtgtcccggtccgtacccccggtagggtaacgtacggtacggtggtacgg

SEQ ID NO: 166058 - DNA, 703 bp, Homo sapiens
  misc_feature: GYAE6OF02IWW0C.36.71.G05.1.454.CMB.1.raw
  modified_base (122)..(122): a, c, t, g, unknown or other
  misc_feature (122)..(122): n is a, c, g, or t
  modified_base (224)..(224): a, c, t, g, unknown or other
  misc_feature (224)..(224): n is a, c, g, or t
  modified_base (239)..(239): a, c, t, g, unknown or other
  misc_feature (239)..(239): n is a, c, g, or t
  modified_base (252)..(252): a, c, t, g, unknown or other
  misc_feature (252)..(252): n is a, c, g, or t
  modified_base (324)..(324): a, c, t, g, unknown or other
  misc_feature (324)..(324): n is a, c, g, or t
  modified_base (439)..(439): a, c, t, g, unknown or other
  misc_feature (439)..(439): n is a, c, g, or t
tcagtacgctgtctcacgaccggtgctcgatttagtgtcgtcgcaagagagagggggggagaactagcgtcagttaggacccagacgggaaccatcggaacgccccaggccgcgagtcttcncttcctcctcgctactctcggctaccctagagtaccactgggacgaagtacgtgactgaccgtcagtctaccagccaccctgtctgtgtctccgaggggaangccacctctcctgcnggccagtcgacgntagtaacatacgttcgaccttaggaccacgacgtacgaccgtagaccacggtcctaccgaggacctccctanactactagtggtgcactcccacggccggcctagtgggttactccgacgcttaggtccaggtcgacgtacgttgggtactagggaaccaggtaccgttccacgtcctacacccgtntcccgacgacctaacctcgacgtacgtacgtaggtaacgttagttttagtacttaagtttacgtttacttcggttacctacgtactagttaacgtaagtacgtaacgtacggttaccgttaccgggttacggtttaccgggaccggtaacgggggaccgtaacgggtcggtacgggtaacggtaccgtaaccgtaaacggtaaccgttacgggtaccggtaccgtacccggtaccgtacccgtaacgttccgtccggtttaccc

SEQ ID NO: 166059 - DNA, 659 bp, Homo sapiens
  misc_feature: GYAE6OF02JVDI1.36.71.G05.1.454.CMB.1.raw
  modified_base (190)..(190): a, c, t, g, unknown or other
  misc_feature (190)..(190): n is a, c, g, or t
  modified_base (211)..(211): a, c, t, g, unknown or other
  misc_feature (211)..(211): n is a, c, g, or t
  modified_base (324)..(324): a, c, t, g, unknown or other
  misc_feature (324)..(324): n is a, c, g, or t
  modified_base (566)..(566): a, c, t, g, unknown or other
  misc_feature (566)..(566): n is a, c, g, or t
  modified_base (592)..(592): a, c, t, g, unknown or other
  misc_feature (592)..(592): n is a, c, g, or t
tcagtacgctgtctcacgaccggtgctcgatttagtgtcgtcgcaagagagaggggggagggaacgtgctcagttaggaccagacggaaccatggaagccccagcgcagcttctcttcctcctgctactctggctcccagactaccgactggagaaatagtgatgacgcaggtctccagccaccctgtcngtgtacctccgaaggggaaancgtccaccctctcctgacgacgggccctagtcaggtaggtacttaaaccataactttacgcctcggtaaccaacacgactacctgggccacggtcctccgacggctcctactntcgtactggcgacaacttcccaccgaacgggggcctaccttacgggaactccccaagcccggttagtacgtaggtacgggcccgtggttcggggtcgttcggggactacggtaacgggtttcacccttacccggttcaaccctagttcgacgactaccggtacacgtacgtacgttacgaagtttaacgttacgtacgttaggttaactttacgtacgtacgtacgtagtactagtatacgngtacgccgtacggtacgttcggaccncgggtaccagtccgagacgatacgaacgacgtacgtggtaccgttcggctacgtcgtagtcgttacc

SEQ ID NO: 166060 - DNA, 637 bp, Homo sapiens
  misc_feature: GYAE6OF02HA9I7.36.71.G05.1.454.CMB.1.raw
  modified_base (203)..(203): a, c, t, g, unknown or other
  misc_feature (203)..(203): n is a, c, g, or t
  modified_base (293)..(293): a, c, t, g, unknown or other
  misc_feature (293)..(293): n is a, c, g, or t
  modified_base (303)..(303): a, c, t, g, unknown or other
  misc_feature (303)..(303): n is a, c, g, or t
tcagtacgctgtctcacgaccggtgctcgatttagtgtcgtcgcaagagagaggggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttaaacaataacttagcctggtaaccaacagacacctggccaggcctcccaggctcctnatctatggtncactccacgacgggccacgtggtactcccgagcctaggttcaggtggctaggtgggtctagggacaggtacttccaacgttctacgaacctataccaacgacctaaccgtacgacgtacgttacgtagtaagttagttttcgacttaacggtttaattacgtgttactagtactaagttaactaagtagaaccgtacggtacccggttaccgggttaaccgttttacgggacccggtaacggggtaccaaggtccgtagggaacgtaagtaaccgtaaacggtaacgttcggtacggtaccgtacgaccgtaacctacgttacgtacgttaccg

SEQ ID NO: 166061 - DNA, 546 bp, Homo sapiens
  misc_feature: GYAE6OF02H4BDT.36.71.G05.1.454.CMB.1.raw
  modified_base (204)..(204): a, c, t, g, unknown or other
  misc_feature (204)..(204): n is a, c, g, or t
  modified_base (393)..(393): a, c, t, g, unknown or other
  misc_feature (393)..(393): n is a, c, g, or t
tcagtacgctgtctcacgaccggtgctcgatttagtgtcgtcgcaagagagaggggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagngccaccctctcctgcagggccagtcagagtgttaacaataacttagcctggtaccaacagacacctggccaggctcccaggctcctcatctatggtgcatccaccacgggccacgttggtatcccagccctaggttcagtggctaggtgggtctggggacagagttcacttctccacatcagccaactnacagtctagaagtatttgcttagtttattactgtcagcaagtataatgacacggtcctaccgggtactttcggaccgagggggccaaggtccgtaggagtaactaccgaaacggtactaggtcggtaccgtaggccaaccgtatccttgtacc

SEQ ID NO: 166062 - DNA, 828 bp, Homo sapiens
  misc_feature: GYAE6OF02HUANJ.36.71.G05.1.454.CMB.1.raw
tcagtacgctgtctcacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaacgtggtggagttcggtgggggaggcgtgactccgaggccgtgggacggtccctggacgactctccgtgtcgcgacgcccttcgtaggaaacttcctaacccttttacaaaacgttacggtaccttaagttcgggacctaagttcggccgtaaccggttcggggggtcccccgacccggaacgggtcccttaccccggaaggggtaaccggtaaacgggggggtccgttaaggggggtaacgggtttggggggggttacggttttaccgttttttttaaacggttttaccgtaaagttttaagtcgggtaagttaggggtaagttaaaatttaacggtttaaggaaaaacgttaccttaagtcggtaaccgtaacggttacccgttacggtacggggtaaccgggtaccggtaacttaccgaacctacttacccgaccgaacgtaacgtaaacctaaacgttaaacccgaaacgaaacctaacgtactacgttacttaccgtacgaactaaacgtacgtaacgaccgtaaacgtaggtaaggtagttaggacgacgtacggtcgttagttagttacttacgtcgtaccggtccccggttaccccggtagggtaacttacgggtaggttacggg

SEQ ID NO: 166063 - DNA, 562 bp, Homo sapiens
  misc_feature: GYAE6OF02F85GF.36.71.G05.1.454.CMB.1.raw
  modified_base (204)..(204): a, c, t, g, unknown or other
  misc_feature (204)..(204): n is a, c, g, or t
  modified_base (215)..(215): a, c, t, g, unknown or other
  misc_feature (215)..(215): n is a, c, g, or t
  modified_base (237)..(237): a, c, t, g, unknown or other
  misc_feature (237)..(237): n is a, c, g, or t
tcagtacgctgtctcacgaccggtgctcgatttagtgtcgtcgcaagagagaggggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagcccaccctntcctgcagggccagtcagagtnttaacaataacttgcctggtaccaacagacacctggccaggctcccaggctcctcatctatggtgcatccacgagggccacgtcgtactcccagccaggttcagtgcagtggtctgggacagtagtcactctcaccatcagccaactgctagtctagaagtatttcgctaagtttattactgtcagctagtaataagtgacgagtccgtacgggttaacgtttcggaccggtaaggggacctaaggtcgtagggaacgtaacgtaaccgaaaacggtaacgttacggtaggtccgtaggacctaccgtattaccgtcgtttaccg

SEQ ID NO: 166064 - DNA, 629 bp, Homo sapiens
  misc_feature: GYAE6OF02FLGFN.36.71.G05.1.454.CMB.1.raw
  modified_base (311)..(311): a, c, t, g, unknown or other
  misc_feature (311)..(311): n is a, c, g, or t
tcagtacgctgtctcacgaccggtgctcgatttagtgtcgtcgcaagagagaggggggggagaggagcccagcactagaagtcggcggtgtttccattcggtgatcagcactgaacacagaggactcaccatggagttttgggctgagcttggggttttcctcgttgctcttttaaggaggtgtccagtgtcaggtgcaactggtggagtcgtgggggagcgtgatccagccgtgggacgtccctgagactctcctgtgcagcctgtggaactccaccttcaatagctatggcatgctacgtcgggtcccncaggcctccgaggcgaaggggctgggagtggggtgtctttttatcatagtgagtggatatagttagaagtactagtcgacagtaccgtccggtaggaacgggtaccgtacttaccgacctactaccgtaccgacgaacgaaccttaaacgttaaccgaaacgaaccgaacgtacgtagtactactacgtaactaaagtacgaacgaccgtaaccgtaggtaagtagttaggacggacgacggtacgttaggttagttacgttacgttcggttccgtcccggttacccccggtaggggtaccgttacggtaggttacgg

SEQ ID NO: 166065 - DNA, 870 bp, Homo sapiens
  misc_feature: GYAE6OF02FGGX8.36.71.G05.1.454.CMB.1.raw
  modified_base (176)..(176): a, c, t, g, unknown or other
  misc_feature (176)..(176): n is a, c, g, or t
  modified_base (212)..(212): a, c, t, g, unknown or other
  misc_feature (212)..(212): n is a, c, g, or t
tcagtacgctgtctcacgaccggtgctcgatttagtgtcgtcgcaagagagagggggagaactgctcagttacggacccagacggaaccatggaacgccccagcgcagcttctcttcctcctgcctactcgtggctcccagactaccactggagaaatgtgatcgacgcagttccnccagccacctgtctagtcgtcctccgaagggaaacnccgccctacctctccgcgacgacggcctagtacgaagtacgttaacgtttaaaccaaccgtttaaccgttccggtacccgttaacgtaaacccctaaccgaaccggtacccgtaccccggtccggaccccgtaaccggtacccccgtaccccggtacggtccccttacccgttacctacgtttacgttaacgtcgtaccgtaccgtaaccgtacccggaaccggtaaccggtacccttacggttaccggttaacccctcccggtaaccggttacggtacggtttacggacggtaccgggttacggtacggggttaccgggtaccgaacggtaaccgttacggttaccttacccttaaccgtacccgtaacccaaccgttcgaccgacgtaccgaccgtcctacgtaccgttacgtagtaacgtttacgttacgtttacgttacgtttaactttaccgttacgtaacctaaccgtaacgtacgttaactacggtaccgttaccgttaccgttacccgtttaccgttaccggtaccggtaccgggacgggtaaccggtaacggtacggtaacggtaacgtaaccgtaaaccggtaaccggtacgttcggaaccgttcgtaacccgtacccgttacgttacgttaccgtttcccgtaaccg

SEQ ID NO: 166066 - DNA, 732 bp, Homo sapiens
  misc_feature: GYAE6OF02GJKI3.36.71.G05.1.454.CMB.1.raw
  modified_base (282)..(282): a, c, t, g, unknown or other
  misc_feature (282)..(282): n is a, c, g, or t
tcagtacgctgtctcacgaccggtgctcgatttagtgtcgtcgcaagagagaggggggaggaactgctcagttaggacccagacggaaccatggaagccccagcgcagcttctcttcctcctgctactctggctcccagatatcactggaagaaatagtgatgacgcagtctccagccacctatctgtgtcctcgaggagaaagacgcccacctctcgtggtacggctagtcagtagttgtagcagactaactacgccgtacggtacagacgaacgtaaccncggaccgtacggttcccgaggtcctacatcgatctagtggcgacactacccgacggacggacctacgtacggtacctaccgacgtaccttaacgttggcggtacgtagggtttcgggtacggtacgggtacgtacggtacgtttaccgaccgttaccgtaccaacctacgtaccgtaacgccgtacggtccctagtaccgtacgttacggtaacgtaaagtttcgtttacgtacgttttaaacgtttacgttaaccgttagttaaccgaaacgtttaacggtaacttaagtaccggttaccgtaccgggttaccttaccgttacggtttaacgggttacccggggacgggttaaccgggtacggtaagggttaccggaaacttaacccggtaaaccgtaaacggttacggttacggtaccggaccgttaccgaccctacgttacgttccg

SEQ ID NO: 166067 - DNA, 897 bp, Homo sapiens
  misc_feature: GYAE6OF02FZ47F.36.71.G05.1.454.CMB.1.raw
tcagtacgctgtctcacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgcttcttttaagaggtgtccagtgtaaggtgcaactggtggagtcgtggggggagcgtgatccagccgtgggagtcccctgagactctccgtggtcgcacgccttgtaggaactcctacccttacaaactagccttaagtggtactaacttcgaccgtacggtccggggttccccgccgacgggtcccttacccggaaggggacgaaacgggggggtccttagggggtaacggttgggggtttacggtttcctttttttaaaagtttccgaagtttaaggttacggaaggttgggtaaagttaatttaacggttaaggtaaaacgtaccttagttacggaccgacggttaccgtaccgggtaacggaacggggtacccgtaacgttacccgtaaaccctacgttacccgttaaccggaaacggtaacccgtaaaaccggttaaacctttaacccggaaaacggtaaacccgtacccggttaaaccgttaacggtttaaccttaccgttaaccggtaaaaccgtaaacgtttaaaccgggaaaccggtaacccgttaaacccggtaagtaacgggttaacggttaagggaaccgggtaaccggtaccggggtacgttttagggtaaccggtttaacgtttaaccggttccggtttacccgggtcccccgggtttaaccccccgggttagggggttaaacccgtaccggggtttacgggttccggtttaaaccggg

SEQ ID NO: 166068 - DNA, 873 bp, Homo sapiens
  misc_feature: GYAE6OF02I49FA.36.71.G05.1.454.CMB.1.raw
  modified_base (274)..(274): a, c, t, g, unknown or other
  misc_feature (274)..(274): n is a, c, g, or t
tcagtacgctgtctcacgaccggtgctcgatttagtgtcgtcgcaagagagagggggggaggaactgctcagttaggacccagacggaaccatggaagccccagcgcagcttctcttcctcctgctactctggctcccagataccactggagaaatagtgatgacgcagtctccagcccacctgtctgtgtctccgaggggaagacgcccaccctctcctgcgacgggccagtcagagttacgttaaactaataacttagcctaggtaaccaanacgtacaccgtcggaccgacggcctcccgaggcctcctactactccttagtggtcacctacgtacccgaccgacggggccctacgtacgggttacctaccccgacggccgtaacgggttaccgacgggtcgggtaccggtagggggttccggggtttaccgggtacggggtaacgtaacgggttaccggtttacccgaacccgtttacccgttaacccggtaaccctaaacggttacccgaaaccggtaacccctaaacccggttccgaacccggttacggtttaaccggtaaggttaaacgtttagttttaacggtacgttttaaacgtttttaacgtttacgttacgttaccggtaacgtaaccgttaaggtttaaacgttaacggtaccggtaaccggtacccggggttaacccgggtttaacccgggggtttaaccgggttttaccggggaaccccgggtaacggggggtaacccgtaacgggtacggtaacggggttaaccggtaaaccgtaaccggtaaaacccgggtaaccggttacggggtacggtaccgtacggtaacccgtacgttaccgttacgtttccgttaacccg

SEQ ID NO: 166069 - DNA, 573 bp, Homo sapiens
  misc_feature: GYAE6OF02HN860.36.71.G05.1.454.CMB.1.raw
  modified_base (203)..(203): a, c, t, g, unknown or other
  misc_feature (203)..(203): n is a, c, g, or t
  modified_base (266)..(266): a, c, t, g, unknown or other
  misc_feature (266)..(266): n is a, c, g, or t
  modified_base (328)..(328): a, c, t, g, unknown or other
  misc_feature (328)..(328): n is a, c, g, or t
  modified_base (331)..(331): a, c, t, g, unknown or other
  misc_feature (331)..(331): n is a, c, g, or t
  modified_base (369)..(369): a, c, t, g, unknown or other
  misc_feature (369)..(369): n is a, c, g, or t
tcagtacgctgtctcacgaccggtgctcgatttagtgtcgtcgcaagagagaggggggaggaactgctcagttaggacccagacggaaccatggaagccccagcgcagcttctcttcctcctgctactctggctcccagataccactggagaaatagtgatgacgcagtctccagccaccctgtctgtgtctccgaggggaancgccacctctcctgcagggccagtcagagtagttaaacaataacttagcctaggtaacccaangacacctggccaggcctccaggctcctcatcatgtgcatccaccaggaccagtgactccganccnggttcagtgcagtggctggacagtagtcactctcgacntcagtaccaacgtgactagtcgtagaacttagtttacgacgtaagtttacttactcgttcagacctaagttaataatacggtaacacggtccgttaccggttaacgtttccggaccggacgggggaaccaaggtcgtaggtacgaacgtaccgaaacggtacgttacgtcggtcgtaccgaccgtacctacgtctacgttaccg

SEQ ID NO: 166070 - DNA, 559 bp, Homo sapiens
  misc_feature: GYAE6OF02IFI5D.36.71.G05.1.454.CMB.1.raw
  modified_base (202)..(202): a, c, t, g, unknown or other
  misc_feature (202)..(202): n is a, c, g, or t
  modified_base (300)..(300): a, c, t, g, unknown or other
  misc_feature (300)..(300): n is a, c, g, or t
  modified_base (309)..(309): a, c, t, g, unknown or other
  misc_feature (309)..(309): n is a, c, g, or t
tcagtacgctgtctcacgaccggtgctcgatttagtgtcgtcgcaagagagagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttaacaataacttagcctggtaccaacagacacctggccaggctcccaggctcctcatctatggtncatccaccngggccacgtggtatcccagccaggttcagtggcaggtggtctgggacagagttcactctcacatcagcaacctgcagtctagaacgtagttttgtctagtttattacttgtacagcagtataactagacgaacggtcctaccgggtaacgttttcgggacgtacggggaccgtaacggcctagggagtaagtaccgaaacggtaacgttacgtacggtacgtacggacctaccgaacttccgtagttccg

SEQ ID NO: 166071 - DNA, 579 bp, Homo sapiens
  misc_feature: GYAE6OF02FWW22.36.71.G05.1.454.CMB.1.raw
  modified_base (202)..(202): a, c, t, g, unknown or other
  misc_feature (202)..(202): n is a, c, g, or t
  modified_base (411)..(411): a, c, t, g, unknown or other
  misc_feature (411)..(411): n is a, c, g, or t
  modified_base (428)..(428): a, c, t, g, unknown or other
  misc_feature (428)..(428): n is a, c, g, or t
  modified_base (460)..(460): a, c, t, g, unknown or other
  misc_feature (460)..(460): n is a, c, g, or t
tcagtacgctgtctcacgaccggtgctcgatttagtgtcgtcgcaagagagaggggggaggaactgctcagttaggacccagacggaaccatggaagccccagcgcagcttctcttcctcctgctactctggctcccagataccactggagaaatagtgatgacgcagtctccagccaccctgtctgtgtctccaggggaangccacctctcctgcagggccagtcagagtagttaacaataacttagcctaggtaccaacacgacaccgtggaccaggcctcccgaggcctccgtacatacctagtggtcgccgtattacccgaccgtacgggccctacgtcggtactccccgagtacccaggtttccaaggttggactagggtggtcgtggactagtacgttcacttcncgacagtcagacacgtnctagtcagtatagtttcgcttagtttatcgtntcagtctagtatagtacgacgacgtcgtaccggttacgttcgacggtacgggactacgtcgtaggacgtactaacgaacgtacgtagtcgtcgtcgacgtaccgtcttcgtcgttaccg

SEQ ID NO: 166072 - DNA, 726 bp, Homo sapiens
  misc_feature: GYAE6OF02GH763.36.71.G05.1.454.CMB.1.raw
  modified_base (205)..(205): a, c, t, g, unknown or other
  misc_feature (205)..(205): n is a, c, g, or t
  modified_base (297)..(297): a, c, t, g, unknown or other
  misc_feature (297)..(297): n is a, c, g, or t
  modified_base (308)..(308): a, c, t, g, unknown or other
  misc_feature (308)..(308): n is a, c, g, or t
tcagtacgctgtctcacgaccggtgctcgatttagtgtcgtcgcaagagagagggggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagcccaccctctcctgcagggccagcagagtagttaaacaataactagcctaggtaccaacagacacctggaccaggcctccaggcctcctnatcgatggtcncactccaccgagggacctagtggtactcccgaagccgtaggttaccaggtcgggactacgggttcggggtactaggggaactaggtaacgtttccaaccgtctaccaaccgtatccacggaccaaccgtcgtacgtacggttactacggtaaaggttacttttacggtacttaacggttttaactttaccgttagttaccgacgtacgtaaagttaacgttaacgtacggtaacgtacgggtacccggttaccgggttaacggttttacgggacccgggttaacgggggaacccgtaacgggtacggtaacgggtaacggtaaacggttaaaccggtaaaaccggtaaccggttacgggtacggttaaccggtacggttaaaccgttaacggttaccggtttacgttcgtttaacccg

SEQ ID NO: 166073 - DNA, 758 bp, Homo sapiens
  misc_feature: GYAE6OF02GXHLQ.36.71.G05.1.454.CMB.1.raw
  modified_base (212)..(212): a, c, t, g, unknown or other
  misc_feature (212)..(212): n is a, c, g, or t
tcagtacgctgtctcacgaccggtgctcgatttagtgtcgtcgcaagagagaggggggaggaactgctcagttaggacccagacggaaccatggaagccccagcgcagcttctcttcctcctgctactctggctcccagataccacgtggaagaaatagtgatgacgcagtctccagcccaccctgtctgtgtcctaccgaagggggaaacncgcccaccccttctcctgcgacgggccagtcaggagttacgttaaacaattaacgtacgtcctaggtaaccaacacgacaccgtggaccaggtcctaccccgacggtccttccctcgtaacttcgtagtggtcgacctactcccgaaccggacggccaacgttggtaccctcccgagtcctaggttacaggtcggaacgtggttcggggtacgtacgggtaacgacggttacgttaccgacttcccgaccaacctagtaccgaaccgtaccgtacgacgtaccgtacgtcgttaacgtaagtttcgtttacgacgtttaacggtttacgtttaacgtcgtactacgtaactaacggttaataacggtacgtaccggtaccgggttacccggtttaacccgggtttacggttaccgggtacccgggaaaggggtaccgtaacgggtccgggtaagggtaaccggtaacgtaaaccggaaacgggttaccgtagggttacccgggacttacgggaaccttacccgtagtttcccgtaacggtttaccc

SEQ ID NO: 166074 - DNA, 832 bp, Homo sapiens
  misc_feature: GYAE6OF02FPBEK.36.71.G05.1.454.CMB.1.raw
  modified_base (151)..(151): a, c, t, g, unknown or other
  misc_feature (151)..(151): n is a, c, g, or t
  modified_base (214)..(214): a, c, t, g, unknown or other
  misc_feature (214)..(214): n is a, c, g, or t
tcagtacgctgtctcacgaccggtgctcgatttagtgtcgtcgcaagagagaggggggaggaactgctcagttaggacccagacggaaccatggaagccccagcgcagcttctcttcctcctgctactctggctccagactaccagtgganaaatagtgatgacgcagtcctcgacgccctaccctgtctggtcgtcctaccggaaggggtaanccgaccctaccccgtccttccgtgacgacgggccctagtacaggtagttacgtaaactaagttaacgttacgccgtacgtaaaccaacgtacgtacctccgtacggccaaccggtcctacccgagtcctacccgtatacttacgtagtcgggtacacctaaccgtcccgaaccggacggtcccttaacggttacggttaaccctaccccggtacgtaccggttacggtttacgacggttacggacgtacgggggttccgggtaacggtcggggtaaacgtaacggttccgtttaacccggaccttacgtaacccgaaactacgtaccgtaacgtaccgtacgttacgacgtacggtacgttacgttaacgtttacgtttacgtaggtttaacgtttaccgttacggtacggtacctaacggtacctaaaggttaaacgttaacgaccggtaaccggttccggtaacccgggtttacggtttaaccggggttaccggtaacggggtaccgggtaaccgtacggttacggtaccgggaaagttaaccgtaaacgtaaccgggtcgttaccgggtacgtccctaccggtacctaccggttaccgttacgtaccgttaaccg

SEQ ID NO: 166075 - DNA, 570 bp, Homo sapiens
  misc_feature: GYAE6OF01DADS5.43.67.G01.1.454.CMB.1.raw
  modified_base (518)..(518): a, c, t, g, unknown or other
  misc_feature (518)..(518): n is a, c, g, or t
  modified_base (561)..(561): a, c, t, g, unknown or other
  misc_feature (561)..(561): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggatttccttgctgctatttaaaaggtgtccagtgtgaggtgcagttggtggaggtccggggggggcctggtaccgccgtggggggtcccttagactctcctgtgtaacctctggattcaccctcagtaacgtctggatgagctggttcccgccaggctccgagggaagggctgggagtgggtggccgtaataaaccgaaagtgagggtggacagtagactacgttgcacccgtgagaggcagatcgccatctcaagagatgattcgaagaaggcacgttgtaatctagacaaagtgaaacagccctagaacaatcggaagacaacgagccgtagtacttactgttccgcgacgggcctcggtacacnccgtataatgacttaggtgggacctacgggaaccctggtaccnccgtctccg

SEQ ID NO: 166076 - DNA, 652 bp, Homo sapiens
  misc_feature: GYAE6OF01CJNFJ.43.67.G01.1.454.CMB.1.raw
  modified_base (369)..(369): a, c, t, g, unknown or other
  misc_feature (369)..(369): n is a, c, g, or t
tcagtgtgagtagtcacgaccggtgctcgatttagagtatacatattgggtttggggggagaggagccccagccttgggattcccaagtgttttcattcagtgatcaggactgaacacagaggactcaccatggagtttgggctgagctggattttccttgctgctattttaaaaggtgtccagtgtgaggtgcagttggtggagtccgggggggcctggtaccgcctgggggtcccttagactctcctgtgtaacctctggattcaccctcagtaacgtctggatgagctggttccgccaggctccgagggaagggctggagtgggttgccgtataaaccaaagtgaggtgggacagtagactacgtncgaccgtacgagagacgacgatacgcgactctacaagagatagtatacgtagaaggacacgttagttatacttcgacgaaactagtaacgaacgaccgtacgtaacgaaactaacggtacgggaacgtaaccgaccgtacggtacgttaacgttacgtttaccgtcgtaccggacggtccggtaccgtaccggtacctaccgtaacgtaacgtaacgtacgttacggtacgggtaccgggaacccggtaccgggtacccgtacggtaccccgtcccgtacccg

SEQ ID NO: 166077 - DNA, 543 bp, Homo sapiens
  misc_feature: GYAE6OF01A120L.43.67.G01.1.454.CMB.1.raw
  modified_base (454)..(454): a, c, t, g, unknown or other
  misc_feature (454)..(454): n is a, c, g, or t
  modified_base (501)..(501): a, c, t, g, unknown or other
  misc_feature (501)..(501): n is a, c, g, or t
tcagtgtgagtagtcacgaccggtgctcgatttagagtatacatattgggtttggggggagaggagccccagccttgggattcccaagtgttttcattcagtgatcaggactgaacacagaggactcaccatggagtttgggctgagctggattttccttgctgctattttaaaaggtgtccagtgtgaggtgcagttggtggagtccgggggggcctggtaccgcctggggggtcccttagactctcctgtgtaacctctggattcaccctcagtaacgtctggatgagctggttccgccaggctccagggaagggctggagtgggttggccgtattaaaccaaagtgagggtggacagtagactacgtgcacccgtgagaggcagattcgcatctcaagagatgattcagaagcacgttgatctgcaaatgaacagcctgacaatcgagacncagccgtagtattactgttccgacgagggctcggtcacgtccgatangacttagtcgggaccagggtaccctggtccaccgtctacccg

SEQ ID NO: 166078 - DNA, 568 bp, Homo sapiens
  misc_feature: GYAE6OF01DU5CC.43.67.G01.1.454.CMB.1.raw
  modified_base (558)..(558): a, c, t, g, unknown or other
  misc_feature (558)..(558): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcagttggtggaggtccggggggggcctggtaccgccgtgggggtcccttagactctcctgtgtaacctctggattcaccctcagtaacgtctggatgagctggttccgccaggctcgagggagggctggagtgggttgccgtattaaaaccaaagtgagggtggacagtagactacgtgcaccgtgagaggcagattcgccatctcaagagatagattacgaagaaggctacgttgtatctagacaaatgaacacgcctagacaagtcgaggacacgacgccgttagtacttacgtcgttccgcgagggcctcggtcacgtccgataatcgactagttcgggacctacgggaaccctggtaccnccgtctcccg

SEQ ID NO: 166079 - DNA, 554 bp, Homo sapiens
  misc_feature: GYAE6OF01AVZMA.43.67.G01.1.454.CMB.1.raw
  modified_base (543)..(543): a, c, t, g, unknown or other
  misc_feature (543)..(543): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcagttggtggagtccgggggggcctggtaccgcctgggggtcccttagactctcctgtgtaacctctggattcaccctcagtaacgtctggatgagctggttccgccaggctccgagggaagggctgggagtgggttggccgtataaaaccaaagtgagggtggacagtagactagttgcaccgtgagaggcagattcgccatctacaagagatgattcagaaggcagtttgtatctgactaaatgaacagcctagacaatcgagacaacagccgtagtattactgttccgacacgggctacggtcacgtccgatactgactagtcgggacctacgggaccctggtccnccgttctcccg

SEQ ID NO: 166080 - DNA, 594 bp, Homo sapiens
  misc_feature: GYAE6OF01EJQ1Y.43.67.G01.1.454.CMB.1.raw
  modified_base (416)..(416): a, c, t, g, unknown or other
  misc_feature (416)..(416): n is a, c, g, or t
  modified_base (457)..(457): a, c, t, g, unknown or other
  misc_feature (457)..(457): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcagttggtggaggtccgggggggcctgggtaccgccgtggggggtcccttagactctcctgtgtaacctctggattcaccctcagtaacgtctggatgagctcggttccgccaggctccgaggggaggggctggaggtgggttggccgtaattaaaaccgaaagtgagggtggacaggtagactacgttgcgaccgtgagaggcagattcgccatctcaagngatgattcaagaaggctacgttgtatctagacaaatgaacngcctagacaagtcgagacacgacgccgttgtaacttacctggttcccgagacgggtcctcggtccaccgtccgaattaagtgtacgttaggtccggggacctaacgggtacccttgggtaccctaccggtcctcccg

SEQ ID NO: 166081 - DNA, 582 bp, Homo sapiens
  misc_feature: GYAE6OF01CDDA2.43.67.G01.1.454.CMB.1.raw
  modified_base (431)..(431): a, c, t, g, unknown or other
  misc_feature (431)..(431): n is a, c, g, or t
  modified_base (449)..(449): a, c, t, g, unknown or other
  misc_feature (449)..(449): n is a, c, g, or t
  modified_base (505)..(505): a, c, t, g, unknown or other
  misc_feature (505)..(505): n is a, c, g, or t
  modified_base (571)..(571): a, c, t, g, unknown or other
  misc_feature (571)..(571): n is a, c, g, or t
  modified_base (577)..(577): a, c, t, g, unknown or other
  misc_feature (577)..(577): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcagttgggtggaggtccggggggggcctgggtacccgccgtggggggtcccttagactctcctgtgtaacctctggattcaccctcagtaacgtctggatgagctggttccgccaggctccgaggggagggctggagtgggtggccgtaataaaaccgaaagtgagggtggacagtagactagtgcaccgtgagagcagattcgcatctcaagagatgattcgaaggaggcacgttntatctgacaaatgaacancctgaacaatcggaacggacaacgacgccggtagttaacttaccgtggttacccgngtacgggcctcgggtccacttcccgaataacgtgacttagtcgggaccacgggtaccctggtaccncccgtntcccg

SEQ ID NO: 166082 - DNA, 660 bp, Homo sapiens
  misc_feature: GYAE6OF01EL49W.43.67.G01.1.454.CMB.1.raw
  modified_base (513)..(513): a, c, t, g, unknown or other
  misc_feature (513)..(513): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcagttggtggaggtccgggggggcctggtaccgccgtggggggtcccttagactcctcctgtcgtaacctctggattccacctcagtaacgtctggatgagctcggttccgccaggcctccgaggggaaggggtcgtgggaggtggggttcggaccgtaagtaaaaccggaaagtggaagggtagggacaggtacgacgtacgttcgccaccggtgaggacgggcaggtacttaccgcctatcctacgaaagacgatagtacttacgaagggaacggtctaggtttgtatcgtagacaaatgaacagcctagactaagngacgacacgagtccgtatacttcgtcgtccgcgtacggtccgtacggtaccaaccggttaccgaagttaagtcggtaacgttacgggtttacgggggacccctaacgggggtaccccttgggtacccgtacccgttccttaccccgg

SEQ ID NO: 166083 - DNA, 633 bp, Homo sapiens
  misc_feature: GYAE6OF01D1IKN.43.67.G01.1.454.CMB.1.raw
  modified_base (190)..(190): a, c, t, g, unknown or other
  misc_feature (190)..(190): n is a, c, g, or t
  modified_base (425)..(425): a, c, t, g, unknown or other
  misc_feature (425)..(425): n is a, c, g, or t
  modified_base (448)..(448): a, c, t, g, unknown or other
  misc_feature (448)..(448): n is a, c, g, or t
  modified_base (470)..(470): a, c, t, g, unknown or other
  misc_feature (470)..(470): n is a, c, g, or t
tcagtgtgagtagtcacgaccggtgctcgatttagagtatacatattgggtttggggggggagaggagccccagccttgggattcccaagtgttttcattcagtgatcaggactgaacacagaggactcaccatggagtttgggctgagctggattttccttgctgcttattttaaaaggtgtccagtgngaggtgcagttggtgggaggtccgggggggctggtaccgccgtgggggtcccttagactctcctgtgtaacctctggattccaccctcagtaacgtctggatgagcgtcggttccgccaggctccgaggggaaggggctgggaggttgggttcggaccgtaattaaaaccgaaaggtgagggtggacaggtagactacgttgcaccgtgagagcaagacttcgcatctacaaganatgattcgagaacggctacgttntaatcgtagacaaaatgaaacncgacctagaacctaaagtacggaaggaaccacgacggtaccgttagttaactttacgtcgttcccgaggtacgggtcctcggtacaccgttccgaaattagtcgtaactacgggttcggggccctaaacggggtaacccctgggtaccctaccgtcgtacccg

SEQ ID NO: 166084 - DNA, 631 bp, Homo sapiens
  misc_feature: GYAE6OF01BYAPF.43.67.G01.1.454.CMB.1.raw
  modified_base (476)..(476): a, c, t, g, unknown or other
  misc_feature (476)..(476): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcaggttggtgggaggtccggggggggcctgggtaccgccgtggggggtcccttagactctcctgtgtaacctctggattccaccctcagtaacgtctggatgagctggttccgccaggctccgaggggaaggggctgggaggttggggttggaccgttaagttaaaaccgaaaggtggagggtggacagtagactacgttgccaccgtgagaggcagtagttcgccatctacgaaagagatgattcgaaggaaggctacgttgtatcgtagacaaatcgaanacgcctagaacaatcggaaggacacgacgccgttagtaacttacgtcgttcccgacgacgggtcctccggtactacgtccgaattaacgtggaaccgttaggttccgggggacccgtacgggaacccccgtgggtaccccaccgttccctacccg

SEQ ID NO: 166085 - DNA, 645 bp, Homo sapiens
  misc_feature: GYAE6OF01BZE49.43.67.G01.1.454.CMB.1.raw
  modified_base (274)..(274): a, c, t, g, unknown or other
  misc_feature (274)..(274): n is a, c, g, or t
  modified_base (391)..(391): a, c, t, g, unknown or other
  misc_feature (391)..(391): n is a, c, g, or t
  modified_base (455)..(455): a, c, t, g, unknown or other
  misc_feature (455)..(455): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcagttggtggaggtccgggggggcctggtaccgccgtgggggtcccttagactctcctgtgtaacctctggattcacctnagtacgtctggatgagctggttccgcaggctccgagggagggctggaggtgggttgccgtaataaaccgaaagtggaggtggacagtagactacgttgcaccgtgagagcagcttcncatctcaaagagatggattcgaaggaacggctacgttagtatccgtagaacaaattcggaaacncgtacctagaaccaagtaccgggaagaacacgacggtaccgttagttaacttaccgttcggttccggacgtacggggtacccttccgggtcctaaccgtacccgtaagttaaaccgttagaacccggttaggtttcgggggaaccctaacggggaaccccttgggtaccctacccgggtccttaccccgg

SEQ ID NO: 166086 - DNA, 622 bp, Homo sapiens
  misc_feature: GYAE6OF01BREIC.43.67.G01.1.454.CMB.1.raw
  modified_base (273)..(273): a, c, t, g, unknown or other
  misc_feature (273)..(273): n is a, c, g, or t
  modified_base (508)..(508): a, c, t, g, unknown or other
  misc_feature (508)..(508): n is a, c, g, or t
tcagtgtgagtagtcacgaccggtgctcgatttagagtatacatattgggtttggggggagaggagccccagccttgggattcccaagtgttttcattcagtgatcaggactgaacacagaggactcaccatggagtttgggctgagctggatttccttgctgctatttaaaaggtgtccagtgtgaggtgcagttggtggaggtccgggggggcctggtaccgccgtgggggtcccttaggactctcctgtgtaacctctggattcaccctnagtaacgtctggatgagctggttccgcaggctccgagggagggctggagtgggttgaccgtaattaaaaccgaaagtggagggtggaacgagtaagactagtgccgaccgtgagagcagtactcgctatctcgaagagatgattcaaggacggctacgttgtatctgacaaatcgaacacgtcctagaacaatacgaaggtacacgaagtccgtagtacttaacgtgttacccgngacggtccgtcggtaccaccgtaccgaattaagtacggtaccgttacgggttccgggggaaccctaaccggggtaaccccgttacgggttcccgaaccccgttcgttacccccg

SEQ ID NO: 166087 - DNA, 426 bp, Homo sapiens
  misc_feature: GYAE6OF01BFHKQ.43.67.G01.1.454.CMB.1.raw
  modified_base (388)..(388): a, c, t, g, unknown or other
  misc_feature (388)..(388): n is a, c, g, or t
  modified_base (411)..(411): a, c, t, g, unknown or other
  misc_feature (411)..(411): n is a, c, g, or t
  modified_base (416)..(426): a, c, t, g, unknown or other
  misc_feature (416)..(426): n is a, c, g, or t
tcagtgtgagtagtcacgaccggtgctcgatttagagtatacatattgggttggccgtattaaaaccaaaagtgagggtgggacagtagactacgttgcacccgtgagaggcagattcgccatctcaagagatgattcagaaggcacgttgtatctgcaaatgaacagcctgacaatcgaggacacagccgtgtattactgttccgcagggctcggtcactccgataatgactattggggccagggaccctggtcaccgtctcctcacgcctccaccaacgggcccatcggtccttccccctggccgccctgcctccgacggacgcacctccgagacgcacgagccggcccgtgggctcgcctggtacaaggctactccactctcacnctgacgcgggctggacaggccanatagnnnnnnnnnnn

SEQ ID NO: 166088 - DNA, 584 bp, Homo sapiens
  misc_feature: GYAE6OF01BOQ7P.43.67.G01.1.454.CMB.1.raw
  modified_base (444)..(444): a, c, t, g, unknown or other
  misc_feature (444)..(444): n is a, c, g, or t
  modified_base (465)..(465): a, c, t, g, unknown or other
  misc_feature (465)..(465): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcagttggtggagtccgggggggcctggtaccgccgtggggggtcccttagactctcctgtgtaacctctggattcaccctcagtaacgtctggatgagctggttccgccaggctccgagggaagggctggagtgggttgcgtataaaaccaaagtgagggtggacagtagactacgttgcaccgtgagaggcagattcgctatctcaagagatgattcagaagctacgttgtatctagacaaagtgaacngcctagacaatcgagacacgngcgtgtactttacgtcgttccgacgagggtcctcggtccacttacccggattaatcggtacttaggttcgggggaccctacggggtaaccccttgggtaccctacccggttcctacccg

SEQ ID NO: 166089 - DNA, 594 bp, Homo sapiens
  misc_feature: GYAE6OF01EPCC4.43.67.G01.1.454.CMB.1.raw
  modified_base (396)..(396): a, c, t, g, unknown or other
  misc_feature (396)..(396): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcagttggtggagtccgggggggcctggtaccgccgtggggggtcccttagactctcctgtgtaacctctggattcaccctcagtaacgtctggatgagctggttccgcaggctccgagggaaggggctggaggtgggttggccgtaataaaaccaaaggtggagggtgggacagtagactacgttgcacccgtgagagcagntcgcatctacaagagatgattcagaaggacacggtttgtatctgacaaatcgaacagacctagaaccaagtacgaggaacacgagtcccgtagtactttactcgttccgcgagggtcctccgggtcacccgttcgaattaagtgtacgttagttcgggggacctaacggggaacccttggaccctacggtccctcccg

SEQ ID NO: 166090 - DNA, 417 bp, Homo sapiens
  misc_feature: GYAE6OF01CEHAR.43.67.G01.1.454.CMB.1.raw
  modified_base (375)..(375): a, c, t, g, unknown or other
  misc_feature (375)..(375): n is a, c, g, or t
  modified_base (383)..(383): a, c, t, g, unknown or other
  misc_feature (383)..(383): n is a, c, g, or t
  modified_base (405)..(406): a, c, t, g, unknown or other
  misc_feature (405)..(406): n is a, c, g, or t
  modified_base (408)..(417): a, c, t, g, unknown or other
  misc_feature (408)..(417): n is a, c, g, or t
tcagtgtgagtagtcacgaccggtgctcgatttagagtatacatattgggttggccgtattaaaaccaaaagtgagggtgggacagtagactacgttgcacccgtgagaggcagattcgccatctcaagagatgattcagaaggcacgttgtatctgcaaatgaacagcctgacaatcgaggacacagccgtgtattactgttccgcagggctcggtcactccgataatgactattggggccagggaaccctggtcaccgtctcctcagcctccaccaagggcccatcggtcttccccctggcgcccctgctccaggagcacctccgagacgcacagccggccctgggcctgcctggtcaagctactccactacncacactgngcgggctggcaaggcgcatagnncnnnnnnnnnn

SEQ ID NO: 166091 - DNA, 678 bp, Homo sapiens
  misc_feature: GYAE6OF01B5GTA.43.67.G01.1.454.CMB.1.raw
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgctaattttaaaaggtgtccagtgtgaggtgcagttggtgggaggtccgggggggcctgggtaccgccgtggggggtcccttagactctcctgtgtaacctctggacttccaccctcagtaacgtctggatgagcgtggttcccgccaggctccgaggggaaggggctgggaggttgggttggaccgtaattaaaaccgaaaggtggagggtggaacaggtagactacgttgaccaccgtgagaggcagacttcgccatcctacaagagatgtacttacgaaggtaaagtcctaacgtttgtaattcgtagaactaaagtcgaaacacggccctaggaacaacgtacggaagaccaacgacggtcccgttagttacttacgtcggttacccgcgtacgggtccttaccgggtaccaccgttaccgaattaagtcggtaaccgttacgggtttaccggggacccgtaaacggggtaacccccttgggtaccccctaacccggttccgttaccccg

SEQ ID NO: 166092 - DNA, 789 bp, Homo sapiens
  misc_feature: GYAE6OF01D3R78.43.67.G01.1.454.CMB.1.raw
  modified_base (315)..(315): a, c, t, g, unknown or other
  misc_feature (315)..(315): n is a, c, g, or t
  modified_base (621)..(621): a, c, t, g, unknown or other
  misc_feature (621)..(621): n is a, c, g, or t
  modified_base (638)..(638): a, c, t, g, unknown or other
  misc_feature (638)..(638): n is a, c, g, or t
tcagtgtgagtagtcacgaccggtgctcgatttagagtatacatattggggtttggggggggagaggagccccagccttgggattcccaagtgttttcattcagtgatcaggactgaacacagaggactcaccatggagtttgggctgagctggtattttccttgctgacttaattttaaaaggtgtccagtgtgaggtgcaggttgggtgggacgggtccggggggggcctcgggtacccggtccggtcgggggggttccccttaggaccttccgttccgttgtacgtaacccttcgtggtactttccaccctnacgttaacgtcgtaggatcgtagtcgtcggttcccgccgaggtcctaccggagggggaaggggtcgtaggggtaggttcggggttacggtaaccgttaaacgttaaaaaccggaaaagggtttgggaaggggttacgggaacgtaacgggttaacggtaaccgtttaacggttcggacccggtaacccggttagggaacgggacgggactaacggttacttacccggacctacgttaccgtacgaaagtacggtaatacggtaacttacggaaacgggtacgaccgttacggtttagtactcgtanaaccgtaaatcgaaacncgacctagaactaagacggacgacacgtacggtaccgtatttaacgttaccgttcgtaccggacgacgggtcctccggtacctacgtaccgtaattaagcggttaacgtcgggtcggaccggtaccggacctaggacctacggccttaccg

SEQ ID NO: 166093 - DNA, 582 bp, Homo sapiens
  misc_feature: GYAE6OF01DGTRZ.43.67.G01.1.454.CMB.1.raw
  modified_base (182)..(182): a, c, t, g, unknown or other
  misc_feature (182)..(182): n is a, c, g, or t
  modified_base (275)..(275): a, c, t, g, unknown or other
  misc_feature (275)..(275): n is a, c, g, or t
  modified_base (353)..(353): a, c, t, g, unknown or other
  misc_feature (353)..(353): n is a, c, g, or t
  modified_base (380)..(380): a, c, t, g, unknown or other
  misc_feature (380)..(380): n is a, c, g, or t
  modified_base (392)..(392): a, c, t, g, unknown or other
  misc_feature (392)..(392): n is a, c, g, or t
  modified_base (397)..(397): a, c, t, g, unknown or other
  misc_feature (397)..(397): n is a, c, g, or t
  modified_base (569)..(569): a, c, t, g, unknown or other
  misc_feature (569)..(569): n is a, c, g, or t
tcagtgtgagtagtcacgaccggtgctcgatttagagtatacatattggggtttgggggggagaggagccccagccttgggattcccaagtgttttcattcagtgatcaggactgaacacagaggactcaccatggagtttgggctgagctggtattttccttgctgcttatttaaaaggtntccagtgtgaggtgcagttggtggaggtccggggggctggtaccgccgtgggggtcccttagactctcctgtgtaacctctggattcaccctnagtaacgtctggatgagtctggtccgcaggctacgagggaggctggagtggtcgacgtaataaacaagtgagggtganagtagactagtgcaccgtgagagcagnttcgctatctanagagntgattcagaacggctagttgatcgagactaatgaactgcctagaaccagcggaacgacaacgtggaccgttagtacttacgcgttaccgcgtaagggtcctcgggctaccgtaccggaataacgtcgtaacgttggttaccggggccctaaggggtaccccctgggtacccncccgtgtaccccg

SEQ ID NO: 166094 - DNA, 728 bp, Homo sapiens
  misc_feature: GYAE6OF01C4WP6.43.67.G01.1.454.CMB.1.raw
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgcttatttaaaaggtgtccagtgtgaggtgcagttggtgggaggtccgggggggcctgggtaccgccgtggggggtcccttagactctcctgtcgtaacctctggacttccaccctcagtaacgtctggatgagtctcggttcccgccgaggcctccggaaggggaaggggtcgtgggaggttggggttcggaccgttaaagttaaaaaccgaaaggtggagggtaggacaaggtagactacgtgcctaccggtgaggacggcagtacttccgacctatcctacgaaggagtagtgtattacgaaggtaacggaccttacggtttagtactcgtaggaactaaagtacgaaacctacgtcccgtagaactaacgtcggaacggtaccaacgtacggtcccgttagttaacgtttaccgttcgttacccggaggtaccgggtcccgttaccggtaccctaccgttacccggtaaattaacgtcggtaacggtttacgggtaaccggggaccccggttaaccggggtaccccttagggttaccccctacccggttcccgtaccccg

SEQ ID NO: 166095 - DNA, 611 bp, Homo sapiens
  misc_feature: GYAE6OF01BNR54.43.67.G01.1.454.CMB.1.raw
  modified_base (388)..(388): a, c, t, g, unknown or other
  misc_feature (388)..(388): n is a, c, g, or t
  modified_base (446)..(446): a, c, t, g, unknown or other
  misc_feature (446)..(446): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcagttggtggagttccgggggggcctggtaccgccgtggggggtcccttagactctcctgtgtaacctctggattcaccctcagtaacgtctggatgagctggttccgcaggctccgagggaggctggagtgggtggccgtaataaaccaaagtggagggtggacagtagactacgtgcaccgtgagaggcagnttcgcatctacaagagatgattcgagaagctagttgtatcgtgactaaagtcgaaacngcctagaacctaagtcggaaggacacgacggtccgttagttacttacgtcggttaccgacgtacggggtccttccgggtacctaccgttaccgaattaagtcggtaacttaggtccggggacccgtacgggtaaccccttgggtccctacccggtccttaccccg

SEQ ID NO: 166096 - DNA, 790 bp, Homo sapiens
  misc_feature: GYAE6OF01CGCD0.43.67.G01.1.454.CMB.1.raw
  modified_base (574)..(574): a, c, t, g, unknown or other
  misc_feature (574)..(574): n is a, c, g, or t
tcagtgtgagtagtcacgaccggtgctcgatttagagtatacatattggggtttggggggggagaggagccccagccttgggattcccaagtgttttcattcagtgatcaggactgaacacagaggactcaccatggagtttgggctgagctggtatttccttgctgctatttaaaggtgtccagtgtgaggtgcgtaggttgggtgggagggtccgggggggggcctcgggtacccggccggtcgggggggtcccttaggactctccgtgtcgttaacctcgtggtacttccgaccctctacgtaacgtcgtaggactggagtcgtcgggttcccgccgtacggccgtaccggaagggggaacgggggtcgtggggagggttcggggttacggtacccggttaaaacgttaaaaaccgaaaagggttacggtaagggggttacgggaacgtaggtaacggaacgttaacggttcgacccgtaccggtaggaacggacggacgagtacgttcgacctataccgtacgaaagacgtaacgtagtaactacggaaggaaacggtccttaaggtttntacgtacgtagaaactaaagtacgaacgtacgtaccgtaagaaccaaggtacggaacgaaccacgtaacgggtaccgttagttaaccttaccggttcggttacccggacgtacggggtcccttccggacctaaccggtaccgaaattacgcgtaacggttcgggtacccggggacccgtaacgggtacccctgggtccccacccggttcctccccg

SEQ ID NO: 166097 - DNA, 662 bp, Homo sapiens
  misc_feature: GYAE6OF01EEL7T.43.67.G01.1.454.CMB.1.raw
  modified_base (397)..(397): a, c, t, g, unknown or other
  misc_feature (397)..(397): n is a, c, g, or t
tcagtgtgagtagtcacgaccggtgctcgatttagagtatacatattgggtttggggggggagaggagccccagccttgggattcccaagtgttttcattcagtgatcaggactgaacacagaggactcaccatggagtttgggctgagctggattttccttgctgctattttaaagtgtccagtgtgaggtgcagttggtggaggtccggggggggcctggtaccgccgtggggggtcccttagactctcctgtgtaacctctggattccaccctcagtaacgtctggatgagcttggttcccgccaggcctccgagggaagggcgtggaggtgggtggaccgtaataaaaccgaaaggtggagggtggacaggtagactagtgcaccgtgagagnagatcgcatcacaagagatgatcgaagaaggctagttgtatctagaacaaatcggaaacacgtacctaggaactaacgtacggaaggtaccaacgtacggtacccgttagttaaccttttaccgtacggtttacccgcggtaaggggtcccttccgggtacctaaccgttacccggtaattaacgtacggttaaccgttagggtaccgggggtacccgaacgggggttaaaccccctgggttacccctacccggttcctccccgg

SEQ ID NO: 166098 - DNA, 684 bp, Homo sapiens
  misc_feature: GYAE6OF01ACLUZ.43.67.G01.1.454.CMB.1.raw
  modified_base (269)..(269): a, c, t, g, unknown or other
  misc_feature (269)..(269): n is a, c, g, or t
  modified_base (275)..(275): a, c, t, g, unknown or other
  misc_feature (275)..(275): n is a, c, g, or t
  modified_base (287)..(287): a, c, t, g, unknown or other
  misc_feature (287)..(287): n is a, c, g, or t
  modified_base (337)..(337): a, c, t, g, unknown or other
  misc_feature (337)..(337): n is a, c, g, or t
  modified_base (399)..(399): a, c, t, g, unknown or other
  misc_feature (399)..(399): n is a, c, g, or t
  modified_base (671)..(671): a, c, t, g, unknown or other
  misc_feature (671)..(671): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggtattttccttgctgtacttaagttttaaaaggtgtaccagtgtaggaggtgcgtagttgggtggacgggtccgggggggcctcggtaccgccgtcgggggtcctagactctcgtgtntacctntgtatccacctnagtacgtctggatgagtctggtccgcgagcctacggaggggaggcgtggnggtggtgaccgtaagtaaacgaaggtggagggtagacgagtagacgtacgtgaccgtaccgngaggacgacgagtacgtccgactacgtcctaagaacgagtaacgttaggaactttacggaaaggaaccggttcgtaacggttttcgaagttacgtaacggtaactaaaacggtcgaaacttacggtcccgttaagaaccgtaggtaccgaacggaactacggtacgtccgtagttaccgttactccggtcgacgtcggtacctcggtactacgacggtacttaaggtcgtagtacgggttaccgggaccgtaaccggtacctcgggtacccnccggttcctcccg

SEQ ID NO: 166099 - DNA, 677 bp, Homo sapiens
  misc_feature: GYAE6OF01D1J2S.43.67.G01.1.454.CMB.1.raw
tcagtgtgagtagtcacgaccggtgctcgatttagagtatacatattgggtttggggggggagaggagccccagccttgggattcccaagtgttttcattcagtgatcaggactgaacacagaggactcaccatggagttttgggctgagctggattttccttgctgcttattttaaaaggtgtccagtgtgaggtgcagttggtggaggtccggggggggcctggtaccgccgtggggggtcccttagactctcctgtgtaacctctggattccaccctcagtaacgtctggatgagctggttccgccaggctccgaggggagggctggagtgggttggccgtaataaaaccgaaagtggagggtggacagtagactacgtgaccaccgtgagaggcagattcgcctatctacaagagatagatttcgaagaaggctacgttgtacttctagaacaaagtcgaaactacgacctagaacctaagtcggaaggaacacgacgtacccggttagttaactttaccgttcggttacccgacggtaacggggtcccttaccgggtacctaacccgttacccggaaatttaaacgtcggtaaaccgtttaggttccggggggaacccctaacgggggtaaacccccttgggtaccccgtacccggttcccttaacccccgg

SEQ ID NO: 166100 - DNA, 616 bp, Homo sapiens
  misc_feature: GYAE6OF01A1SPH.43.67.G01.1.454.CMB.1.raw
  modified_base (366)..(366): a, c, t, g, unknown or other
  misc_feature (366)..(366): n is a, c, g, or t
  modified_base (520)..(520): a, c, t, g, unknown or other
  misc_feature (520)..(520): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcagttggtggaggtccggggggggcctgggtaccgccgtggggggtcccttagactctcctgtgtaacctctggattcaccctcagtaacgtctggatgagctggttccgccaggctccgagggaagggctgggagtgggttggccgtaataaaaccaaagtgagggtgganagtagactacgttgcaccgtgagagcagattcgcatctacaagagatgaacttcaaggaaggctaacggttgtaactcgtagacaaagtgaaactggacctagaaccaagtaccggaaggacacaggcccgttagtacttaacgtcgttcccgnacgggtcctcggtaccaccgtaccgtaataagtcgtaacttaaggttcggggaccctacggggaacccttcgggccctaacccggttccctacccg

SEQ ID NO: 166101 - DNA, 525 bp, Homo sapiens
  misc_feature: GYAE6OF01A9K63.43.67.G01.1.454.CMB.1.raw
  modified_base (304)..(304): a, c, t, g, unknown or other
  misc_feature (304)..(304): n is a, c, g, or t
  modified_base (477)..(477): a, c, t, g, unknown or other
  misc_feature (477)..(477): n is a, c, g, or t
  modified_base (479)..(479): a, c, t, g, unknown or other
  misc_feature (479)..(479): n is a, c, g, or t
  modified_base (484)..(490): a, c, t, g, unknown or other
  misc_feature (484)..(490): n is a, c, g, or t
  modified_base (492)..(500): a, c, t, g, unknown or other
  misc_feature (492)..(500): n is a, c, g, or t
  modified_base (502)..(525): a, c, t, g, unknown or other
  misc_feature (502)..(525): n is a, c, g, or t
tcagtgtgagtagtcacgaccggtgctcgatttagagtatacatattgggttggccgtattaaaaccaaaagtgagggtgggacagtagactacgttgcacccgtgagaggcagattcgccatctcaagagatgattcagaaggcacgttgtatctgcaatgaacagcctgacaatcgaggacacagccgtgtattactgttccgtagggctcggtcactccgataatgactagttggggccagggaaccctggtccaccgtctcctcagcctccaccaaggcccatcggtcctcccctggccnccctgcctccaggcgccacctccgagacgccacgacggccggccctggggcctcggacccgttcggtaccaacgggaccttacccgttacccaacttacctaccaaccgtaccgttcggaaacggtccggggtacgttacgggaccgaaaggggccaaccgtaagttaacggngngcgcnnnnnnncnnnnnnnnncnnnnnnnnnnnnnnnnnnnnnnnn

SEQ ID NO: 166102 - DNA, 613 bp, Homo sapiens
  misc_feature: GYAE6OF01EKYGY.43.67.G01.1.454.CMB.1.raw
  modified_base (399)..(399): a, c, t, g, unknown or other
  misc_feature (399)..(399): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcagttggtggaggtccgggggggcctggtaccgccgtggggggtcccttagactctcctgtgtaacctctggattcaccctcagtaacgtctggatgagctggttccgccaggctccgagggagggctggaggtgggttggccgtaattaaaaccgaaaagtggagggtggaacaggtagactacgttgcaccgtgagaggcagnttcgcatctacaagagatgattcgagaaggctacgtttgtatcgtagacaaagtcgaaactagcctagaacaagtcgaaggacacgacgccgttagtactttactcggttccgcgacgggtcctcgggtccaccgtcccgaattaaacgtggtaaccttaggttcgggggaccctacggggaaaccccttgggtacccacccggttcctacccg

SEQ ID NO: 166103 - DNA, 714 bp, Homo sapiens
  misc_feature: GYAE6OF01CG1VI.43.67.G01.1.454.CMB.1.raw
  modified_base (276)..(276): a, c, t, g, unknown or other
  misc_feature (276)..(276): n is a, c, g, or t
  modified_base (446)..(446): a, c, t, g, unknown or other
  misc_feature (446)..(446): n is a, c, g, or t
  modified_base (516)..(516): a, c, t, g, unknown or other
  misc_feature (516)..(516): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgctattttaaaggtgtccagtgtgaggtgcagttggtggaggtccgggggggcctggtaccgccgtgggggtcccttagactctcctgtgtaacctctggtattccaccctnacgtaacgtctggatgagtctcggttccgccacggtctccggaggggaagggggcgtgggtacggttggggttcggtaccgttaaagttaaaaaccgaaaggttggaagggtgggaacaggtagacgtacgttcgaccaccgtagagaggcagtattcgcctagtcctanaagagagtacgattacgaaggtacggactacggtttcgtagttaccgtaggaacctaaagtcgggaaacngaccctagaactaacgtcgaaggtacccgaagacggtacccgtagttacgtttacctcggtttccccggagtaccgggtccgtttaccgggacctaccgtacccgtaaagttaattccggtaaacgttcgggttacccggggaacccgaacggggttaacccccttgggaccccgtacccggttcccgttacccccgg

SEQ ID NO: 166104 - DNA, 732 bp, Homo sapiens
  misc_feature: GYAE6OF01A4RUW.43.67.G01.1.454.CMB.1.raw
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgctattttaaaggtgtccagtgtgaggtgcagttggtggaggtccgggggggcctggtaccgccgtgggggtcccttagactctcctgtgtaacctctggtattcaccctcagtacgtctggatgagcgtcggttccgccaggcctacgagggagggctggaggtgggttcggaccgttaattaaaaccgaaaggtggagggtaggacaggtagacgtacgtcgaccgtaccgtgacggaggcgagtacgttccgacctactactacgaaagtagtagtagtaacttacgaacggtaaacggtccgtaacggtttagttaactaccggttacggaactaaaacgttacggaaacctacggtacccttaaggaaccctaaacgtccgggaaacggaactaccgtaacgggtcccgtttaaggttacgtttaacccgttcgggttacccgacggtacgggtccttaccgggtacctaacccgtaccgtaaagttaacgtacggtaaccggttaggtccggggaacccgtaaccgggtaccccgtaggtcccgtaacccgttccgtacccg

SEQ ID NO: 166105 - DNA, 598 bp, Homo sapiens
  misc_feature: GYAE6OF01CB52I.43.67.G01.1.454.CMB.1.raw
  modified_base (421)..(421): a, c, t, g, unknown or other
  misc_feature (421)..(421): n is a, c, g, or t
  modified_base (426)..(426): a, c, t, g, unknown or other
  misc_feature (426)..(426): n is a, c, g, or t
  modified_base (428)..(428): a, c, t, g, unknown or other
  misc_feature (428)..(428): n is a, c, g, or t
  modified_base (444)..(444): a, c, t, g, unknown or other
  misc_feature (444)..(444): n is a, c, g, or t
  modified_base (457)..(457): a, c, t, g, unknown or other
  misc_feature (457)..(457): n is a, c, g, or t
  modified_base (463)..(463): a, c, t, g, unknown or other
  misc_feature (463)..(463): n is a, c, g, or t
  modified_base (512)..(512): a, c, t, g, unknown or other
  misc_feature (512)..(512): n is a, c, g, or t
  modified_base (585)..(585): a, c, t, g, unknown or other
  misc_feature (585)..(585): n is a, c, g, or t
tcagtgtgagtagtcacgaccggtgctcgatttagagtatacatattggggtttggggggggagaggagccccagccttgggattcccaagtgttttcattcagtgatcaggactgaacacagaggactcaccatggagtttgggctgagctggtattttccttgctgctattttaaaaggtgtccagtgtgaggtgcagttggtgggaggtccgggggggcctgggtaccgccgtgggggtcccttagactctcctgtcgtaacctctggacttccaccctcagtaacgtctggatgagcgtcggttccgcaggctccgaggggaaggggcgtgggaggtggggttggaccgttaaagtaaaaaccgaaagtggagggtggacagtagactacgtgcaccgtgagagcagatcgcatcanaaganangatcgagagctagttntatctgaataaangaaacngcctagaactaagcgaacgcaacgcggtctagttacttcgtcgtaccgngacgggtctacgcaaccgtacgtaataagtcgaacttacggtcggggacctaacgggtaaccctgggtacccncccggtcctcccg

SEQ ID NO: 166106 - DNA, 642 bp, Homo sapiens
  misc_feature: GYAE6OF01D6S69.43.67.G01.1.454.CMB.1.raw
  modified_base (460)..(460): a, c, t, g, unknown or other
  misc_feature (460)..(460): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgcttattttaaaaggtgtccagtgtgaggtgcagttggtggaggtccgggggggcctgggtaccgccgtgggggtcccttagactctcctgtgtaacctctggattcaccctcagtaacgtctggatgagctggttccgccaggctccgagggaaggggctggaggtgggttggccgtaattaaaaccaaagtggagggtggacagtagactacgttgcaccgtgagaggcagacttcgccatctacaagagatagattcgaagaagctacgttgtattcaggacaaagtgaaacngtacctgaaccaagtcggaacgtacaacgacgtccggttagttactttaaccgttcggttacccgcggtacgggtcccgttccggtacctaacccgttccgaagtttaactagtaccgttagggttcggggacccgtaacggggttaaaccccttgggtacccgtacccgttccgtaccccg

SEQ ID NO: 166107 - DNA, 774 bp, Homo sapiens
  misc_feature: GYAE6OF01CNSI6.43.67.G01.1.454.CMB.1.raw
  modified_base (487)..(487): a, c, t, g, unknown or other
  misc_feature (487)..(487): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggtattttccttgctgcttaagtttttaaaaaggtgtccagtgtgaggtgcaggttggtgggagggtccgggggggcctgggtaccggccgtcgggggtcccttagactctcctgtcgtaacctctggcttcaccctcagtaacgtcgtggatgagtcgtcggttcccgccgaggcctaccggagggggaacgggcgtggggaggttggggttcggaccgtaaataaaaccgaaaggtggagggtggacagtagactacgtgaccgaccgtgaggaggcagtacttccgacctatctacgaagagtatgtacttacgaaggaacggtctaaggtttntactacgtagaactaaagtacgaaacctacgacccgtagaaccgtaaacgtccggaaacgggtacctaaccggaacggttaccccggtttaagtttaaccgtttacccggttaccggttaccccgggacggttaacgggggtccccgttacccgggtacctacccgttaacccggtaaaattaaccggtacggttaaaccgtttacggggtaccgggggaaccccgtaaaccgggggttaacccccggttgggttaaccccgtaccccggttccccgttaacccccg

SEQ ID NO: 166108 - DNA, 456 bp, Homo sapiens
  misc_feature: GYAE6OF01AXCJF.43.67.G01.1.454.CMB.1.raw
  modified_base (440)..(456): a, c, t, g, unknown or other
  misc_feature (440)..(456): n is a, c, g, or t
tcagtgtgagtagtcacgaccggtgctcgatttagagtatacatattgggttggccgtattaaaaccaaaagtgagggtgggacagtagactacgttgcacccgtgagaggcagattcgccatctcaagagatgattcagaaggcacgttgtatctgcaaatgaacagcctgacaatcgaggacacagccgtgtattactgttccgcagggctcggtcactccgataatgactattgggccagggaaccctggtcaccgtctcctcagcctccaccaacgggcccatcggtccttcccccgtggccgcccctgcctccgaggacgccaccctccgagacgcacacgccggcccgtgggctcgccgtggtcgaacggactacttcccactactcaccactggacggccggggctacgggaccgaacgggccgacactaggnnnnnnnnnnnnnnnnn

SEQ ID NO: 166109 - DNA, 993 bp, Homo sapiens
  misc_feature: GYAE6OF01C5RCG.43.67.G01.1.454.CMB.1.raw
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggtattttccttgctgtacttaattttaaaaggtgtccagtgtgaggtgcaggttggtgggagggtccggggggggcctcggggtacccggcccggggttccgggttaccgtacgtaccgttcctcgtgttaccgtaccgttcgtacgttactacccgtaccctacgtaacggtacgtacggtaggtagtacggtacgttccggttcccggtcccggaccgtaccggtacccggtacggggaacgggggacggtcggggtacggggttaggggtttacggggtaccggtaaaccggtttaaaaaccgtaaaaacggtaaaggggtaggggtacgggggtaacggtaacgtaacggtaacgtaaccggtttaccggttacgaccccgtacggtacggaacggacggacgtacgtacgtacccgacgtactacgtaaaggaacgtaagtagtaacgtttacaaaccgggaaagggtaccgttaaccggttttagttacgtttacgtaccgtaaactaaaacgttaacgtaacgggaaaccccgtccggtttaaacgtaaacccggaaacgtttaaacccgggaaccgggggaaaccctaaacccgtcgggtaacccggggtttttaccttttaaacggtttaacccttcccggggtttacccggtcccccgggaggggtaaccccgggttttcccgtaaccctaaacccggtaacccgttaaaggtaattaaacccggtacggggttttaacggtacccgggggggttaacccgggaacccgtttaaacccccccgggtaggttcccccgggtttaaacccctccgtttaccccccggtaacccg

SEQ ID NO: 166110 - DNA, 644 bp, Homo sapiens
  misc_feature: GYAE6OF01DTYU8.43.67.G01.1.454.CMB.1.raw
  modified_base (284)..(284): a, c, t, g, unknown or other
  misc_feature (284)..(284): n is a, c, g, or t
tcagtgtgagtagtcacgaccggtgctcgatttagagtatacatattgggtttggggggggagaggagccccagccttgggattcccaagtgttttcattcagtgatcaggactgaacacagaggactcaccatggagtttgggctgagctggattttccttgctgcttaattttaaaaggtgtccagtgtgaggtgcagttggtgggagggtccgggggggcctgggtaccgccgtgggggtcccttagactctcctgtcgtaacctctggacttccaccctnagtaacgtcgtggatgagcttcggtccgcgaggcctccgaggggaggggctgggaggtgggttggaccgtaagttaaaaccgaaaggtggagggtggacaggtagacgtacgtgccaccgtgagagcagtactcgactatctacgaagacgtataggtaacttcgaaggtaaacggtcctaacggtttgtaactcgtagaaactaaatcgaaaccgagtcctaaggaacctaaggacgaacggacacgacgtccgttattacttacgtcgttccgcgtacggccttcgacctacgtacgatagtagtaccgttagggtcgggaccctaacgggaccccgttgtcccacccgttctacccg

SEQ ID NO: 166111 - DNA, 768 bp, Homo sapiens
  misc_feature: GYAE6OF01BT4JY.43.67.G01.1.454.CMB.1.raw
  modified_base (632)..(632): a, c, t, g, unknown or other
  misc_feature (632)..(632): n is a, c, g, or t
tcagtgtgagtagtcacgaccggtgctcgatttagagtatacatattgggtttggggggagaggagccccagccttgggattcccaagtgttttcattcagtgatcaggactgaacacagaggactcaccatggaggtttgggctgagctggtattttccttgctgtacttaattttaaaaggtgtccagtgtgaggtgcgtaggttgggtgggacgggtcccggggggggtcctcgggtacccggccggtcgggggtcccttagaccttctccgtgttcgtaacctcgtggtacttccaccctcgaacgtaaccgtctggactggacgtcgttcgggtcccgccgacggtccgtaccggaagggggaggggtcgtaggggagggttcggggttacggtaaccgttaaaacgtaaaaaaccgaaaggtgggaaggggtagggaacgtaaggtaagtaccgttacggtcgaccgtaaccggtggaaggacgggacaagtacgttccgacctatacccgtaagaaaggtagattaggaacttacggaagggaagtcctaaggttgtaaactcgtaagaaacctaaagcgaaaaccgcgtaccgtaacgaacgtaaacgtccggaaacgaacccnccgtaacggtcccgttattaaccgtacgtttcgacccgaggtacgggccgttaccgactaccgtaacgtataacgttcgaccggttaggccggggtaacccgaacggtacccgtagtaccctccgtccgtaccccg

SEQ ID NO: 166112 - DNA, 636 bp, Homo sapiens
  misc_feature: GYAE6OF01A2YGC.43.67.G01.1.454.CMB.1.raw
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcagttggtggaggtccggggggggcctggtaccgccgtgggggtcccttagactctcctgtgtaacctctggattcaccctcagtaacgtctggatgagctggttcccgccaggctccgaggggaagggctgggaggtgggttggaccgtaattaaaaccaaaggtggagggtggacagtagactacgtgcaccgtgagagcagatcgcatctacaagagatgattacgaggaacggctacggtttgtaactcgtagaactaaagtgaaaccaggcctagaacaagtacgacggaacacgacgtcgtagttacttacgttcgtccgacgtacgggtctaccgggtaccaccgttacccgaattaagtggtaaccttagggttaccggggaccccgtaaacggggtaacccccttgggtacccctacccggttccctaccccg

SEQ ID NO: 166113 - DNA, 664 bp, Homo sapiens
  misc_feature: GYAE6OF01ACY8O.43.67.G01.1.454.CMB.1.raw
  modified_base (198)..(198): a, c, t, g, unknown or other
  misc_feature (198)..(198): n is a, c, g, or t
  modified_base (304)..(304): a, c, t, g, unknown or other
  misc_feature (304)..(304): n is a, c, g, or t
  modified_base (354)..(354): a, c, t, g, unknown or other
  misc_feature (354)..(354): n is a, c, g, or t
  modified_base (522)..(522): a, c, t, g, unknown or other
  misc_feature (522)..(522): n is a, c, g, or t
  modified_base (651)..(651): a, c, t, g, unknown or other
  misc_feature (651)..(651): n is a, c, g, or t
tcagtgtgagtagtcacgaccggtgctcgatttagagtatacatattgggtttggggggggagaggagccccagccttgggattcccaagtgttttcattcagtgatcaggactgaacacagaggactcaccatggagtttgggctgagcgtggtagtttcctaggctgactagtttaaagtgtcagtgtgaggtgcnggttgggtggagggtccgggggggcctgggtaccggccggtcgggggtcccttaagcctctcctgtacgtacctcgtggtacttaccaccctcacgtaacgttcgnggtaagtgacgtctcggttcccgaccaggcgtaccgaagggggacggggngtaggggtaggtggggttacggtaccggttaaactaaaaaccgtaaagggtaggacgggtagggaactagtagaccgttagtcgaccgacggtaggagaaggcacggtactacggtcctaatacgtacgaagtaaggatcgtaatacggaagacgtacgtacggttanactgtagaactagtacgaaccgtagacgtaacagacgacgacgtacagtacgtctagttacgtcgtcgacgacggtagtccgtcgacctagacgtagtagtacgtagtcggtacggacgtacggtacgngtacctcgtctcg

SEQ ID NO: 166114 - DNA, 626 bp, Homo sapiens
  misc_feature: GYAE6OF01CW54A.43.67.G01.1.454.CMB.1.raw
  modified_base (409)..(409): a, c, t, g, unknown or other
  misc_feature (409)..(409): n is a, c, g, or t
  modified_base (417)..(417): a, c, t, g, unknown or other
  misc_feature (417)..(417): n is a, c, g, or t
  modified_base (446)..(446): a, c, t, g, unknown or other
  misc_feature (446)..(446): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcagttggtggagtccgggggggcctgggtaccgccgtggggggtcccttagacctctcctgtgtaacctctggattcacctcagtaacgtctggatgagctggttccgccaggctccaggggaagggctgggagtgggtggccgtaattaaaaccgaaaggtgagggtgggacaggtagactacgttgccaccgtgaagaggcagattcgcatcncaagagangattacaaggaggctaacgttgtacttgngaacaaatgaaacagcctagaaccaagtacgaaggacacgaacgtccgttagttaacttactggtttacccgacgtacggggtactccggacctaacgtcccgtaaagtaagtcggtaaccttaggttacgggggcctaaacggggaaccccttgggtacctaccccgttcgttaccccg

SEQ ID NO: 166115 - DNA, 759 bp, Homo sapiens
  misc_feature: GYAE6OF01C5ZJH.43.67.G01.1.454.CMB.1.raw
  modified_base (565)..(565): a, c, t, g, unknown or other
  misc_feature (565)..(565): n is a, c, g, or t
tcagtgtgagtagtcacgaccggtgctcgatttagagtatacatattgggtttgggggggagaggagccccagccttgggattcccaagtgttttcattcagtgatcaggactgaacacagagactcaccatggagtttgggctgagctggtaattttccttgctgtacttaattttaaaaggtgtccagtgtgaggtgcgtaggttgggtgggcgggtcccggggggggcctcgggtacccggccggttcggggggtcccttacgaccttctccgtgtacgtaacctcgtggtacttccaccctactacgtaacgttcgtggatggacgtcgtcgggttcccgaccgacggtcctaccgggaaggggaacgggggtcgtaggggtaggttcgggggttacggtaccgttaaaaacgttaaaaccgaaaaggtggaaggggttacggaacgtaaggtacgtacgttacggttcgaccgtaccggtaggaacggtacggacgtagtacgttccggactacgtactacgaagtagatagactacgaaggtacgtacgtagttatacncgtaacgaactaagacgtaacgactacgtacaacgtaacgtacggaacgacacgacggtccgttaattactaccggtcttaccggacgtacgggtccttcggaccctacgtaacccgtaaataccggttagtaccgtacggggtaccccgggaacgtaacccgggtacgtacccggtcctacccgtcctacccg

SEQ ID NO: 166116 - DNA, 623 bp, Homo sapiens
  misc_feature: GYAE6OF01DOJLG.43.67.G01.1.454.CMB.1.raw
  modified_base (521)..(521): a, c, t, g, unknown or other
  misc_feature (521)..(521): n is a, c, g, or t
  modified_base (610)..(610): a, c, t, g, unknown or other
  misc_feature (610)..(610): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgctatttaaaaggtgtccagtgtgaggtgcagttggtggagtccgggggggctggtaccgcctggggggtcccttaggactctcctgtgtaacctctggattcaccctcacgtaacgtctggatgagctggttccgccaggctccaaggggaggggctgggagtggggtggccgtaattaaaaccgaaagtggagggtggacaggtagactagttgcacccgtgagaggcagattcgccatctcaagagatagattacaaggaaacgcaacgtttgggttaaactcgttaggaacctaaatacggaaactacgtccctagaaccaaagtaccgaagggactaaccaggacccggttntaagttaccttggttaccgcgtaagggcctcgggtccaccgttaccgaataagtcgtactaggttgggaccctacgggaaccctggtcncccggttctcccg

SEQ ID NO: 166117 - DNA, 666 bp, Homo sapiens
  misc_feature: GYAE6OF01BOPP0.43.67.G01.1.454.CMB.1.raw
  modified_base (402)..(402): a, c, t, g, unknown or other
  misc_feature (402)..(402): n is a, c, g, or t
  modified_base (408)..(408): a, c, t, g, unknown or other
  misc_feature (408)..(408): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttcctgctgctattttaaaaggtgtccagtgtgaggtgcagttggtggaggtccgggggggcctggtaccgccgtgggggtcccttagactctcctgtgtaacctctggacttcaccctcagtacgtctggatgagctggttccgcaggctccgaggggaagggctggagtgggttggaccgtataaaccgaaagtggagggtgggacaggtagactacgtgacaccgtgagaggcagatcgcatcncaaganatgattcagaacggcacgttgtatcgtagacaaagtcgaaactacgaccgttagaacgtaaacgtcggaacggaaccaacgtaacggtccggttaagtaacctttacgttcggtttcccgagtacggggtccttaccgggtacgaccgttacccggaaattaaccgttaggaacgtttaacgggttacggggggacccctaaaccgggggttaacccccgttaggggttcccgtaaaccccgggttcccgtaaccccg

SEQ ID NO: 166118 - DNA, 681 bp, Homo sapiens
  misc_feature: GYAE6OF01B50Y2.43.67.G01.1.454.CMB.1.raw
  modified_base (281)..(281): a, c, t, g, unknown or other
  misc_feature (281)..(281): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggtattttccttgctgctattttaaaaggtgtccagtgtgaggtgcagttggtgggaggtccgggggggcctgggtacccggccgtgggggtcccttagactctcctgtgtaacctctggattccaccctnagtaacgtctggatgagcgtcggttcccgccacggcctaccggaagggggaagggggtcgtggggaggttggggttcggaccgttaaagttaaaaaccgaaaaagggtggaaggggtgggaacgaggtaagtaactacggttgaccgacccggtgacggaggcagacgttccgctactctacgaagagagtagattacgaaggaacggtctagtttgtatcgtagaacaaagtgaaaccgagcctagaacgtagtaccgaagacaaccgacggtccgttagttacttacgttcgttacccgcggtaacgggtccgttacggtccaccgtaccgtaattaagtgtaacgttacggtcggggaccgtaacgggtacccgtgggtaccctaccggtctacccg

SEQ ID NO: 166119 - DNA, 907 bp, Homo sapiens
  misc_feature: GYAE6OF01BVZYZ.43.67.G01.1.454.CMB.1.raw
tcagtgtgagtagtcacgaccggtgctcgatttagagtatacatattggggtttggggggggtagaggacgcccagccgtggatccccaagtgtttcattcagtgatcaggactgaacacagaggactcaccatggagtttgggctgagctggattttccttgctgctaattttaaaaggtgtccagtgtgaggtgctaggttgggtgggacgggtccggggggggtcctgggtacccggccggtcggggggtcccttagactcctccgtgtcgtaacctcgtaggtacttccgaccctcgaagtaaccgtcgtggattggacgtcgttcggttcccgccgacggtccgtaccggaagggggaacgggggcgtgggggtaacgggttgggggttacgggtaacccggttaaaacgttaaaaaacccggaaaaagggttcgggaagggggtacgggaacgtaaggtaacggtaaccgttaacggttcggacccgtacccgggtaggaacgggtacgggacgtaaggtacgttccggacctaagttccgaacgaaaggtaagtagttacggtaacgttaccggaaagggtaaccgggtaccttaacggtttgtaacttcgtaaggaaacctaaaagttcgaaacgtcgacccgtaaggaaacctaacgtaccgggaaacggaaccaacggtacgggtacccgtttaggtttaacttttaccggtttcgggaccccgtacgggtaacggggttcccgttaccgggttaacccgtaaacccgttaccgggttaaacttaaacggtcgggtaaaaccccgtttacgggggttacccggggaaaccccggttaaacccggggttaaccccgttccgggtacccccgttaacccggttccccgttaaaccccgg

SEQ ID NO: 166120 - DNA, 785 bp, Homo sapiens
  misc_feature: GYAE6OF01B9QFS.43.67.G01.1.454.CMB.1.raw
  modified_base (690)..(690): a, c, t, g, unknown or other
  misc_feature (690)..(690): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgcttatttaaaaggtgtccagtgtgaggtgctaggttgggtgggacgggtccgggggggccgtcggtaccggccgtcgggggtcccgttacgtactcgtcctcgtcgtaacctccgtcggtagttcctaccctactacgtaacgtcgtcgtagtgacgtacgtggttcccggtccgacggtccgtacccggtagggggaaacgggggtcggtggggtaggttcggggttcggggtaaccgtaaacgttaaaaaaccgtaaaagggtagggtaggggtacgggacgtaaggttacggaacttacggtcgaccgaccgtacggagacggcgagacgttcgacctactcgtacgaagagatgtaatcaaggtacggtactaacgtttcgtaagttcgtacgtaacgtaaactacgaactaacggtacccgtacgaacgaaaccgtacggaacggacctaaacggaaccgttacccggtagttaaaccttccggttagtcccggtaccggaacgggtccgttacccgggnttaaccccgtccggtaaaattaccgtacgtacggttacggtacggggtaccccgaacggtaaccccggttggtacccacccccgttcgtaccccg

SEQ ID NO: 166121 - DNA, 850 bp, Homo sapiens
  misc_feature: GYAE6OF01A2DB7.43.67.G01.1.454.CMB.1.raw
  modified_base (262)..(262): a, c, t, g, unknown or other
  misc_feature (262)..(262): n is a, c, g, or t
tcagtgtgagtagtcacgaccggtgctcgatttagagtatacatattgggtttggggggggagaggagccccagccttgggattcccaagtgttttcattcagtgatcaggactgaacacagaggactcaccatggagtttgggctgagctggattttccttgctgctattttaaaaggtgtccagtgtgaggtgcagttggtggaggtccgggggggctggtaccgccgtgggggtcccttagactctctgtcgtaacctntggacttcgaccctcagtacgtctaggatggacgcgttcggttcccgccgaggtcctaccggaagggggtaacggggtcgtggggtaggttggggttacggaccgttaaagttaaaaccgaaagggtggaacggggtagggactaaggtacgtaactacggtcgaccgaccggtggacggacggacaggtacttccggcctattaccgacgaaaggtacggattggtaacttacggaagggaaacggtccgttacggttagttacgtaccgttaggaaaccgtaaaggttaccgaaaccgtaggtaaccccggttaaggaaacccgttaaaggttacccgggaaaggaaaccccgtaaggtaacccggggttaccccgtttaaggggtttaaacccttttaacccgggttacggtttcccccgggaagttacccggggggtacccctttacccgggtaccgtaacccggtttaccccggaaatttaacccggttcggtaaacgttacccggggtttacgggggaccccggtaaaaccggggttaccccccgttagggtaaccccgttacccggtttccccgtacccgg

SEQ ID NO: 166122 - DNA, 618 bp, Homo sapiens
  misc_feature: GYAE6OF01CEGDE.43.67.G01.1.454.CMB.1.raw
  modified_base (275)..(275): a, c, t, g, unknown or other
  misc_feature (275)..(275): n is a, c, g, or t
  modified_base (384)..(384): a, c, t, g, unknown or other
  misc_feature (384)..(384): n is a, c, g, or t
  modified_base (511)..(511): a, c, t, g, unknown or other
  misc_feature (511)..(511): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcagttggtggagtccgggggggcctggtaccgccgtgggggtcccttagactctcctgtgtaacctgtggattccaccctnagtaacgtctggatgagctgttccgccaggctcgagggagggctggaggtgggttgccgtaataaaaccgaaagtgagggtggacagtagactacgtgcacccgtgagnggacagagttcacatctacaagagtatgatcgaagaaggcagttgtatcgtagactaaatgaaacacgactagaacaatacggaagaacaacgacgtacccgttagtacgttacgtcgtttacccgnggaacggtcctcgggtacccaccgtaccgtaaattatacggaaccgttaggtaccgggggacctaacgggggtaacccctaggttcccgaacccggttcgtaccccg

SEQ ID NO: 166123 - DNA, 752 bp, Homo sapiens
  misc_feature: GYAE6OF01CKTQ0.43.67.G01.1.454.CMB.1.raw
  modified_base (209)..(209): a, c, t, g, unknown or other
  misc_feature (209)..(209): n is a, c, g, or t
tcagtgtgagtagtcacgaccggtgctcgatttagagtatacatattggggtttggggggggagaggagccccagccttgggattcccaagtgttttcattcagtgatcaggactgaacacagaggactcacagtggagtttgggctgagctggtattttccttgctgtacttaattttaaaggtgtccagtgtgaggtgcaggttggngggacgggtccgggggggcctggtaccgcggtcgggggtcccttagctctcgtgtcgtaacctcgtggtacttccaccctatacgtaacgtcgtaggatgacgtcgtcggttcccgccgacggtcgtaccggaagggggacgggtcggtagggaggttcggggttacggtaaccgttaaacgttaaaaaccgaaagggtacggtagggggtacggaacgtaggtacggtaacgttacggtcgaccgtaccggtaggacggaggcgagtaactccgacgtactacgacgaaaggtagtacgtagtaacgttacgaacggtaacggctaacgggtttatacgtactacggaaactaagtaacgaacgtacgaccgtagtaactacggtacgaacgaaccgtaacgtacgtacccggttaattccgttacggtccgttacggacggtacggtctaacccggcgtaaaccgtccgtaataagtcggtaaccttggggtaacccgtacggacccgggttaacaccggtaccgtcccgtcgtaccccgg

SEQ ID NO: 166124 - DNA, 808 bp, Homo sapiens
  misc_feature: GYAE6OF01AQOF5.43.67.G01.1.454.CMB.1.raw
tcagtgtgagtagtcacgaccggtgctcgatttagagtatacatattgggtttggggggggagaggagccccagccttgggattcccaagtgttttcattcagtgatcaggactgaacacagaggactcaccatggagtttgggctgagctggtattttccttgctgacttattttaaaaggtgtccagtgtgaggtgcagttggtggacggtccgggggggctggtaccggccgtgggggtcccttagactctcctgtcgtaacctcgtggtacttccaccctcagtaacgtctaggatgacgtcgtggttcccgccgaggtccgtaccggaagggggaaggggtccgtggggaggttggggttacggtaccgtaaaagtttaaaaacccgaaaaggtgggaagggggtacgggaacgtaagggtaacggtaaccgttacggtttacggacccgtaacccggtggacggaacgggaccaaggtaccgttccgacccttaacgtcctaaaccgaaaggtaacgtattacggtaagtttaccgaaacgggtaacggtacgttaaccgggttttgttaaacttcgtaagggaaccttaaagtaccgtaaacgacgtaccccgttaaggaaacctaacggttacggaaaccgggtacaaccgtaacggtccgtttagtaacgtttaccgtcggttacccgagggtacgggtcccttacgggtacctaccggtacgtaataacggtcgtagttaccgggttaccgggaccgtaaacgggtaccccgttaggaccctcccggtcccgtacccg

SEQ ID NO: 166125 - DNA, 583 bp, Homo sapiens
  misc_feature: GYAE6OF01BN657.43.67.G01.1.454.CMB.1.raw
  modified_base (438)..(438): a, c, t, g, unknown or other
  misc_feature (438)..(438): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcagttggtggaggtccgggggggcctggtaccgccgtggggggtcccttagactctcctgtgtaacctctggattcaccctcagtaacgtctggatgagctggttccgcaggctccgagggagggctggagtgggttggccgtaataaaaccgaaagtgagggtggacagtagactacgttgcaccgtgagaggcagacttcgcatctacaagagatgtatcgaagaaggctacgttgtatcgngactaaatgaacagcctagaacaatcgagacacagccgtagtacttctcgttccgacgacgggtctaccggtctaccgtcgaattaagcgtaacttacggttcgggacccgtaagggtaacccctggtaccctcccgtcctcccg

SEQ ID NO: 166126 - DNA, 861 bp, Homo sapiens
  misc_feature: GYAE6OF01CKH39.43.67.G01.1.454.CMB.1.raw
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggtattttccttgctgcttaattttaaaaggtgtccagtgtgaggtgcgtaggttgggtgggacgggtccggggggggcctggtaccggccgtcggggggtccctagactctcctgtcgtaacctcgtggtacttccaccctcagtaacgtcgtggatgagtcgtcggttcccgaccgaggcctccggaaggggaacggggtcgtgggtaaggttcggggttacggtaccggttaaaacgttaaaaaccgaaaaggtcgggaaggggttagggaaacgtaaggtaggaaccgttacggttacggaccgtacccggtaggaacggtacggaccgtaggtaactttcccgacctaattaccgtaaccgtaaaaggtaacgtaacgttacggtaacgtttaccgaaagggtaaacggggttcctaacgggttttacgttaacttccgttaacggaaacgtaaagttacgaaaccgtacggtaccccttaaggaaacctaaacgtccggaaacgggaacctaaccggagtacccggttaagttaacctttacggttaccggtcccggagtacggggtaccttccggtaccgtaaccgttacccggaaagtttaaccgtacggttaaaccggttacgggtttaccgggggaaccccgttaaacgggggtaaaccccccgttggttaaacccccttccccggttcccttaaccccgg

SEQ ID NO: 166127 - DNA, 663 bp, Homo sapiens
  misc_feature: GYAE6OF01CV9VI.43.67.G01.1.454.CMB.1.raw
  modified_base (311)..(311): a, c, t, g, unknown or other
  misc_feature (311)..(311): n is a, c, g, or t
  modified_base (433)..(433): a, c, t, g, unknown or other
  misc_feature (433)..(433): n is a, c, g, or t
  modified_base (465)..(465): a, c, t, g, unknown or other
  misc_feature (465)..(465): n is a, c, g, or t
  modified_base (482)..(482): a, c, t, g, unknown or other
  misc_feature (482)..(482): n is a, c, g, or t
  modified_base (535)..(535): a, c, t, g, unknown or other
  misc_feature (535)..(535): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggtattttccttgctgcttattttaaaaggtgtccagtgtgaggtgcaggttggtgggaggtccgggggggcctgggtaccgccgtgggggtcccttaggactctcctgtcgtaacctctggattccaccctcagtaacgtctggatgacgcgtcggtccnccgaggcctaccgaggggaaggggctgggaggttgggtggaccgtaataaaaccgaaaggtggaggggtaggaacaggtagacgtacgtgacctacccggtggagtaggcagattcgcctanctacaagagactgattacaggtaagctagttntatcagaacaatgaacncgcctagacaagtcggaagacaacgacgtccgttataccgttcgtcgtccggngacgggtccttcgggtaccctacgtacccgtaaagttacgttcggtaaacgtttacggggttaccggggacccccgttaaacggggtaacccccgttgggacccgtaaccccggtttccctaccccgg

SEQ ID NO: 166128 - DNA, 825 bp, Homo sapiens
  misc_feature: GYAE6OF01BOQRR.43.67.G01.1.454.CMB.1.raw
  modified_base (330)..(330): a, c, t, g, unknown or other
  misc_feature (330)..(330): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggtattttccttgctgcttaagttttaaaaggtgtccagtgtgaggtgctaggttggtgggacgggtccggggggggcctcgggtacccggccggtcgggggtcccttagactcctcctgtacgtaacctcgtaggacttccaccctcaagtaacgtctggacttgcgtcgttcggtccncgacggtcctacgggagggacggtcgtagggtgggttcgggtacggtaaccgttaaaacgtaaaaaccggtaaggttaggggtaggggtaacgggaacgtaacggtaacgtaccgttacggtcgacccgtaccggtaggacggaggacgagttcgtaccgactactaccgtacgaaagtagaagttagtactacggaaacggacggtacgttaacgttagtacttcgtaacgaaactaaacgtacgaaacgcccgtcgtaaacgaacgttaacggtcggaaacgtaaccgaaccgtacgggtccgttttaaaccgttaacgttttaccggtcccgggttaacgaccgggttccgggtccgtttacccggaccttaacccggttacgaaaacgtttacgtaccggttaaagggttacccggggtaaacccggtacccgggtaaaccccgggttaccccggttaggtaacccccgttcccttccccggttaaccccg

SEQ ID NO: 166129 - DNA, 664 bp, Homo sapiens
  misc_feature: GYAE6OF01EA92F.43.67.G01.1.454.CMB.1.raw
  modified_base (480)..(480): a, c, t, g, unknown or other
  misc_feature (480)..(480): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggatttttccttgctgcttaattttaaaaggtgtccagtgtgaggtgcagttggtggaggtccgggggggctggtaccgccgtgggggtcccttagactctcctgtgtaacctctggacttccaccctcagtaacgtctggatgagctggttccgccaggcctaccgaggggaaggggcgtgggaggtggggttcggaccgtaaattaaaaccgaaaggtggagggtggaacaggtagacttacgtcgaccgaccgtgagaggacagacttccgcctatctacaagagatgattacgaagaagctagttgtatctagacaaatcgaaacncgcctagaacctaagtacggaagacaacgacgtccgttagttaacttcgtcgttacccgaggtacgggtcctccgggtacctaaccgttacccgtaaattaagtacggtaaccgttaacgggttcccgggggaacccgtaaccggggaaccccttcgggtacccctaacccgttccctaccccg

SEQ ID NO: 166130 - DNA, 789 bp, Homo sapiens
  misc_feature: GYAE6OF01BF546.43.67.G01.1.454.CMB.1.raw
  modified_base (181)..(181): a, c, t, g, unknown or other
  misc_feature (181)..(181): n is a, c, g, or t
  modified_base (261)..(261): a, c, t, g, unknown or other
  misc_feature (261)..(261): n is a, c, g, or t
  modified_base (273)..(273): a, c, t, g, unknown or other
  misc_feature (273)..(273): n is a, c, g, or t
  modified_base (624)..(624): a, c, t, g, unknown or other
  misc_feature (624)..(624): n is a, c, g, or t
tcagtgtgagtagtcacgaccggtgctcgatttagagtatacatattgggtttgggggggagaggagccccagccttgggattcccaagtgtttcattcagtgatcaggactgaacacagaggactcaccatggaggttttgggctgagctggtattttccttgctgtctatttaaaggtntacagtgtgagtgcagttggtggaggtccggggggcctggtaccgccggtgggggtcccttagactctcctgtgtacctntggattcacctnagtacgtctggactgagtcgtcggttcccgaccgacggccttacccggaaggggtaacgggggtcgttaggggaggttcgggggttacggacccggtttaaaattaaaaaacccggtaaagggttaccgggtaagggggttacgggaaccgtaaggttaacggaacgtttaacgggtttcggaccgtaaccccggttaggaacggacgggtccgtaacgggtaacctttccgacccggtaactttaccccgtaacggaaaggtacgtaggttagtaacttaccggaaggtaaaccggtcgttaacggtttgtaaacttacggtacgtaaccgttaaaagcgtaaaaccggngttaacccgtacgaacgtaacgtaaccggacgaacttacgacccgttacgttaacgttacgttaacgttccggttacgaccggtaggcctttccggacctcgttaaccgattacgtagtcgacggttccgggactaccgggtaccgtcgcctaccggtttcaccg

SEQ ID NO: 166131 - DNA, 667 bp, Homo sapiens
  misc_feature: GYAE6OF01CL1O6.43.67.G01.1.454.CMB.1.raw
  modified_base (340)..(340): a, c, t, g, unknown or other
  misc_feature (340)..(340): n is a, c, g, or t
  modified_base (492)..(492): a, c, t, g, unknown or other
  misc_feature (492)..(492): n is a, c, g, or t
  modified_base (577)..(577): a, c, t, g, unknown or other
  misc_feature (577)..(577): n is a, c, g, or t
  modified_base (586)..(586): a, c, t, g, unknown or other
  misc_feature (586)..(586): n is a, c, g, or t
tcagtgtgagtagtcacgaccggtgctcgatttagagtatacatattggggtttgggggggagaggagccccagccttgggattcccaagtgttttcattcgagtgatcaggactgaacacagaggactcaccatggagtttgggctgagctggtattttcctgctgtacttaatttaaaggtgtccagtgtggaggtgctaggttgggtcgggacgggtccggggggggtcctgggtacccggccggttcggggggttccccttaggacctctccctaggtacgttaacctcgtcggtacttccaccctcgaagtaacgtctggatgagtcgtggtccncgaggctccgaggggaggcgtaggagtggtcgaccgtaaataaaaccgaaaggtgagggtaggacaggtagactacgtgccgaccggtgacgaggacagacttccgactacgttcacgaaggatatagtatcgaaggtaacggctacggttnactctaggaacctaagtacgaacgacgcctagaactagacggaacgacctacgacgtccgttaagtacttaccgtgtaccccggngaaccggtntaccccggcaacggtcgaattagtgtaccgttagggtccgggaacgtcgggtaacccttgggaaccctccggtacctcccg

SEQ ID NO: 166132 - DNA, 663 bp, Homo sapiens
  misc_feature: GYAE6OF01BYTNM.43.67.G01.1.454.CMB.1.raw
  modified_base (204)..(204): a, c, t, g, unknown or other
  misc_feature (204)..(204): n is a, c, g, or t
  modified_base (417)..(417): a, c, t, g, unknown or other
  misc_feature (417)..(417): n is a, c, g, or t
  modified_base (439)..(439): a, c, t, g, unknown or other
  misc_feature (439)..(439): n is a, c, g, or t
  modified_base (463)..(463): a, c, t, g, unknown or other
  misc_feature (463)..(463): n is a, c, g, or t
  modified_base (474)..(474): a, c, t, g, unknown or other
  misc_feature (474)..(474): n is a, c, g, or t
tcagtgtgagtagtcacgaccggtgctcgatttagagtatacatattgggtttggggggggagaggagccccagccttgggattcccaagtgttttcattcagtgatcaggactgaacacagaggactcaccatggagtttgggctgagctggatttccttgctgctattttaaaagtgtccagtgtgaggtgcagttggtggnggtccgggggggcctggtaccgccgtggggggtccttagactctcctgtcgtaacctctggacttcaccctcacgtaacgtctggatggacgctcggttccgccaggcctccgaggggaaggggcgtagggagggttggggttggaccggttaaacttaaaaaccgaaaaggtggagggtagggacaggtagactacgttgaccaccgtgagnggcagctcgctatctacaaganatgaattcaagtaacgctacgttntaatcgactanaaatcgaactagacctagaaccaagtacggaaccgaactaccgaagtccggttagttacttacgttcgttacccgacgtacgggtccttccgggacctaccgtacgaaagttaacgtggtaccgttaggggttaccgggaccggtaaacccggggtacccttagggtaccctacccggtcccctacccg

SEQ ID NO: 166133 - DNA, 799 bp, Homo sapiens
  misc_feature: GYAE6OF01DYFTA.43.67.G01.1.454.CMB.1.raw
tcagtgtgagtagtcacgaccggtgctcgatttagagtatacatattgggtttgggggggagaggagccccagccttgggattcccaagtgttttcattcagtgatcaggactgaacacagaggactcaccagtggtaggtttgggctgagctggtattttccttgctgtacttaagttttaaaaggtcgtacctagtgtggaggtgcgtaggttgggtgggacggggtccgggggggcctcgggtaccggccgggttcgggggtcccttacgaccttcgtcctgtacgtaacctgtggtactcctacctcgaacgttacgtcgtggtatgacgtcgtcggttcccgaccgaggtccgtaccggaaggggacggggtcgtaggggtacgggttacggggttaccggtaaccgttaaaagttaaaaaccggtaaaagggtcgggaaggggtacggaacgtaggtaacgtacgttacggttcgaccgtacccggtaggaacggacggcgtaagtacgtaccgacctaactccgtaagaaaggtacgtaagtacgtaacgttacgaaggtaacggtccttaacggtttgtaactcgtacgtaactaaagtcgaaacctcgacctaggaacaacgtcggaacgtacgacgtacggtacgttatacgtttacgtcgtaccggacgtacggtccctacggtacctaaccggttcgtaaacgttagtaaggttacccgttaggggttaccccgggaaccggtaacccggtacccggttcggtacccgttacccgtcttaccccggg

SEQ ID NO: 166134 - DNA, 767 bp, Homo sapiens
  misc_feature: GYAE6OF01D0TIE.43.67.G01.1.454.CMB.1.raw
tcagtgtgagtagtcacgaccggtgctcgatttagagtatacatattggggtttggggggggagaggagccccagccttgggattcccaagtgttttcattcagtgatcaggactgaacacagaggactcaccatggagtttgggctgagctggattttccttgctgcttattttaaaaggtgtccagtgtgaggtgcaggttggtgggacgggtccggggggggcctcgggtaccggccggtcggggggtcccttagactctcctgtcgtaacctctggtacttccacctcagtaacgtctggatgacgtctcgggttcccgccgacggcctaccggaagggggaacggggcgtaggggtaggttcgggggttcggaccggttaaaagtttaaaaaaccgaaaagggttgggaacggggtaggggaactaggtaacgtacgttaacggttacggaccgtaacccggtaggaaggacggtacgaaggtacgttccggacctacttaccgtaacgaaaggagtaattgtaaactttcggaaaggtaaacgggtcgtaacggtttagttaacttgtacgaactaaaagtcgaaactaacgccgtagaacctaaagtcggaacgacaacgaacggtccgttaagttacttaaccgtcggttacccgcggtaacgggtccttccgggtaccaccgttacgtaattagtacgtagttaccgggttggggaaccccgtaacgggacccttagggccctccggttcctccccgg

SEQ ID NO: 166135 - DNA, 828 bp, Homo sapiens
  misc_feature: GYAE6OF01ER0T4.43.67.G01.1.454.CMB.1.raw
  modified_base (613)..(613): a, c, t, g, unknown or other
  misc_feature (613)..(613): n is a, c, g, or t
  modified_base (653)..(653): a, c, t, g, unknown or other
  misc_feature (653)..(653): n is a, c, g, or t
  modified_base (693)..(693): a, c, t, g, unknown or other
  misc_feature (693)..(693): n is a, c, g, or t
tcagtgtgagtagtcacgaccggtgctcgatttagagtatacatattgggttgggggggagaggacgccccagccttgggacttcccaagtgttttcattcagtgatcaggactgaacacagagactcaccagtggtaggtttggctggagtctcggttacttttcctgctagtactttaaagtttaaacggtctaccgtaggttggtacggaggttcggacgttagggttgggtaacggggtccgggggttcccgggggggttacctacggggtaccccgggtcccggggtttaccggggttaccccttaacggtccttcccgttacccggttaggttacccgtttaacccgtcggttacgttaccttaccccgacccgttacggtaaacgggttaccgttcgtaggtactcggaccggttccgttaccggttacccgccggacggtcccggttaacggggaacggggtacgggtcggttaggggtcgggtttacgggttaacgtaaaccgttaaaacgttaaaacggaagggttcgggaacggggttacgtaacgtagttaactaccggttaagtccgaccgacggttagacggtcgactaagtcgtaccncgtatacgagtaagtacgattacgtagtaagacggtacgngtttacgtatactgtaagactaagtacgagtacacgtaanacgtacgacgactagccgtagtacttgttaaccgtacgtcgccgaggtaccggtcacgtccctaattagaccgttagtacgttaccgtagggacccgtaaccgggaccttcccgtacctccggtccctccgtacg

SEQ ID NO: 166136 - DNA, 616 bp, Homo sapiens
  misc_feature: GYAE6OF01BB1MT.43.67.G01.1.454.CMB.1.raw
  modified_base (297)..(297): a, c, t, g, unknown or other
  misc_feature (297)..(297): n is a, c, g, or t
  modified_base (386)..(386): a, c, t, g, unknown or other
  misc_feature (386)..(386): n is a, c, g, or t
  modified_base (411)..(411): a, c, t, g, unknown or other
  misc_feature (411)..(411): n is a, c, g, or t
  modified_base (415)..(415): a, c, t, g, unknown or other
  misc_feature (415)..(415): n is a, c, g, or t
  modified_base (428)..(428): a, c, t, g, unknown or other
  misc_feature (428)..(428): n is a, c, g, or t
  modified_base (452)..(452): a, c, t, g, unknown or other
  misc_feature (452)..(452): n is a, c, g, or t
  modified_base (464)..(464): a, c, t, g, unknown or other
  misc_feature (464)..(464): n is a, c, g, or t
  modified_base (533)..(533): a, c, t, g, unknown or other
  misc_feature (533)..(533): n is a, c, g, or t
tcagtgtgagtagtcacgaccggtgctcgatttagagtatacatattggggtttgggggggagaggagccccagccttgggattcccaagtgttttcattcagtgatcaggactgaacacagaggactcaccatggagtttgggctgagcgtggtattttccttgcctcgacttaattttaaaaggtgtccagtgtgaggtgcgtaggttggtgggacgggtccgggggggcctgggtacccggccgtcgggggtccctagacctctccgtgtcgtaacctctggacttccaccctnagtaaccgtctggatgagcttcggtccgccaggcctccgagggaggctggagtgggtcgaccgtaagtaaaccgaagtggagggtgganagtagactacgtgccaccgtgacgngacngtctcgctatcanaagatactgattacgaagacggtntacgttgtactnacgactaaagcgacgtaagcctaagaacaacgtgaaacgcaacgacgtaccgtagtactcgtcgtaccncggacggtctacggccagtccgaatatcggaacttcgggtccgggactaccgggtaccctaggtccctaaccggtctacccgg

SEQ ID NO: 166137 - DNA, 868 bp, Homo sapiens
  misc_feature: GYAE6OF01B9LZK.43.67.G01.1.454.CMB.1.raw
  modified_base (610)..(610): a, c, t, g, unknown or other
  misc_feature (610)..(610): n is a, c, g, or t
  modified_base (791)..(791): a, c, t, g, unknown or other
  misc_feature (791)..(791): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccagtggaggtttgggctgagctggtattttccttgctgtactttaaagttttaaaaggtgtacctagtgttggaggtgtacgtaggtttgggtacgggtacggggtccggggggggtcctacgggtaccccggtccgggttcggggggttacccttaaggtcctccgttcctgttacgttaaccctgttacggtacttccgacccctcgtaacggttaacgttcgttacggagtacggtcgtccgttccgggttcccggaccggtacggtccgtaaccggggaacgggggttaacgggcggttgggggtaggggttcggggtttacggtaaaccccgttaaaagttaaaaaccggtaaagggttcggggtaaggggttacgggaacgtaaagggttacggtaaccgttacggttccgtaaccggtaccggtaggaacgtggaccgtagtacgtaccggactactcgtaacgaagtacgtntacgtaagtaacgaggtaaaccgtgtttaacgttggtaaacctgtaacgaaacgtaagttacgaaacgtacgccgtaaagtaaccgttaacgaccggaaaggacccttaaagggccgtttacgtaacgtttaccttacgtccggttaacgccgggtcgtcttacccgacgacgttaaacgngtttaagcgttaacgggtacgtttccggggaaacccgttaccgggaaccttccggggtacccttcccggtctaccgg

SEQ ID NO: 166138 - DNA, 926 bp, Homo sapiens
  misc_feature: GYAE6OF01BCOYH.43.67.G01.1.454.CMB.1.raw
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggtattttccttgctgtacttaagttttaaaaggtgtccaggtgtggaggtgcgtaggttgggtcggggacggggtcccgggggggggtccgttcggggtacccggtccgggttcgggggggttaccccttaggtaccttccgttccgttggttacgttaacccttcgttaggtacttcccgtacccgttctaacgttaaccggtcgtaggagtacggtacgtccgttcgggttcccgccgacgggtcctaccgggaagggggtaacgggggtcgtggggtagggttcggggttacgggtaacccgttaaaagttaaaaacccggtaaaagggttaggggtaacggggtacgggtaaccgtaagggttaacggtaaccgtttaaccgggttaccggcccggtaaacccggttagggaacgggtaacggggactaacgggtaccgtttacccggacctaaccgttaccgtaaacgaaaacggtaagtaacgttacgttaacgttacgggaaacgggtacggtaccgtttaacggtttagtaacccttcggtaacggaaaaccgtaaaggtaccgaaaacgtccgtaacccgtaggaaccgtaaacggtaccggaaccgtaacgaccggtacggttaccggttaagtttaacccgtttaccggttccgggtacccgacggtacccggtccgtacccggtaccttaccggtacgtatacgtacggtaacgttcgggtaccgggaccgtaccggacccgttggacccgtccgtccgtccg

SEQ ID NO: 166139 - DNA, 803 bp, Homo sapiens
  misc_feature: GYAE6OF01APUHY.43.67.G01.1.454.CMB.1.raw
  modified_base (668)..(668): a, c, t, g, unknown or other
  misc_feature (668)..(668): n is a, c, g, or t
tcagtgtgagtagtcacgaccggtgctcgatttagagtatacatattggggtttgggggggagaggagccccagccttgggattcccaagtgttttcattcagtgatcaggactgaacacagaggactcaccatggaggtttgggctgagcgtggtattttccttgctgtacttaattttaaaaggtcgtccgagtggtgaggtgcgtaggttggtgggacgggtccgggggggccgtcggtccggaaaccggtcgggggtcccgtacgtacgtccgttccgtgtacgtaccgtcgtcggtacttcctacccgtactaacgttaccgtcgtaggtagtacgtacgtacgttcggttcccgaccgacggtccgtacggacggggacgggtcgtgggtacggtgggtcggtaccgtaaacgtaaaaccgtaaaggtagggtacgggtacggagtacggtagtacgtacgtacgaccgtacgtggacgacggacgagtacgtccgactactacgtacgaagtacgagtagtacgtacgaggtaacgtcgttagttagtaactacggtacaaacgtaagtaaccgacgtacgtccgtacgaaacgttacgacgaccgtaaacgtaccgtacggttccgttaagttaacggttaccggtcgggttaaccccgngggtaaccgggtcccgttaacccgcgttaaaacccggttccggaaaattttaccggtacggaaaccgggtttcgggaccccgggggaacgtaaacccggttacccggtggtaaccccgtaccggttcccctaccg

SEQ ID NO: 166140 - DNA, 874 bp, Homo sapiens
  misc_feature: GYAE6OF01C4ATI.43.67.G01.1.454.CMB.1.raw
  modified_base (557)..(557): a, c, t, g, unknown or other
  misc_feature (557)..(557): n is a, c, g, or t
tcagtgtgagtagtcacgaccggtgctcgatttagagtatacatattggggtttgggggggagaggacgccccagccttgggattcccaagtgttttcattcagtgatcaggactgaacacagagactcaccatggtagtttggctgagctggtattttccttgtctgtacttaagttttaaaaggtgtccagtgtggaggtgcgtaggttgggtggtacggtccggggtcgggggtccgttcgggtacccggtcccggttcggggggttccccttaggaccttctccgttgtacgtaacctcgtggtacttccacccctacgtaacggtaacgtcgtggtagtgacgcgttcgggttccgaccggacggcctaccgggaaggggggaacgggggtgtcgggggtagggttacggggttacggtaaacccggtttaaaagttaaaaaaaccggtaaaaagggtgggaacgggggttagggaaccgtaaggtaacgtacgtacggttcgacccgaccggtagacgaggacagtattccgacataccgtagaaagagtntagacttcggaaagaacgggccttaagttgtaactcggtacaaataacgtacgaaaactcgaacccttaggaaacctaaggtccggaaaacgtacccgtaaacggccggttaacccgggttgttttaaaaccttccgggtcgttacccgggccgggtaacgggtcccggttacccggtacttaacccggtaaccgtaaaagttaacccgttacgggttaaccgttaaacccggggggtttaccggggggaaaccccggtaaaaccgggggttaaaccccccgtttcgggtccccccgtttaaaccggttaccccccg

SEQ ID NO: 166141 - DNA, 684 bp, Homo sapiens
  misc_feature: GYAE6OF01CQ3W9.43.67.G01.1.454.CMB.1.raw
  modified_base (270)..(270): a, c, t, g, unknown or other
  misc_feature (270)..(270): n is a, c, g, or t
  modified_base (281)..(281): a, c, t, g, unknown or other
  misc_feature (281)..(281): n is a, c, g, or t
  modified_base (308)..(308): a, c, t, g, unknown or other
  misc_feature (308)..(308): n is a, c, g, or t
  modified_base (372)..(372): a, c, t, g, unknown or other
  misc_feature (372)..(372): n is a, c, g, or t
  modified_base (385)..(385): a, c, t, g, unknown or other
  misc_feature (385)..(385): n is a, c, g, or t
  modified_base (392)..(392): a, c, t, g, unknown or other
  misc_feature (392)..(392): n is a, c, g, or t
  modified_base (396)..(396): a, c, t, g, unknown or other
  misc_feature (396)..(396): n is a, c, g, or t
  modified_base (525)..(525): a, c, t, g, unknown or other
  misc_feature (525)..(525): n is a, c, g, or t
  modified_base (577)..(577): a, c, t, g, unknown or other
  misc_feature (577)..(577): n is a, c, g, or t
  modified_base (657)..(657): a, c, t, g, unknown or other
  misc_feature (657)..(657): n is a, c, g, or t
  modified_base (668)..(668): a, c, t, g, unknown or other
  misc_feature (668)..(668): n is a, c, g, or t
tcagtgtgagtagtcacgaccggtgctcgatttagagtatacatattggggtttggggggggagaggagccccagccttgggattcccaagtgttttcattcagtgatcaggactgaacacagaggactcaccatggagtttgggctgagctggtattttccttgctgacttaattttaaaaggtgtccagtgtgaggtgcgtagttggtgggacgggtccgggggggcctggtaccggccgtgggggtccctagctctctgtctacctntgctccacctnagtaacgtctgagtgagtctcggtccncaggctcgagggaggcgtaggtggtggtcggtacgtaaactaaaaccgaaggtggagggtgtanacgtagactgtcncctacgngagngcagacttcgctacgtcgacgtagagtatgtaacttcgaaggttaggtaccgttacggtttagttacgtcgacgtaaactaaaagttcggaaacctcgtactaaggaacccgttaagacccgggaaaancccgtaaccgacgttacggtaacgtttacttaccgggttcttaaccccgggngtaacggtccgttccggacccgtacttaccgaaagtagttacgtaaccggttcgggtacggaccccgtaacgggtacccngggttaccccncccgttaaccgtcccc

SEQ ID NO: 166142 - DNA, 727 bp, Homo sapiens
  misc_feature: GYAE6OF01CI50Q.43.67.G01.1.454.CMB.1.raw
tcagtgtgagtagtcacgaccggtgctcgatttagagtatacatattggggtttgggggggagaggagccccagccttgggattcccaagtgttttcattcagtgatcaggactgaacacagaggactcaccatggagtttgggctgagctggtattttccttgctgtacttaagttttaaaaaggtgtaccgagtgtggaggtgcgtaggttggtgggaggtccggggggctcgggtaccgccgtgggggtccttagaccttctcctagtcgtaacctctggtattccaccctcacgtaacgtcgtagatacgatacgttcggtaccgccaggccgtaccggagggaacggggcgtgggagtcgggtacgtaccgtaaagtaaaaccgaaaggtggagggtacgaagagtagaccgttaggtcgaccgaccggtaggaagacggcgaacgtactaccggtcctaacgttagtacgaaaggtactaacgtagagttaacccgaaggtaacggtactaacgtttaggacttaacgtacgaaacgtaaaagtacgaaccacgggtaccctaagaaacccgaagtacggaaggaaccctagaccgtaccgttagttaaccttacgtcgtccgagacgggttcctacggacctacgtactaagtaagtcgtaaaccgttcggtcggggaaaccgtacgggttaaacccctggaaacccctcgtccctaacg

SEQ ID NO: 166143 - DNA, 771 bp, Homo sapiens
  misc_feature: GYAE6OF01CQTPY.43.67.G01.1.454.CMB.1.raw
  modified_base (625)..(625): a, c, t, g, unknown or other
  misc_feature (625)..(625): n is a, c, g, or t
  modified_base (687)..(687): a, c, t, g, unknown or other
  misc_feature (687)..(687): n is a, c, g, or t
  modified_base (709)..(709): a, c, t, g, unknown or other
  misc_feature (709)..(709): n is a, c, g, or t
  modified_base (754)..(754): a, c, t, g, unknown or other
  misc_feature (754)..(754): n is a, c, g, or t
tcagtgtgagtagtcacgaccggtgctcgatttagagtatacatattggggtttgggggggagaggagccccagccttgggattcccaagtgttttcattcagtgatcaggactgaacacagaggactcaccatggagtttggctgagctggtattttccttgctgacttatttaaaagtgtcagtgtgaggtgcagttggtggaggtccggggggcctggtaccgccgtcgggggtccctagactctccgtgtcgtaacctctggtacttccaccctctagtaacgtctggatgagtctggttcccgcgacggcctaccggaggggaacggggcgtggggtaacggttgggttacggaccgttaaaacgttaaaacccgaaaagggttggaacggggtacggaacgtaaggtacgtaaccgttaccggttcggacccgtaacccggttggaaacggacggggtacccgtaaggtaccgtttacccggacccttaacgtaccgtaaccgaaaaggtagtaacgttaaggtacttaacggaaggtaaacggtccttaacggtttaggtacttcgtaacggtaactaaagtccgaaaacgtaccggtacgtaacggaacgttaaacnccggggaaacgaccgtaacgaccggtacccgttaagggttaccttacggttcgttacccggngtaacgggtccctacgtaaccncgttaccgaatagtacgtacgttaggcgggacctacgtacccgtnacccggtcctcgtaccc

SEQ ID NO: 166144 - DNA, 869 bp, Homo sapiens
  misc_feature: GYAE6OF01CXMSJ.43.67.G01.1.454.CMB.1.raw
  modified_base (624)..(624): a, c, t, g, unknown or other
  misc_feature (624)..(624): n is a, c, g, or t
tcagtgtgagtagtcacgaccggtgctcgatttagagtatacatattggggtttgggggggagaggagccccagccttgggattcccaagtgttttcattcagtgatcaggactgaacacagagactcaccagtggaggtttgggctgagctggtattttccttgctgtacttaagtttaaaaggtcgtccgagtgtggaggtgcgtaggttgggtgggtacgggtcccggggggggtccttcgggtacccggtccgggtcggggggttcccttaacgtccgttcctccgttgtacgtaacctcgtcggtacttccaccctcaacgtacgtcgtaggatggacgtccgttcggtccgcgacggtcgtaccgggaaggggacggggtcggtagggacgggttcggggttacggtaaccgttaaaacgtaaaaaccggtaaagggtgggtaaggggttaggaacggtaaggttaacggtaacgttaccggttacggccgtaacccggtaggaacgggtacggaccgtagtaacgtcccgtacctaagttacctaagaaggtaagtacgttaggtacgtaacggaacgggtaaccggtcgttacgtttagtaaccgtcggtttaaanaacgtaaatacccggaagtaacccgtacgaaccgaacgttaagacgggaaacgaccgtaacggaaccggtttaccgttagtaaacgtttccggtccggttaccggacggtaaccggggtccttacccgggtaccgtaaacccgtaggttaacccgtaagttacggtaacggtttaccgggggtacccgggaacccgttaccggggtaacccctttgggaaccccgttaccccggtttctaccccg

SEQ ID NO: 166145 - DNA, 658 bp, Homo sapiens
  misc_feature: GYAE6OF01DNT7F.43.67.G01.1.454.CMB.1.raw
  modified_base (184)..(184): a, c, t, g, unknown or other
  misc_feature (184)..(184): n is a, c, g, or t
  modified_base (333)..(333): a, c, t, g, unknown or other
  misc_feature (333)..(333): n is a, c, g, or t
  modified_base (348)..(348): a, c, t, g, unknown or other
  misc_feature (348)..(348): n is a, c, g, or t
  modified_base (397)..(397): a, c, t, g, unknown or other
  misc_feature (397)..(397): n is a, c, g, or t
  modified_base (409)..(409): a, c, t, g, unknown or other
  misc_feature (409)..(409): n is a, c, g, or t
  modified_base (441)..(441): a, c, t, g, unknown or other
  misc_feature (441)..(441): n is a, c, g, or t
  modified_base (476)..(476): a, c, t, g, unknown or other
  misc_feature (476)..(476): n is a, c, g, or t
  modified_base (494)..(494): a, c, t, g, unknown or other
  misc_feature (494)..(494): n is a, c, g, or t
  modified_base (645)..(645): a, c, t, g, unknown or other
  misc_feature (645)..(645): n is a, c, g, or t
tcagtgtgagtagtcacgaccggtgctcgatttagagtatacatattggggtttggggggggagaggagccccagccttgggattcccaagtgttttcattcagtgatcaggactgaacacagaggactcaccatggagtttgggctgagctggtattttccttgctgcttattttaaaaggtntccagtgtgaggtgcaggttgggtgggacgggtccggggggggcctcgggtaccgccggttggggggtcccttaggaccttctcctgtcgtaacctcgtcggacttcaccctgaacgtaacgtcgtggactggacgtctcggtccacgngcctcgaggggaggntgggtagtgggtcggaccgtaagtaaaacaaggtggagggtgacagtanactgtgcacggngagaggcagtactcgcatcgatagatacgtanaacgttcaaggaccgtactacgttgtacttcgtanaacaagttcgaaacgtcncgtagaactacgacggacaacgacgtacggtaccgtttaggtaccctgggttactcccggagtaacgggccttacgggactaccgaacggtaatagtcgggtaacttcggggttaccgggaccttaaacgggggtacccttggttaccccncgttcccgtaccg

SEQ ID NO: 166146 - DNA, 1005 bp, Homo sapiens
  misc_feature: GYAE6OF01AM7N0.43.67.G01.1.454.CMB.1.raw
  modified_base (174)..(174): a, c, t, g, unknown or other
  misc_feature (174)..(174): n is a, c, g, or t
tcagtgtgagtagtcacgaccggtgctcgatttagagtatacatattgggtttggggggggagaggagccccagccttgggattcccaagtgttttcattcagtgatcaggactggaacacagaggactcaccagtggtaggttggtcgtgagtcgtggtattttccttcggtntggtacctttaagttttaaaagggtcgttaccaggttggtgagggttgcgtaggttggtggggtacggggttcccggggggggccttacggggtaccgtccgggtcggggggtcccttagacgttcctaccgtgtcgtacctgtggtacttcacctctaacggttaaccgtcgtaggacttaggagtaccgtccggttaccgacgtaacggcctaccggggagggggaacggggtacggtacgggtacgggttaccggggtacggtaaccggttaaacggtttaaaaacccggtaaaggggttcgggaagggggtttacgggaaacgtttagggtaacccgtaacggtttaccggtccggtaccggtaacccgggtaggaacgggaacgggttacgaaggtccgtttacggaccctaacgttaccgtaacccgggaaaagtaggtaacgtaacggtaacgtaacgggtaacgggtaaacccgtcgttaacggggtttaccttaaacgggttccgttaaaggtaacccgtaaaaacggttccgtaaaaaccgggttcccggtaaacctaacgggtaaccgtaaacggttaccgggaacccgggtaaacttacccggggaacccgggtttaaccgttaaccgggtttaaaccgtttccgggtttaacccgggtaccggggtaacccggtacggggttaaccccggtttacgacccggttaacccccgttaaggtaaacggttacggttacctaaacggggttttccggggaaccgtaaaccggggttaccggtaccggttcccgtaacccgggtcccgtttccgtacccccgg

SEQ ID NO: 166147 - DNA, 901 bp, Homo sapiens
  misc_feature: GYAE6OF01DGCF4.43.67.G01.1.454.CMB.1.raw
  modified_base (586)..(586): a, c, t, g, unknown or other
  misc_feature (586)..(586): n is a, c, g, or t
  modified_base (751)..(751): a, c, t, g, unknown or other
  misc_feature (751)..(751): n is a, c, g, or t
tcagtgtgagtagtcacgaccggtgctcgatttagagtatacatagttggggtttgggggggagaggacgccccagccgttgggacttcccaagttgttttcattcagtgatcaggactgaacacagaggactcaccagtggtaggtttggctgagcttggtattttccgttgctgacttaagttttaaaaggtgtacctagtgtagtagggtgcgtaggttgggtcgggtacggggtcccgggggggcctcgggtacccggtcgggttccgggggttaccttaaggcctccgtccgttgtaccgttaaccgtcgtacggtacttcccgacccgttacgtaacgttaacgtcgtaggagttgaaggtccggttcgggtccgtaccgacggccgaacgggaacggggggtaacgggtcggtaggggtacgggttacggggtttacggtaaaccggttaaaaacgttaaaaaccggaaaggggtagggaaggggttagggaaaacgttaggtaacggtaaccgttacggttaccgccggtaacgaggaacggaggacgtaagtactccgactaggtaccaacgaaagngtaagtcgttaagaaccgaaggaacgtaccttaaggttacctaattaccgtaactaaagggtaacgtaccgaagttaacggacccgtaaagaaccgtaagggaaccgaggaaacgccgtaaggtcccgttaaagtttaaccgttaccgttacggttaaccccggngggtacccgggtaccgttacggttaaccccgtaaccgttaaaccgtaaagttaccgttacggtaaaccgttaaacgggggttcccggaaaaccggggtaccgtttaacccccgttagggaaccccttacccgggtccttaaacccccccg

SEQ ID NO: 166148 - DNA, 782 bp, Homo sapiens
  misc_feature: GYAE6OF01B9VT2.43.67.G01.1.454.CMB.1.raw
  modified_base (537)..(537): a, c, t, g, unknown or other
  misc_feature (537)..(537): n is a, c, g, or t
tcagtgtgagtagtcacgaccggtgctcgatttagagtatacatattggggtttggggggggagaggagccccagccttgggattcccaagtgttttcattcagtgatcaggactgaacacagaggactcaccatggagtttgggctgagctggtattttccttgctgcttaattttaaaaggtgtccagtgtggaggtgctaggttgggtgggacgggtccggggggggcctcgggtacccggccggttcgggggggtccccttaggaccttcctccgtgttacgtaaccctcgtggtacttccaccctcaacggttaacgtcgtagggatggtacgtcgttcggttcccgacgacggcgtccggaagggggaggggtcgtggggtagggttggggttcggaccgttaaagtaaaaccgaaaggtggaggggtaggactaggtacgacgtacgtgaccgaccggtagaggagactaggtactccgacctatacctacgaaagagtagtacgtatacgaaggtaacgtctaagtttntactacgtcgaataaacgacgacgtaacgtactagaacctaagtcggaacgtaacccagtaccggttaccgtagttaactttaccgtcggttaccccggagtaccgggttcccgtaccgggtaccttaaccccggtcgttaaacgttaacgttacggtaacgtttacggggtacccgggaaaccccggtaccggggtttaaaccccgtccggggttaacccctcccgggtttacccgtaccccgg

SEQ ID NO: 166149 - DNA, 646 bp, Homo sapiens
  misc_feature: GYAE6OF01DVSTK.43.67.G01.1.454.CMB.1.raw
  modified_base (273)..(273): a, c, t, g, unknown or other
  misc_feature (273)..(273): n is a, c, g, or t
  modified_base (283)..(283): a, c, t, g, unknown or other
  misc_feature (283)..(283): n is a, c, g, or t
  modified_base (287)..(287): a, c, t, g, unknown or other
  misc_feature (287)..(287): n is a, c, g, or t
  modified_base (295)..(295): a, c, t, g, unknown or other
  misc_feature (295)..(295): n is a, c, g, or t
  modified_base (297)..(297): a, c, t, g, unknown or other
  misc_feature (297)..(297): n is a, c, g, or t
  modified_base (301)..(301): a, c, t, g, unknown or other
  misc_feature (301)..(301): n is a, c, g, or t
  modified_base (635)..(635): a, c, t, g, unknown or other
  misc_feature (635)..(635): n is a, c, g, or t
  modified_base (639)..(639): a, c, t, g, unknown or other
  misc_feature (639)..(639): n is a, c, g, or t
tcagtgtgagtagtcacgaccggtgctcgatttagagtatacatagttggggtttggggggggagaggagccccagccttggggattcccaagtgttttccattcagtgatcaggactgaacacagaggactcaccatggagtttgggctgagctggtattttcctgctgtcttaagttttaaaggtgtccagtgtgagtgcgtagtggtgggacgggtccggggggcctggtaccggcggtcggggtccttagactctcctgtacgtacctntcggcttccncctnagtactgngngtgntcgtggtccgacgacggtccgtacggacggggaggtcgtagggtgggttcgggttacgaaccgtttaaagtaaaaccgtaaaggttcggaagggtacgggaacgtagtacgtaccgttacggtcgaccgtacccggtaggacggtaggacgacgtacgttaccggactagtccctaaggtaagacgtaagtcgagttacgaaggtacgtcgttaacgttgtactacgtagataacgacgaactcgaccgtagaccacgtagggacacgtacgacgtgtactagtaccgtcgtgcgtagccgttgccatcgatagtcacgtgcggactacggtcngtcncgtctcg

SEQ ID NO: 166150 - DNA, 759 bp, Homo sapiens
  misc_feature: GYAE6OF01CR4ZX.43.67.G01.1.454.CMB.1.raw
  modified_base (674)..(674): a, c, t, g, unknown or other
  misc_feature (674)..(674): n is a, c, g, or t
  modified_base (744)..(744): a, c, t, g, unknown or other
  misc_feature (744)..(744): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggtatttttccttgctgacttaagttttaaaaggtgtccagtgtgaggtgctagttgggtggagggtccgggggggcctggtaccgccgtgggggtccctagactctccgtgtcgtaacctgtggattccacctctagtaacgtctggatagagcgttacggttcccgccgacgggtcctaccggaaggggaacgggggtctggggtaggttcggggttacggtaccgttaaaagttaaaaaacccgaaaagggttggaaggggtacgggaactaggtaacgaaccgttacggttgacccgtaacccgtgtaacgggacgacgaacgtacgttaccgcctaacttccgtaacgaaagtactagtaggtactagaacggtaaggaccttacggtttactaagtacgtaacgaactaaaagttacgaactacggtacctaggaactaaacgtcggaaacggacctaacacgggtacgtttagttaactttacgtccggttccgaacggtcgggtactacccgggtnaaccgtaccgtaaaattgacggttaaccgtaagttcggggaaaccctaacggggttaaccctggtaaccncccggttcctacccg

SEQ ID NO: 166151 - DNA, 798 bp, Homo sapiens
  misc_feature: GYAE6OF01B9ZPS.43.67.G01.1.454.CMB.1.raw
  modified_base (586)..(586): a, c, t, g, unknown or other
  misc_feature (586)..(586): n is a, c, g, or t
  modified_base (607)..(607): a, c, t, g, unknown or other
  misc_feature (607)..(607): n is a, c, g, or t
tcagtgtgagtagtcacgaccggtgctcgatttagagtatacatattgggtttggggggggagaggagccccagccttgggattcccaagtgttttcattcagtgatcaggactgaacacagaggactcaccatggagtttgggctgagctggtattttccttgctgtacttaagttttaaaaggtgtaccagttgtgaggtgcgtaggttggtcgggtacgggtcccggggggggcctcgggtacccggccggttggggggtccccttaggaccttctccgtgtacgttaaccctcgtggtacttccaccctcaacgttaacgtccgtggtagtggacgacgtcggtttcccggcctaggccgtcccggaaggggacggggacgtgggtagggttggggtacggtaccggttaaaacgttaaaaacccgtaaaggtgggaaggggttacgggtaacgaacggttaagtacgttacggttacgaccgtaccccggtaggaacggaggacgacggtagttccgacacgttctacgaaggtacgagtagtataacgaggaaacggtcgtacggttatacgtactgaanaaagtcgaactacgccgttanacgtaaccgtacgaggaaaccgtcgacgtacccggttattaccgttacgttcccgttacgacccgggtcggggtaccgttccggtccgtaacccgttagaaacctttacgaaggtaaccgtacggttttacccggggaacccggttaacgggtaccccggtacggtcccgtacccgttcccgttaccccgg

SEQ ID NO: 166152 - DNA, 929 bp, Homo sapiens
  misc_feature: GYAE6OF01B864G.43.67.G01.1.454.CMB.1.raw
  modified_base (206)..(206): a, c, t, g, unknown or other
  misc_feature (206)..(206): n is a, c, g, or t
  modified_base (215)..(215): a, c, t, g, unknown or other
  misc_feature (215)..(215): n is a, c, g, or t
tcagtgtgagtagtcacgaccggtgctcgatttagagtatacatattgggtttggggggggagaggagccccagccttgggattcccaagtgtttttcattcagtgatcaggactgaacacagaggactcaccatggagtttgggctgagcgtggtatttttccttgctgtcttaagtttttaaaaggtgtccaggtgtgaggtgngagttgggngggagggtccggggggggcctcgggtaccggccggttcggggggtccccttagaccgttccgtccgttggtacgttaacctcgtggtacttccaccctctagtaacgtcgtaggataggagtcgttcggttcccgaccgacggcctaccggacggggaaggggtcgtaggggtaggtcggggtttacggaccggttaaacgttaaaaaccgaaagggttaggaggggtaggtaacgaaggtaacgtacgttacggtcgaccggtaccgaggacgtaggctagtacgttccgactactccgtaagaagtacgtagttcgtaacgttacggaaggtacggtaccttaagggtttcgtaacgtttccgaacggtaaacctaaaggttacccgaaccggttaacggtacccgtaaggtaaacccgttaacggtaaccgggacgtaaaccgacccgggtaacggttacccgggtttaggttaacccgtttccgtttaacccgggttacccgggtacggtaaccgggggtttcccgttacccgggttaacccgtaaaccgggtttaacccgttaaacggtttaaacgggtaacccggttttaaccggggtttaaccccggggttacccggggggtaaccccgtaaaaccccggggggtttacccccggttaacccggtttacccccgggtaaaccccgttttcccgttaaccccccgggg

SEQ ID NO: 166153 - DNA, 785 bp, Homo sapiens
  misc_feature: GYAE6OF01EP7NX.43.67.G01.1.454.CMB.1.raw
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggtatttttccttgctgcttaattttaaaaggtgtccagtgtgaggtgctaggttggtgggacgggtccggggggggcctcgggtaccggccggtcggggggtccccttagacctcctccgtgtcgtaaccttcgtggacttccaccctacgtaacgttaaccgttctaggatggacgtcgttcggttcccgccgacggcctaccggaggggaacggggtcgtggagggttgggttacggaccgttaaacttaaaaaccgaaaggtgggtaaggggtagggaacgtaaggtaacgtaaccgttacggttcgaccgtaacccggtggaacggacgggcgaaggtacttacccggaccctacgttaccgtacgaaagacggtagtgtaacgttacgaaggtaacggtcgtacggtttataagttcgtacgaacgaaagtacgaaacgcggtaccctaagaacctaaggtacggaacgaccgaaccgtacgccgtttagttacgttaccgtttacgtcccgacggtaccggtccgtaccgggttacctacccgttacgtaattacggtacgttaagtaccgggtaccgggaacccgttaccgggacccgttccggtaccgtccccgttccgtaccccg

SEQ ID NO: 166154 - DNA, 932 bp, Homo sapiens
  misc_feature: GYAE6OF01APSTP.43.67.G01.1.454.CMB.1.raw
tcagtgtgagtagtcacgaccggtgctcgatttagagtatacatattgggtttggggggagaggagcccagccttgggattcccaagtgttttcattcagtgatcaggactgaacacagagactcaccagtggtacgtttgggctgagcttggtattttccgttgctgtacttaagtttttaaaaggtcgtacctaggttcgtggtaaggttcgacgttaggtttgggtagggtacggggttccccggggggggtaccttcgggtaacccggtcccgggttcgggggggtttaccccttaaggtaccgttccgttccgttagttaccgttaacccgttcgttcggttacttccctaccccttacgtaagttaaccgtcgtaggaagtcggacgtcgttcggttcccgaccgtacggtccgtacggaacggggaacgggtcggtgggtaacggtttcggggtttaccggtaacccgtttaaaaacgttaaaaaacccggtaaagggtttacggggtaacgggggttaacgggaacgttaacgggttaacgttaaccggtttaccgggttaccggacccgttaacccgggtaggtaaacgggacgggtaccgtaaggtaccgtttccggtaacctacgttaccgtaaacgaaggtaacgtagtaacgttacgtaccggaaaggtacggtcgtaacggtttgtacgtactagaactaagtacggaacgtacgtacgaagtaacctaaagtccggtaagaacccgttacgtaaccgtggtttaacttaccggttagttcccggttaccggacggtccggttacccgtacggttaccgaaccgttaacgtacgtttaaggtacttacgggttaccgggacgggttaacccggtaacggtttacccgtacggttccccgtaacccgttcgtaccccgg

SEQ ID NO: 166155 - DNA, 839 bp, Homo sapiens
  misc_feature: GYAE6OF01DEX4L.43.67.G01.1.454.CMB.1.raw
  modified_base (491)..(491): a, c, t, g, unknown or other
  misc_feature (491)..(491): n is a, c, g, or t
  modified_base (591)..(591): a, c, t, g, unknown or other
  misc_feature (591)..(591): n is a, c, g, or t
  modified_base (619)..(619): a, c, t, g, unknown or other
  misc_feature (619)..(619): n is a, c, g, or t
tcagtgtgagtagtcacgaccggtgctcgatttagagtatacatattggggttggggggggagaggagccccagccgttgggattcccaagtgtttcattcagtgatcaggactgaacacagaggactcacgatggagtttgggctagagctggtacttttccgtgtcgtagtacttaagttttaaacggtgtacctagtggtggagggttcgagtagggtttgggacgggcggggtcccgggggggtacctgggtacccggtcgggttcggggggttaccctagccgttcctaccgtggttacggtaacctcgtaggaccttccgacccgtagtacgttaacgtcggtagtatcggcgtcggttacgttccgcccgaggtcgtccggaagggggtaacgggtctggggtcgggtgggttacggaaaccgttaagtaaacgaaaggtcgggagggtcgagtagtgtacctagtactcgaacgtggacgagnagtacgtcgactacgtccagtacggatagtacgtaacggtcgaaagggtacgtacggtaacgttagtacggtactaacgttaaaggtactaacgggttanaaccccgttaagacgtaaccggtaaacncggttaaaccgaccgggtaacctcggggttaaacccgttgggtttaacccgtacgggttccccgggttagaacccggggttggtaccccggttaaccacgtttaaaaccgtaacgggtacttaaaagggtcggttaaccggtttaacgggaaccggggttaaacccgttaccccggggtaagttaacccgtccctttaaacccggcgtttaaacccccgg

SEQ ID NO: 166156 - DNA, 978 bp, Homo sapiens
  misc_feature: GYAE6OF01CA1IG.43.67.G01.1.454.CMB.1.raw
tcagtgtgagtagtcacgaccggtgctcgatttagagtatacatattgggtttgggggggagaggagccccagccttgggattcccaagtgttttcattcagtgatcaggactgaacacagaggactcaccatggagttgggctgagctggtattttccttgctgtacttaagttttaaaaggtgtacctaggtggtgaggtgcgtaggtttgggtgggtacggggtcccggggggggtccgtcggggttacccggtcccgggttcgggggggttaccccttaaggtaccttccgttacccgttggtttaccggttaaacccgttcgttacgggtaacctttccccgtaaccccttacgtaaacggtttaaccggttccgttacggggtaagttaggtaacggtcccgggtttaccggggttttccccggacccggtaacggggtaccccggttacccggggaaacgggggggtaaacgggggtccggttacggggggtaggggttttcggggggtttaaccgggtaaacccggtttaaaaacgtttaaaaaaacccggtaaaaggggttaacggggtaaacggggggttacggggtaaaccgtaaagggttaaccggtaaccgtttaaccgggttccgacccggtaaccggtagggaaacggtagggacctaacgggtacttacccggaccctaagtacccgtaacgtaaaggagtaacgttaggtaacttaaccggaaaggtaaccgggtcgttaacgggtttagtaaccttacggtaacgtaaactaaacgtacgtaaaccgtaccgtaccctaaaggaaccgtaacgtacggaacggaacctcgtaacggttaccgttagttacgttccgtcgttaccgcgggtaggtcccgtacgtaccaacgtcgtaaagtgtacgttaccgtagggtcccgggacgtaccgggtaccctggtaaccctcccgtcctcccgg

SEQ ID NO: 166157 - DNA, 590 bp, Homo sapiens
  misc_feature: GYAE6OF01EF18M.43.67.G01.1.454.CMB.1.raw
  modified_base (552)..(590): a, c, t, g, unknown or other
  misc_feature (552)..(590): n is a, c, g, or t
tcagtgtgagtagtcacgaccggtgctcgatttagagtatacatattgggttggccgtattaaaaccaaaagtgagggtgggacagtagactacgttgcacccgtgagaggcagattcgccatctcaagagatgattcaggaaggcacgttgtatctgcaaatgaacagcctgaacaatcgaggacacagtccgtgtacttactgttccgacagggctcggacactaccgataatgacctagtcgggaccacgggaacctggtccaaccgtctccgtacacgtccctaccgaccaacggggccctacgtccggtcccgttcccccgtggacccgtccccgtcgtccgtaccggaacggcgacccgacccgtaccggaaggacgaccgaccgaacgggccggtcccccgtggggtccgtccggaccgttacggtaaaccggtaaaggtacccttaacccgtttacccgaaacttaaccctttacgaaccttccggagggtaacgggccggtacgtaccgggagaaaccgggtcgaactagtacgtgcacgtannnnnnnnnnnnnnnnnnnnnnnnnnnnnnnnnnnnnnn

SEQ ID NO: 166158 - DNA, 868 bp, Homo sapiens
  misc_feature: GYAE6OF01CE5LH.43.67.G01.1.454.CMB.1.raw
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggtattttccttgctgtacttaattttaaaagtgtcctagtgtggaggtgtcgtaggttgggtgggtacgggtccggggggggtcctcgggtacccggtccggttacggggggttccccttaggaccgttcctcccgttgtccgttaacctcgtggtacttccgacccttcgaacgtaacgtctaggagtcggacgtcgttcggttcccgccgtacggccgtaccggaagggggaacggggtcggtacgggtaggggttcggggttacggtaacccggttaaaacgtttaaaaaaccggtaaaaggtacgggaaggggttaacgggaacgtaaggttaacgtaacggttaacgtcggtacccgtaaccggtaggacgggacgggtaccaggtaccgttacgacccgtaacgtccgaaacgtaaacggtaagtaagtacggtaacttaacggaacgggtaaacggtaccgtttaacggtttacggttaaaccgtacgttaacgaaacctttaaaaggtaccgaaaacgtaaccggttcccgtaaacgtaaccgtaaacggtacccggaaacggtacaacccggttacggtacccggttaaagtttaccggttaccgttccggtacccggtaccgtacgggtcctacggtaccctacgtccgtaaatacgtagtcgttaacgggcggacccgtaacgggccttagtccctcgtcctccgg

SEQ ID NO: 166159 - DNA, 770 bp, Homo sapiens
  misc_feature: GYAE6OF01CD9EO.43.67.G01.1.454.CMB.1.raw
  modified_base (348)..(348): a, c, t, g, unknown or other
  misc_feature (348)..(348): n is a, c, g, or t
  modified_base (758)..(758): a, c, t, g, unknown or other
  misc_feature (758)..(758): n is a, c, g, or t
tcagtgtgagtagtcacgaccggtgctcgatttagagtatacatatttggggtttggggggggagaggagccccagccttgggattcccaagttgtttttcattcagtgatcaggactgaacacagaggactcaccatggtaggtttggctgagctggtatttttccttgctgcttaattttaaaaggtgtccagtgtgaggtgctaggttggtgggaggggtcccggggggggtctcgggtacccgccgggtacggggggtcccttaaggcctccgttcctgttacgtaacctgtacggtacttccacccctgaacgtaacgtcgttggatgagccgttcggttccncgacggctacggaggggaacggggctagggacggttggggtacggtaaccgttaaacgtaaaaaccgaaaggtggaagggtaggaaccgtagtaagtacgtaacggttcgaccgtacggtacggaagacgggactacgtacgttcaccgtacgtaccgtacgaaacggtaggaatttacgggaaacttacggaaacggaaggttaccgttaaccggtttaagtcttacggaacggtaagtaaaactacggaaaccgtaacgaccgtaaagaacttaacggaaccggaaggtaccaagtacgttccggtaaagttccttaacgttccgtaccgaggtcggtaccgtaccgttgaacccgtcgtaaagtacctaggtcgtacggtacgggaaccaccgggtctagggtaccncccgtctacccg

SEQ ID NO: 166160 - DNA, 802 bp, Homo sapiens
  misc_feature: GYAE6OF01BUQ78.43.67.G01.1.454.CMB.1.raw
  modified_base (643)..(643): a, c, t, g, unknown or other
  misc_feature (643)..(643): n is a, c, g, or t
  modified_base (725)..(725): a, c, t, g, unknown or other
  misc_feature (725)..(725): n is a, c, g, or t
tcagtgtgagtagtcacgaccggtgctcgatttagagtatacatagttggggtttgggggggagaggacgccccagccttgggattcccaagttgttttcattcagtgatcaggactgaacacagaggactcaccagtggaggtttgggctgagcgtggttattttccttgctgtactttaattttaaaacggtgtccgagttggtggaggtgcgtaggtttggggtgggacggggtccggggggggcctcgggtaccggccgggttcgggggttccttacggtcctcgttcgtggttacgtaaccttcgtaggtacttccacccgtcgtaacgttaacgtcgtaggagttggacgtccgtttacgggtcccgaccgtacggtcctaccgtaggtagggggtaacgggggtcgttagggggtacgggtttggggttaaccggtaaacgtttaaaaaccggttaaaaaccggtaaaggggttgggtaaagggggtacgggaacgtaaggttaacggtaacgttacggttccgaccgtaccggtaggacggacgtacgacgtacgtaccggacctagtcgtaaggtaacgagtaacgtgtaacgtacggtaaaggtacggttacgtagtttagtaactcggtaanaaacttaaccggtaagtaccgacgtacgaacgacgtaaggacgacgatacgacggttaccgttattacttacgtcggtacgnggacggtcctacggtaccacgtactagactacgtggtaacggtcgggaacccgttacggacctcggtcctaccgtcc

SEQ ID NO: 166161 - DNA, 805 bp, Homo sapiens
  misc_feature: GYAE6OF01DQAZP.43.67.G01.1.454.CMB.1.raw
  modified_base (208)..(208): a, c, t, g, unknown or other
  misc_feature (208)..(208): n is a, c, g, or t
  modified_base (660)..(660): a, c, t, g, unknown or other
  misc_feature (660)..(660): n is a, c, g, or t
tcagtgtgagtagtcacgaccggtgctcgatttagagtatacatattgggtttggggggggagaggagccccagccttgggattcccaagtgttttcattcagtgatcaggactgaacacagaggactcaccatggagtttgggctgagctggattttccttgctgcttattttaaaaggtgtccagtgtgaggtgcgtaggttgggngggacgggtcccggggggggcctcggggtacccggccggttcggggggttacccttagaccttcgttccgtgtcgtaacctcgtaggacttcaccctcacgtaacgtctggatgacgtctcggtccgccgaggcctcgaggggacgggcgtgggtaggtgggttcggaacgtaacgttaaaaaaccgaacggtggtaggggtacggaacgtaggtaacggtacgttacgttcgaccgacccggttgacggaaggcgtaacgtacgttccgacctacgtccgtacggaacgaagtctaagtcgttaacgaaggtacgggtaccttacggttagtacttacggagtaacgaaacggtacgaacgtaccgacgttaacgaacggtaaacttcgggaaacggtacaaccgggtaccgttacggtaacggttttacgtaccgtttaccgggtacccncgggttaaaccgggtcccttcccgggtaacctaccgtttaacccggtaaattaccggttacggtaccggtttaacgggttcggggaacccccggtaagggttaaacccccggtgggttaacccctacccgtttccgtaacccccg

SEQ ID NO: 166162 - DNA, 877 bp, Homo sapiens
  misc_feature: GYAE6OF01CH734.43.67.G01.1.454.CMB.1.raw
tcagtgtgagtagtcacgaccggtgctcgatttagagtatacatattggggtttgggggggagaggagccccagccttgggattcccaagtgttttcattcagtgatcaggactgaacacagaggactcaccatgggagtttgggctgagctggtattttccttgctgtacttaattttaaaggtgtccagtgtgaggtgctaggttgggtgggacggggtcccgggggggtcctcgggtaccggcccggttcggggggtccccttagccttcctccgttcgtacgtaaccctcgtaggtacttcccaccctctaaggtacgttcgtaggtataggacgtcgttcgggttcccgccgacgggtccgtaccggaagggggaacgggggtcgtaggggttacggggttcggggtttacggtaaccggtttaaaacgtttaaaaaacccggaaagggttagggtaacgggggtagggtaaacgtaggttaaacggtacgttaccggttagaccccgtaccggtaggaaggacgggacgtaacggtcgttacccggaccttaactacccgtaaagaaacggtagtagtacgtacttacggaaggttaaaccgggctttaagggttcgtaacgtttccgtaaggtaaactaacgtacgaaactcgggtaacccctaagaaaccgttaaagaaccgggtaaagaacccgtaacggtacggtaccggtttacgtttaaacgttaccccggtttacgtacccgggtaccggaccgggttcccgtacgggtacccctaaccggttaaccgtaattaggtacctaacggttagggaccccgggaacggtaccccggtacgtcggtaccccgtacgttcccgtacccg

SEQ ID NO: 166163 - DNA, 873 bp, Homo sapiens
  misc_feature: GYAE6OF01CHJEK.43.67.G01.1.454.CMB.1.raw
  modified_base (168)..(168): a, c, t, g, unknown or other
  misc_feature (168)..(168): n is a, c, g, or t
  modified_base (701)..(701): a, c, t, g, unknown or other
  misc_feature (701)..(701): n is a, c, g, or t
tcagtgtgagtagtcacgaccggtgctcgatttagagtatacatattgggtttgggggggagaggagcccagccttgggattcccaagtgttttcattcagtgatcaggactgaacacagaggactcaccagtggtagtttgggctgagctggtacttttccttgctncttaatttaaaggtgtccagtgtgaggtgcgtagttggtgggacgggtccggggggggcctgggtacccggccggttcggggggtcccttaaggccttccgttccgtgttacgtaacctcgtaggtacttccaccgtcgtaacgtaaccgtcgtggacgttgacggtcgttcgggttacccgccgaggtccgtaccgggaggggagggtcggtgggacggttcggggttacggtaccgttaaaacgttaaaaaccggaaagggttgggtaaggggtacggaacgtaggtaacggtacttacggttcgtccgaccggtggaaggcgggacaacggtcgttacgacctagcctaagaagacggtatacggtatacgaacgggtagttaccgttaggtacttacgtcgtcggaaactagtaacggaaccctacgggtacccgttaagaacctaacggttaccgggaacggtaaccacggttccggtacccgggttttaatttaccggttaaccggtttcccgggttaaccccgggngggtaacccgggttttcccggtacccggtttaaacccgacccggttttaacggtaaagttttcccgggtaaacttcggggtttaaaccccgggtggggggtttaaaccccccggaaccggtttaccccgggttaacgggttaccccggttccccgttcccgttaacccccgg

SEQ ID NO: 166164 - DNA, 875 bp, Homo sapiens
  misc_feature: GYAE6OF01D0OGT.43.67.G01.1.454.CMB.1.raw
  modified_base (197)..(197): a, c, t, g, unknown or other
  misc_feature (197)..(197): n is a, c, g, or t
  modified_base (213)..(213): a, c, t, g, unknown or other
  misc_feature (213)..(213): n is a, c, g, or t
tcagtgtgagtagtcacgaccggtgctcgatttagagtatacatattggggttgggggggagaggacgccccagtccgttgggattcccaagttgttttcattcagtgatcaggactgaacacagacgactcacctagtaggtaggtttcgggctgagcgtggtacttttccgttgctgtacttaagtttaaaggtntcgtagtgtggaggtnacgtaggttgggtacggacggggtccgggggggctcgggtaccggccgggttcgggggtcccttagaccgttctccgtgttacgtaaccgtcgtacggacttccaaccgtcgtaagtaaccgttcgtggaagtcgtacgtcgtccggttaccgaccgtacggacctacgggaagggggacgggttccggttaggggtacggtttcggggttaaccggtaaccgtttaaaacgttaaaaaccgggtaagggtacgggtaacgggggtaacggtaaccgtaaaggttaacggttaaccggttacggttaccggaccggttaccggtagggaacggacgtacgtacggtacgttaccgacctacggtactaacggagaacgttacgtaacgtgttaacgaaggtacgaccttaagggtttactacttacgaacgtaaactaacgtacgtaacgtaccggtaacgtaccggaacgtaagtacccggaacgtaaccgaacggttaccggtaactttaacgggtactttacgggttccggtccgtaacgggcccggttccgtaacggtacccgttactaccggtaaagttagttaccggtaaacccgttgggtaaccccggaacccggttacggtaccccgttcgaaacccgttcccgtcgtaacccg

SEQ ID NO: 166165 - DNA, 701 bp, Homo sapiens
  misc_feature: GYAE6OF01B8R71.43.67.G01.1.454.CMB.1.raw
  modified_base (392)..(392): a, c, t, g, unknown or other
  misc_feature (392)..(392): n is a, c, g, or t
  modified_base (395)..(395): a, c, t, g, unknown or other
  misc_feature (395)..(395): n is a, c, g, or t
tcagtgtgagtagtcacgaccggtgctcgatttagagtatacatattgggtttggggggagaggagccccagccttgggattcccaagtgttttcattcagtgatcaggactgaacacagaggactcaccatggagtttgggctgagctggattttccttgctgctattttaaaaggtgtccagtgtgaggtgcagttggtggaggtccgggggggcctggtaccggcgtggggggtcccttagacctctcctgtgtaacctctggattccacctcagtaacgtctggatgagcgtggttccgccaggctccgaggggaagggctggagtgggttcgaccgtaataaaaccgaaagtggagggtgacgagtagactagtgcaccgtgagagnagntcgacctatctacgaagagatcgtacttgagaaaggtctaacggtttgtaacgttctacggaactaaagtcggaaactaggccctaaggaactaagtacggaacggaacaacgttacggaccggttagttaagtttacccgttacggttccccggacgtaaccgggggtccttaccgggtaaccgtaacccgttaacccgtaagttaaacgtacgggtacccggttaacgggtttccggggggaaccccgttaaaccgggggaaaccccctttgggaacccccttcccggttccccttacccccgg

SEQ ID NO: 166166 - DNA, 1044 bp, Homo sapiens
  misc_feature: GYAE6OF01D0005.43.67.G01.1.454.CMB.1.raw
tcagtgtgagtagtcacgaccggtgctcgatttagagtatacatattgggttgggggggagaggagccccagccttgggattcccaagtgttttcattcagtgatcaggactgaacacagaggactcaccatggagtttgggctgagctggtattttccttgctgtcttaattttaaaaggtgtcctagtgtgaggtgctaggttgggtgggacgggttccggggggggtcctcggggtacccggtcccgggttcgggggggttaccccttaacggtaccttccgttccgttggttacgtaaaccccttcgttcgggtaactttcccaccccgttacgaacggttaaaccggttcgtacgggtaattggtacggtccgtttccggggtttacccgaccgtaacgggtccccgtacgggaaagggggtaacgggggtcgttacggggtaggggttcggggtttacgggtaacccggttaaaacgtttaaaaaaccggaaaagggtgggtaacgggggtacgggtaaccgtaagggtaaacgtaaccgtttacggttccggaccgtacccggttagggtacggaacgggtcgtaacggtaccgtttaccgggacccttaacggtaccgtaacgaaacggagttaacgtttagggtaacgttttaaccggaaagggttaacccgggttaccttaaaggggttttactaacggtttaccggtaaggttaaaacccgtaaaaggttacggtaaaccgtacccgggtttaaccgtaacgtaaacccgttaaacgggttacccgggaaaggttaaaccccggaaccggtttacggttaaacccgggttttaagtttaacccgtttacgggtttaccccggtcccggaaccggggtttacggtaccccggttttccggaaaccctttaaccggttacccgtaaaaggttaacgttacccggggttaaaccggttacgggggtacccgggaaacccggttaaaccggggtaacccctttcggggacccctaccccgttttctaaacccccggg

SEQ ID NO: 166167 - DNA, 538 bp, Homo sapiens
  misc_feature: GYAE6OF02F86BK.43.67.G01.1.454.CMB.1.raw
  modified_base (478)..(478): a, c, t, g, unknown or other
  misc_feature (478)..(478): n is a, c, g, or t
tcagtgtgagtagtcacgaccggtgctcgatttagagtatacatattgggtttgggggagaggagccccagccttgggattcccaagtgttttcattcagtgatcaggactgaacacagaggactcaccatggagtttgggctgagctggattttccttgctgctattttaaaaggtgtccagtgtgaggtgcagttggtggagtccggggggcctggtaccgcctgggggtcccttagactctcctgtgtaacctctggattcaccctcagtaacgtctggatgagctggttccgccaggctccagggaagggctggagtgggtggccgtattaaaccaaaagtgagggtgggacagtagactacgttgcacccgtgagaggcagattcgccatctcaagagatgattcagaaggcacgttgtatctgcaaatgaacagcctgacaatcgaggacacagccgtgtattactgttccncagggctcggtcactccgaataatgaactagtgggccagggaccctggtccaccgtctcc

SEQ ID NO: 166168 - DNA, 409 bp, Homo sapiens
  misc_feature: GYAE6OF02I13NV.43.67.G01.1.454.CMB.1.raw
  modified_base (319)..(319): a, c, t, g, unknown or other
  misc_feature (319)..(319): n is a, c, g, or t
  modified_base (404)..(409): a, c, t, g, unknown or other
  misc_feature (404)..(409): n is a, c, g, or t
tcagtgtgagtagtcacgaccggtgctcgatttagagtatacatattgggttggccgtattaaaaccaaaagtgagggtgggacagtagactacgttgcacccgtgagaggcagattcgccatctcaagagatgattcagaaggcacgttgtatctgcaaatgaacagcctgacaatcgaggacacagccgtgtattactgttccgcagggctcggtcactccgataatgactattggggccagggaaccctggtcaccgtctcctcagcctccaccaagggccccatcggtcttcccctggcgccctgctccaggacncacctccgagagcacagcggccctgggctgcctggtcaaggctacttccactactcacactgagcgggctggcaaggcgcatagnnnnnn

SEQ ID NO: 166169 - DNA, 410 bp, Homo sapiens
  misc_feature: GYAE6OF02GF94I.43.67.G01.1.454.CMB.1.raw
  modified_base (405)..(410): a, c, t, g, unknown or other
  misc_feature (405)..(410): n is a, c, g, or t
tcagtgtgagtagtcacgaccggtgctcgatttagagtatacatattgggttggccgtattaaaaccaaaagtgagggtgggacagtagactacgttgcacccgtgagaggcagattcgccatctcaagagatgattcagaaggcacgttgtatctgcaaatgaacagcctgacaatcgaggacacagccgtgtattactgttccgcagggctcggtcactccgataatgactattggggccagggaaccctggtcaccgtctcctcagcctccaccaagggcccatcggtcttccccctggcgccctgctccaggagcacctccgagagcacagcggccctgggctgcctggtcaaggactacttccactactcacactgacgcgggctggcaaggcgcatagnnnnnn

SEQ ID NO: 166170 - DNA, 550 bp, Homo sapiens
  misc_feature: GYAE6OF02I20PN.43.67.G01.1.454.CMB.1.raw
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcagttggtggagtccgggggggcctggtaccgcctggggggtcccttagactctcctgtgtaacctctggattcaccctcagtaacgtctggatgagctggttccgccaggctccagggaagggctggagtgggttggccgtataaaccaaagtgagggtggacagtagactacgttgcacccgtgagaggcagattcgcatctcaagagatgattcaagaaggcacgttgtatctgcaaatgaacagcctgacaatcgagacacagccgtagtattactgttccgcgagggctcggtcactccgataatgaactagttggggccacgggtaaccctggtacctaccggtctcccg

SEQ ID NO: 166171 - DNA, 537 bp, Homo sapiens
  misc_feature: GYAE6OF02G8ALM.43.67.G01.1.454.CMB.1.raw
  modified_base (400)..(400): a, c, t, g, unknown or other
  misc_feature (400)..(400): n is a, c, g, or t
  modified_base (535)..(535): a, c, t, g, unknown or other
  misc_feature (535)..(535): n is a, c, g, or t
tcagtgtgagtagtcacgaccggtgctcgatttagagtatacatattgggtttgggggagaggagccccagccttgggattcccaagtgttttcattcagtgatcaggactgaacacagaggactcaccatggagtttgggctgagctggattttccttgctgctattttaaaaggtgtccagtgtgaggtgcagttggtggagtccgggggggcctggtaccgcctggggggtcccttagactctcctgtgtaacctctggattcaccctcagtaacgtctggatgagctggttccgccaggctccagggaagggctggagtgggttggccgtattaaaccaaagtgagggtgggacagtagactacgttgcacccgtgagaggcagattcgccatctnaagagatgattcagaaggcagttgtatctgcaaatgaacagcctgacaatcgaggacacgagccgtagtattactgttccgcagggctcggtcactccgataatgactagtgggccagggaccctggtcacgtcncc

SEQ ID NO: 166172 - DNA, 535 bp, Homo sapiens
  misc_feature: GYAE6OF02HECZE.43.67.G01.1.454.CMB.1.raw
  modified_base (457)..(457): a, c, t, g, unknown or other
  misc_feature (457)..(457): n is a, c, g, or t
  modified_base (477)..(477): a, c, t, g, unknown or other
  misc_feature (477)..(477): n is a, c, g, or t
tcagtgtgagtagtcacgaccggtgctcgatttagagtatacatattgggtttggggggagaggagccccagccttgggattcccaagtgttttcattcagtgatcaggactgaacacagaggactcaccatggagtttgggctgagctggattttccttgctgctattttaaaaggtgtccagtgtgaggtgcagttggtggagtccgggggggcctggtaccgcctggggggtcccttagactctcctgtgtaacctctggattcaccctcagtaacgtctggatgagctggttccgccaggctccagggaagggctggagtgggtgccgtataaaccaaagtgagggtggacagtagactacgtgcaccgtgagaggcagattcgccatctcaagagatgattcagaaggcacgttgtatctgacaaagtgaacagcctagacaatcgagacanagccgtgtattactgtccgnagggctcggtcactccgaataatgaactagtgggcacgggacctggtccacgtctccg

SEQ ID NO: 166173 - DNA, 593 bp, Homo sapiens
  misc_feature: GYAE6OF02IHGI1.43.67.G01.1.454.CMB.1.raw
  modified_base (375)..(375): a, c, t, g, unknown or other
  misc_feature (375)..(375): n is a, c, g, or t
  modified_base (475)..(475): a, c, t, g, unknown or other
  misc_feature (475)..(475): n is a, c, g, or t
  modified_base (524)..(524): a, c, t, g, unknown or other
  misc_feature (524)..(524): n is a, c, g, or t
  modified_base (584)..(584): a, c, t, g, unknown or other
  misc_feature (584)..(584): n is a, c, g, or t
  modified_base (589)..(589): a, c, t, g, unknown or other
  misc_feature (589)..(589): n is a, c, g, or t
tcagtgtgagtagtcacgaccggtgctcgatttagagtatacatattggggtttagggggggagaggagccccagccttgggattcccaagtgttttccattccagtgatcaggactgaacacagaggacgtcaccgatggagtttgggctgagctggattttcccttgcttgctattttaaaacggtgtccagtgtgaggtgtcagttggtggagtccgggggggcctggtaccgccgtggggggtcccttagactcgtccttgtgtaacctctggattcacctcagtaacgtctcggatgagcttggttccgcaggctaccgagggaagggctggagtgggttggccgtaattaaaccaaagtggaggtgganagtagactagtgcacccgtgagaggcagagttcgaccatctacgaaggagatgtatttcgaaggaacggctaacggttgtatctagactaaagtgaacgngtaccgtgaacagtcgaagacacgagccgtagtacttacgtcgttccgntacgggcctcggtctacgtccgtaatactcgacttagtcgggccacgggtacctggaccnccgtntccg

SEQ ID NO: 166174 - DNA, 545 bp, Homo sapiens
  misc_feature: GYAE6OF02GQLXJ.43.67.G01.1.454.CMB.1.raw
  modified_base (485)..(485): a, c, t, g, unknown or other
  misc_feature (485)..(485): n is a, c, g, or t
  modified_base (540)..(540): a, c, t, g, unknown or other
  misc_feature (540)..(540): n is a, c, g, or t
tcagtgtgagtagtcacgaccggtgctcgatttagagtatacatattgggtttggggggagaggagccccagccttgggattcccaagtgttttcattcagtgatcaggactgaacacagaggactcaccatggagtttgggctgagctggattttccttgctgctattttaaaaggtgtccagtgtgaggtgcagttggtggagtccggggggggcctggtaccgcctggggggtcccttagactctcctgtgtaacctctggattcaccctcagtaacgtctggatgagctggttccgccaggctccagggaaggggctgggagtgggtggccgtattaaaccaaagtgagggtgggacagtagactacgttgcacccgtgagaggcagattcgccatctcaagagatagattcaagaaggcagttgtatctagcaaatgaacagcctgacaatcgaggacacagccgtgtatactgttccgnaggctcggtcactccgataatgactagtcgggaccagggaccctggtacaccgtntcccg

SEQ ID NO: 166175 - DNA, 598 bp, Homo sapiens
  misc_feature: GYAE6OF02HT8FQ.43.67.G01.1.454.CMB.1.raw
  modified_base (410)..(410): a, c, t, g, unknown or other
  misc_feature (410)..(410): n is a, c, g, or t
  modified_base (454)..(454): a, c, t, g, unknown or other
  misc_feature (454)..(454): n is a, c, g, or t
  modified_base (499)..(499): a, c, t, g, unknown or other
  misc_feature (499)..(499): n is a, c, g, or t
tcagtgtgagtagtcacgaccggtgctcgatttagagtatacatattgggtttggggggagaggagacccgagccttgggattcccaagtgttttcattcagtgatcaggactgaacgaccagaggactcaccagtggagttttggctgagctggtattttccttgctgcttattttaaaaggtgtccagtgtgaggtcgctagttggtggacgtcccggggggggcctgggtaccgcctgggggtcccttaggactctcctgtgtaacctctggattccacccttcacgtaacgtctggatgagctggtccgcctaggctcagggaggctggagtgggtggacgtataaaacaaagtgaggtggacagtagactacgttgcaccgtgagaggcgagattcgactatctnaagagatgtatcgagtaaggctagtgtatcgtagcaaatgaacngcctgacaatgagactacagtccgtagtacttacgcgtttaccgnaaggggtctacggtcctaacgttcccgaattaacgtcggaacgttagttagggggacctaacggggtaaccccttagggtaccctaccggttctacccg

SEQ ID NO: 166176 - DNA, 558 bp, Homo sapiens
  misc_feature: GYAE6OF02IQOT8.43.67.G01.1.454.CMB.1.raw
  modified_base (476)..(476): a, c, t, g, unknown or other
  misc_feature (476)..(476): n is a, c, g, or t
  modified_base (490)..(490): a, c, t, g, unknown or other
  misc_feature (490)..(490): n is a, c, g, or t
  modified_base (553)..(553): a, c, t, g, unknown or other
  misc_feature (553)..(553): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcagttggtggagtccggggggggcctggtaccgcctggggggtcccttagactctcctgtgtaacctctggattcaccctcagtaacgtctggatgagctggttccgccaggctccgagggaaggggctgggagtgggttggccgtaattaaaaccaaagtgagggtggacagtagactacgtgcacccgtgagaggcagattcgcatctacaagagatgattcagaaggcacgttgtatctagacaaatgaacagcctagacaatcgagacacgagccgtntactactgttccgngagggctcggtcactccgaataactgactagttcgggccacgggtaccctggtaccacccgtntcccg

SEQ ID NO: 166177 - DNA, 669 bp, Homo sapiens
  misc_feature: GYAE6OF02J24IQ.43.67.G01.1.454.CMB.1.raw
  modified_base (281)..(281): a, c, t, g, unknown or other
  misc_feature (281)..(281): n is a, c, g, or t
  modified_base (426)..(426): a, c, t, g, unknown or other
  misc_feature (426)..(426): n is a, c, g, or t
  modified_base (502)..(502): a, c, t, g, unknown or other
  misc_feature (502)..(502): n is a, c, g, or t
  modified_base (563)..(563): a, c, t, g, unknown or other
  misc_feature (563)..(563): n is a, c, g, or t
tcagtgtgagtagtcacgaccggtgctcgatttagagtatacatattggggtttggggggggagaggagccccagccttgggattcccaagtgttttcattcagtgatcaggactgaacacagaggactcaccatggagtttgggctgagctggattttcctgctgctatttaaaggtgtccagtgtgaggtgctaggttggtgggaggtccgggggggcctgggtaccgccgtcgggggtcccttagactctcctgtcgtacctctggacttccaccctnagtaacgtctggatgagcgtggttcccgcgaggccgtaccggaggggacgggtcgtggaggttgggttacggaccgttaagtaaaaccgaaaggtgggagggtacggactaggtacgtacgtacgtcgaccgtaccggtgacggngcagtacgttcgccagtctacgaagtgatagacttacaacggaagtctaacgttcgtatcgagacaaagtcgaacncgaccttaagaccgaagtcggaacgacaacgcggtaccgttatacgttacgtcggtacccnggtacggtcctccgtacaccgtacgtaagtacgtacggtaaccgtttacgggtaccggggaccctaaccggggttaacccgtggtaccccgttaccgtcctacccg

SEQ ID NO: 166178 - DNA, 549 bp, Homo sapiens
  misc_feature: GYAE6OF02F3JYG.43.67.G01.1.454.CMB.1.raw
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcagttggtggagtccgggggggcctggtaccgcctggggggtcccttagactctcctgtgtaacctctggattcaccctcagtaacgtctggatgagctggttccgccaggctccgagggaagggctggagtgggttggccgtattaaaccaaagtgagggtgggacagtagactacgttgcacccgtgagaggcagattcgccatctcaagagatgattcagaaggcacgttgtatctgacaaatgaacagcctgacaatcgagacacagccgtagtattactgttccgcgagggctcggtcacgtccgaataatgtactagtcgggcacgggaccctggtcctaccgtctccg

SEQ ID NO: 166179 - DNA, 426 bp, Homo sapiens
  misc_feature: GYAE6OF02I175Z.43.67.G01.1.454.CMB.1.raw
  modified_base (332)..(332): a, c, t, g, unknown or other
  misc_feature (332)..(332): n is a, c, g, or t
  modified_base (372)..(372): a, c, t, g, unknown or other
  misc_feature (372)..(372): n is a, c, g, or t
  modified_base (404)..(426): a, c, t, g, unknown or other
  misc_feature (404)..(426): n is a, c, g, or t
tcagtgtgagtagtcacgaccggtgctcgatttagagtatacatattgggttggccgtattaaaaccaaaagtgagggtgggacagtagactacgttgcacccgtgagaggcagattcgccatctcaagagatgattcagaaggcacgttgtatctgcaaatgaacagcctgacaatcgaggacacagccgtgtattactgttccgcagggctcggtcactccgataatgactattgggccagggaccctggtcaccgtctcctcagcctccaccaacggcccatcggtcctcccctggccgccctgctccaggacgcacctcgagagcacngcggccctgggctgcctggtacaaggactactccactacncacactgcgcgggctggacaaggcgacatagnnnnnnnnnnnnnnnnnnnnnnn

SEQ ID NO: 166180 - DNA, 550 bp, Homo sapiens
  misc_feature: GYAE6OF02IT2O3.43.67.G01.1.454.CMB.1.raw
  modified_base (447)..(447): a, c, t, g, unknown or other
  misc_feature (447)..(447): n is a, c, g, or t
tcagtgtgagtagtcacgaccggtgctcgatttagagtatacatattgggtttggggggagaggagccccagccttgggattcccaagtgttttcattcagtgatcaggactgaacacagaggactcaccatggagtttgggctgagctggattttccttgctgctattttaaaaggtgtccagtgtgaggtgcagttggtggagtccgggggggcctggtaccgccgtgggggtcccttagactctcctgtgtaacctctggattcaccctcagtaacgtctggatgagctggttccgccaggctccgagggaaggggctggagtgggttggccgtattaaaaccaaagtgagggtgggacagtagactacgttgcaccgtgagagcagattcgcatctcaagagatgatttacgagaaggctacgttgtatctgacaaatgaacngcctagacatcgagacacagccgtatacttactgttccgcgagggctcggtcacgtccgataactgaactagttgggccagggaccctggtccaccgtctccg

SEQ ID NO: 166181 - DNA, 565 bp, Homo sapiens
  misc_feature: GYAE6OF02H5M24.43.67.G01.1.454.CMB.1.raw
  modified_base (501)..(501): a, c, t, g, unknown or other
  misc_feature (501)..(501): n is a, c, g, or t
  modified_base (523)..(523): a, c, t, g, unknown or other
  misc_feature (523)..(523): n is a, c, g, or t
  modified_base (556)..(556): a, c, t, g, unknown or other
  misc_feature (556)..(556): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcagttggtggagtccggggggggcctggtaccgcctggggggtcccttagactctcctgtgtaacctctggattcacctcagtaacgtctggatgagctggttccgccaggctccgaggggaaggggctgggagtgggttggccgtaattaaaaccaaagtgagggtgggacagtagactacgttgccgacccgtgagaggcagattcgccatctcaagagatgattcgaagaaggctaacgttgtatctgacaaatgaacagcctagacaatcgaaggacacagccgtagtaacttctcgttccgngagggctcggcactcgaataangaacttgtcggggaccagggaccctgggtaccnccgtctccg

SEQ ID NO: 166182 - DNA, 608 bp, Homo sapiens
  misc_feature: GYAE6OF02F5221.43.67.G01.1.454.CMB.1.raw
  modified_base (521)..(521): a, c, t, g, unknown or other
  misc_feature (521)..(521): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcagttggtggaggtccggggggggcctggtaccgccgtggggggtcccttagactctcctgtgtaacctctggattcaccctcagtaacgtctggatgagctggttccgccaggctccgaggggaagggctgggagtggggttggccgtaattaaaaccgaaaggtgaggggtggacagtagactacgttgcacccgtgagaggcagattcgccatctcaagagatgattcgaaggaaggctacggtttgtaatcgtagacaaaagtcgaaacagccttagaacaaagtcgaaggacacgagccgtagtaacttacgtcgttcccgngtacgggcctccgggtcactccgaattaacgtcgaacgttagtcggggaccaggggtaacccctgggtaccctaccggtctaccccg

SEQ ID NO: 166183 - DNA, 414 bp, Homo sapiens
  misc_feature: GYAE6OF02FV9W2.43.67.G01.1.454.CMB.1.raw
  modified_base (305)..(305): a, c, t, g, unknown or other
  misc_feature (305)..(305): n is a, c, g, or t
  modified_base (378)..(378): a, c, t, g, unknown or other
  misc_feature (378)..(378): n is a, c, g, or t
  modified_base (405)..(414): a, c, t, g, unknown or other
  misc_feature (405)..(414): n is a, c, g, or t
tcagtgtgagtagtcacgaccggtgctcgatttagagtatacatattgggttggccgtattaaaaccaaaagtgagggtgggacagtagactacgttgcacccgtgagaggcagattcgccatctcaagagatgattcagaaggcacgttgtatctgcaaatgaacagcctgacaatcgaggacacagccgtgtattactgttccgcagggctcggtcactccgataatgactattggggccagggaaccctggtcaccgtctcctcagcctccaccaagggcccatcggtcttccccctggccnccctgctccaggacgcacctccgagagcacagcgccctgggctgcctggtcaaggctacttccactactcacnctgacgcgggctggcaaggcgcatagnnnnnnnnnn

SEQ ID NO: 166184 - DNA, 633 bp, Homo sapiens
  misc_feature: GYAE6OF02I5IBV.43.67.G01.1.454.CMB.1.raw
  modified_base (401)..(401): a, c, t, g, unknown or other
  misc_feature (401)..(401): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcagttggtggaggtccggggggggcctggtaccgccgtggggggtcccttaggactctcctgtgtaacctctggattccaccctcagtaacgtctggatgagctggttcccgccaggcctccgaggggaaggggctgggaggtgggttggaccgtaataaaaccaaaggtggagggtgggacaggtagacgtagtgccaccgtgagngcagatcgcatctcaagagatgattcgaaggaacggcacgtttgtaactctacggacaaaattgaaacagtccctagaacctaagtccggaaggaccacgagtacccggtagttaacttacgtcggttacccgagtacgggtcctccggtactaccgtaccgaattaactcgtacttaaggttccggggaccctaaggggtaaccccctggtaccctacccggttctacccg

SEQ ID NO: 166185 - DNA, 560 bp, Homo sapiens
  misc_feature: GYAE6OF02GJI63.43.67.G01.1.454.CMB.1.raw
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcagttggtggagtccggggggggcctggtaccgctggggggtcccttagactctcctgtgtaacctctggattcaccctcagtaacgtctggatgagctggttccgccaggctccgaggggaagggctgggagtgggttggccgtattaaaaccaaaagtgagggtggacagtagactacgttgcaccgtgagaggcagattcgcatctcaagagatgattcagaaggcacgttgtatctgcaaatgaaacagcctgacaatcgaggacacagccgtagtacttacgtcgttccgcagggctcggtcacgtccgaataacgtgactagttcgggaccacgggacccttggtcctaccgtcctcccg

SEQ ID NO: 166186 - DNA, 443 bp, Homo sapiens
  misc_feature: GYAE6OF02IYMJT.43.67.G01.1.454.CMB.1.raw
  modified_base (377)..(377): a, c, t, g, unknown or other
  misc_feature (377)..(377): n is a, c, g, or t
  modified_base (413)..(413): a, c, t, g, unknown or other
  misc_feature (413)..(413): n is a, c, g, or t
  modified_base (420)..(443): a, c, t, g, unknown or other
  misc_feature (420)..(443): n is a, c, g, or t
tcagtgtgagtagtcacgaccggtgctcgatttagagtatacatattgggttggccgtattaaaaccaaaagtgagggtgggacagtagactacgttgcacccgtgagaggcagattcgccatctcaagagatgattcagaaggcacgttgtatctgcaaatgaacagcctgacaatcgaggacacagccgtgtattactgttccgcagggctcggtcactccgataatgactattggggccagggaccctggcaccgtctcctcagcctccaccaagggcccatcggtctcccctggcgccctgcctccaggagccacctccgagagccacgagccggccctgggctcgccgtggtcaaggactacttccactacncaaccactggacgcggggctacgggccaaggccganagtagcnnnnnnnnnnnnnnnnnnnnnnnn

SEQ ID NO: 166187 - DNA, 581 bp, Homo sapiens
  misc_feature: GYAE6OF02IANTF.43.67.G01.1.454.CMB.1.raw
  modified_base (447)..(447): a, c, t, g, unknown or other
  misc_feature (447)..(447): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcagttggtggagtccggggggggcctggtaccgccgtggggggtcccttagactctcctgtgtaacctctggattcaccctcagtaacgtctggatgagctggttccgccaggctccgagggaagggctggagtgggttggccgtattaaaaccaaagtgagggtggacagtagactacgtgcaccgtgagagcagattcgccatctacagagatgattcgaagaggctagttgtatctgacaaagtgaaacngcctagacaatcgaagacacgagccgtagtacttacgtcgttccgcgaggctccggtacaccgtaccgaattaactcgtaacgttagttcggggacccaacggggtaccctgggtacctacccggtctaccccg

SEQ ID NO: 166188 - DNA, 566 bp, Homo sapiens
  misc_feature: GYAE6OF02GJFRQ.43.67.G01.1.454.CMB.1.raw
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcagttggtggagtccggggtgggcctggtaccgcctgggggtcccttagactctcctgtgtaacctctggattcaccctcagtaacgtctggatgagctggttccgccaggctccagggaaggggctggagtgggttggccgtattaaaaccaaaagtgagggtgggacgagtagactacgttgcacccgtgagaggcagattcgccatctacaagagatgattacagaaggcacgttgtatctgacaaatgaacagcctgacaatcgagacacagcgtgtattactgtccgcgaggcgtcgtcacgtcgaattactacgtaacttaggttacggggccgaaccgggtaaccctcggtaccgaccgttcccg

SEQ ID NO: 166189 - DNA, 628 bp, Homo sapiens
  misc_feature: GYAE6OF02GMEUX.43.67.G01.1.454.CMB.1.raw
  modified_base (520)..(520): a, c, t, g, unknown or other
  misc_feature (520)..(520): n is a, c, g, or t
tcagtgtgagtagtcacgaccggtgctcgatttagagtatacatattgggtttggggggggagaggagccccagccttgggattcccaagtgttttcattcagtgatcaggactgaacacagaggactcaccatggagtttgggctgagctggattttccttgctgctattttaaaaggtgtccagtgtgaggtgcagttggtggaggtccggggggggcctggtaccgccgtggggggtcccttagactctcctgtgtaacctctggattcaccctcagtaacgtctggatgagctggttccgccaggctcgagggagggctggagtgggtgaccgtaataaaccaaagtggagggtgggacagtagactacgtgcaccgtgagaggcagattcgcatctacaagagatgattcgaaggtaaggctacggtttagtacttcgtagacctaaaagtcgaactacgacctagaacaagtcggaaggtaccacgacgccgttagtattaccgtgttacccgngacgggtctaccggtccaaccgtacccggaattaacgtgtaacgttacggttacggggacccgtaacggggtaaccccgttggggtacccttacccggtcctaccccg

SEQ ID NO: 166190 - DNA, 627 bp, Homo sapiens
  misc_feature: GYAE6OF02F2P33.43.67.G01.1.454.CMB.1.raw
  modified_base (402)..(402): a, c, t, g, unknown or other
  misc_feature (402)..(402): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcagttggtggagtccggggggggcctggtaccgcctggggggtcccttagactctcctgtgtaacctctggattcaccctcagtaacgtctggatgagctggttccgccaggctccgagggagggctggagtgggtggccgtataaaccgaaagtgagggtggacagtagactacgtgcaccgtgagaggcagattcgcatctcaagngatgatcaagaaggctaacgtttgtactcgtagacaaaagtcgaaaccgagcccctagaacaacgtcggaacgacacgagtcccgtagttacttacgtcgtttaccgacgtacggggccttccgggtacctaacctcccgttaaataacggttcgtaaccgttacggttcgggggacccctaacgggggaccccttggggtaccctacccggtcccttaccccgg

SEQ ID NO: 166191 - DNA, 659 bp, Homo sapiens
  misc_feature: GYAE6OF02HUFFI.43.67.G01.1.454.CMB.1.raw
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcagttggtggaggtccgggggggcctggtaccgccgtgggggtccctagactctcctgtgtaacctctggattcacctcagtaacgtctggatgagctggtccgccgaggctccgaggggaagggctgggaggtgggttcggaccgtaattaaaaccgaaaaggtggaaggggtgggaacaggtagacgtacgttgaccaccgtgagaggcagatttcgccatactcaagagatgattacgaagaaggctacgttgtatctagacaaagtgaaacacgtcctagaacctaagcgaggaacacgacgtccgtagttaacttacgttcgttacccgacgtacgggtcctacgggtaccgtaccgttaccgaacgttaacgtcggtaaccgtttaacgggttcggggtaccccggaaacggggttaaccccgttcgggttaaccccgtacccggtttccttaccccgg

SEQ ID NO: 166192 - DNA, 682 bp, Homo sapiens
  misc_feature: GYAE6OF02FPDWO.43.67.G01.1.454.CMB.1.raw
tcagtgtgagtagtcacgaccggtgctcgatttagagtatacatattgggtttggggggagaggagccccagccttgggattcccaagtgttttcattcagtgatcaggactgaacacagaggactcaccatggagtttgggctgagctggattttccttgctgctattttaaaaggtgtccagtgtgaggtgcagttggtggaggtccgggggggcctggtaccgccgtgggggtcccttagactctcctgtgtaacctctggattcaccctcagtaacgtctgatgagcgtggttccgccgacggcgtccgagggaaggggcgtggaggtgggttgggccggtaacgttaaaaccgaaaagtacccccccggagggtagggacgagtagacgtacgttcgcgaccgtagagaggcgagagtcgccatctacaagagatagtattacgagaaggacgtacgttagtatcgtagacaaatagaacgacgaccgtacgaacgaagtacggaacggaacgaacgacgaccgttacgttaacgtttacgttacgttccgtaccgtacgggtccgtccggtaccgtaccgtaccgtaacgttaacgttacgtaacgttacggttacggggtacccggtaaccgggtaacccggttaccgggtacccgtacccgttacccgtacccg

SEQ ID NO: 166193 - DNA, 641 bp, Homo sapiens
  misc_feature: GYAE6OF02F1YK1.43.67.G01.1.454.CMB.1.raw
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgctattttaaaagtgtccagtgtgaggtgcagttggtggaggtccggggggggcctggtaccgcctggggggtcccttaggactctcctgtgtaacctctggattcaccctcagtaacgtctggatgagctggttccgccaggctccgaggggaaggggcgtgggaggtggggttggaccgtaattaaaaccgaaaaggtggaggggtgggacagtagactacgttgcaccgtgacgaggcagatcgccatctacgaagagatgattcgaaggacggctacggttgtaatcgtagacaaatgaactaggcctagaacgtaagtcgaaggaaccacgaggtcccgttagtactttacgtcgttccgacgtacgggccttccgggtacaccgtaccgtaattaacgtcgtaaccgttacggtccggggacccgtaacggggtaaccccgttacggtcccgtacccggttccctaccccg

SEQ ID NO: 166194 - DNA, 605 bp, Homo sapiens
  misc_feature: GYAE6OF02HRJ6F.43.67.G01.1.454.CMB.1.raw
  modified_base (363)..(363): a, c, t, g, unknown or other
  misc_feature (363)..(363): n is a, c, g, or t
  modified_base (399)..(399): a, c, t, g, unknown or other
  misc_feature (399)..(399): n is a, c, g, or t
  modified_base (404)..(404): a, c, t, g, unknown or other
  misc_feature (404)..(404): n is a, c, g, or t
tcagtgtgagtagtcacgaccggtgctcgatttagagtatacatattgggtttgggggggagaggagccccagccttgggattcccaagtgtttttcattcagtgatcaggactgaacacagaggactcaccatggagtttgggctgagctggattttccttgctgctattttaaaaggtgtccagtgtgaggtgcagttggtggaggtccggggggggcctggtaccggccgtggggggtcccttagactctcctgtgtaactctggattcaccctcagtaacgtctggatgagctggtccgccaggctccgagggaaggggctggaggtggttggcgtaataaacaaagtggagggtgganagtagactagtgcaccgtgagaggcagatcgcatcncaagngatgattcagaagctacgttgtatcgtagacaaagtcgaaagacgcctagacaaagtcgaacggacaaccgtagcccgtagttaattaccgttgttcccggacgacgggccgtcggtacctaccgtccgtaattaacgtgaacgttacgttcggggaccctacggggtaaccccgttgggtaccgtccccgtcgtaccccg

SEQ ID NO: 166195 - DNA, 769 bp, Homo sapiens
  misc_feature: GYAE6OF02J1QGA.43.67.G01.1.454.CMB.1.raw
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgctattttaaaaggtgtccagtgtgagtgcagttggtggaggtccgggggggcctggtaccgccgtcgggggtcctagactctcctgtgtaacctctggacttcaccctcacgtaacgtctggatgagtctcggttccgcacggctccggaggggaagggcgtggaggtgggttggaccgtaattaaaaccgaaagtgggagggtaggacaggtacgtacgttacgtcgaccgaccgtaggacggtacggcgagtacttccgactactactaacggaaggtacgtatacgtactttacgaagggtaacggtactaacggtttgtaccgttactaggaaacctaaaagtcggaaaacgtcgtacccgtaacgtaaaccgtagtaccggtaagaaccgtacgtaaaccggttcccgtttaaatttaaccgtttaccgtttaccggtacccggtacggtaacggggttcccttacccgggtacttaacccggtaaccggtaaatttaaccggtagttaaaccggtttacgggtaccgggggaaccccggttaacccgggtaacccgggttccgttaacccccggttaccggttcccctttaaccccgg

SEQ ID NO: 166196 - DNA, 618 bp, Homo sapiens
  misc_feature: GYAE6OF02FXJX4.43.67.G01.1.454.CMB.1.raw
  modified_base (452)..(452): a, c, t, g, unknown or other
  misc_feature (452)..(452): n is a, c, g, or t
  modified_base (472)..(472): a, c, t, g, unknown or other
  misc_feature (472)..(472): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcagttggtggagtccgggggggcctggtaccgccgtggggggtcccttagactctcctgtgtaacctctggattcaccctcagtaacgtctggatgagctggttccgccaggctccgagggaaggggctgggagtgggttggccgtattaaaaccaaagtggagggtggacagtagactacgttgccaccgtgagaggcagatcgcatctcaagagatgattcgaagaaggctacgttgtatcgtagactaatgaacngcctagacaagtcgaagacncgacgcgttagtacttacgtcgttaccgcggtacgggccttcggtacctaccgtaccggtaaattaacgtacggtaacgttacggttaccggggacccgtaacggggtaaccccttgggtaacccctacccggttcccttaccccg

SEQ ID NO: 166197 - DNA, 591 bp, Homo sapiens
  misc_feature: GYAE6OF02GDBB2.43.67.G01.1.454.CMB.1.raw
  modified_base (446)..(446): a, c, t, g, unknown or other
  misc_feature (446)..(446): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcagttggtggagtccggggggggcctggtaccgccgtggggggtcccttagactctcctgtgtaacctctggattcaccctcagtaacgtctggatgagctggttccgccaggcctcgagggaagggctgggagtggtgcgtataaaaccaaagtgaggtggacagtagactagtgccaccgtgagaggcagattcgccatctcaagagatagattcagaaggtcacgtttgtatcgtagacaaatgaaacngtaccctagaacaacgtcggaaggaacacgagtcccgtagttaacttaccgttgttcccgacgtagggcctcggtaccacgtccgaataacgttcaacgttagtcggggaccaacgggtaccctgggtacccaccggtctacccg

SEQ ID NO: 166198 - DNA, 780 bp, Homo sapiens
  misc_feature: GYAE6OF02JMSX5.43.67.G01.1.454.CMB.1.raw
tcagtgtgagtagtcacgaccggtgctcgatttagagtatacatattgggtttgggggggagaggagccccagccttgggattcccaagtgttttcattcagtgatcaggactgaacacagagactcaccatggagtttgggctgagctggattttccttgctgcttattttaaaaggtgtcagtgtgaggtgcagttggtggaggtccggggggctggtaccgccgtcgggggtcctagactcctccgtgtcgtaacctctggattccaccctcacgttaacgtctggatgagcgttcggttcccgccgaggcctccggaaggggaacggggtcgtaggggtaggttggggttcggaccggttaaacgtttaaaaaccgaaaaggttgggaacggggttgggaaacgtaaggtaacggtaacgttaaccggttaggaccctaaccccggttggaacgggtacggacgtaaggtaacgtttccggacctaacttcccgttaacgaaaggagtaacgttagtaacgtttacgaacgggtaaacggtccgttaacgggtttagttaacgttaccgtacggtaaactaaacgacgtaaacgaacgaccgttagaaactacgtacggaaggtaccaacggacgtccggttaagtacgtttaacgtcggttaccgacgtaccgggtctaccggttcgaaccgttacggaattaacgtcggtaaccgttcggtaccgggtaccggtaaccgggtccctcgggttaacccgtcccgtccgtacccgg

SEQ ID NO: 166199 - DNA, 603 bp, Homo sapiens
  misc_feature: GYAE6OF02IORL5.43.67.G01.1.454.CMB.1.raw
  modified_base (373)..(373): a, c, t, g, unknown or other
  misc_feature (373)..(373): n is a, c, g, or t
  modified_base (377)..(377): a, c, t, g, unknown or other
  misc_feature (377)..(377): n is a, c, g, or t
  modified_base (393)..(393): a, c, t, g, unknown or other
  misc_feature (393)..(393): n is a, c, g, or t
  modified_base (519)..(519): a, c, t, g, unknown or other
  misc_feature (519)..(519): n is a, c, g, or t
tcagtgtgagtagtcacgaccggtgctcgatttagagtatacatattgggtttggggggggagaggagccccagccttgggattcccaagtgttttcattcagtgatcaggactgaacacagaggactcaccatggagtttgggctgagctggattttccttgctgctattttaaaaggtgtccagtgtgaggtgcagttggtggaggtccgggggggcctggtaccgccgtgggggtcccttagactctcctgtgtaacctcgtggattccacctcagtaacgtctggatgagctggtccgcagctcgagggagggctggagtgggtcggcgtaataaacgaagtgaggtggacagtagactgtgcgaccgngagngcagtatcgcatctanaagagatagtactacgaggtaaacgctacgtgtattcgaggactaaaggtcgaaagtcgtaaccgtagtaacgaacgtcgaacgggtacaaccggagtcccgttagttaacgttctcggttaccgngtcggtaccgtcgtactacgtcgtaagtactcgaagttcggtagggacctacggggtaccctaggtaccgtacccgtgtacccg

SEQ ID NO: 166200 - DNA, 656 bp, Homo sapiens
  misc_feature: GYAE6OF02JDVN3.43.67.G01.1.454.CMB.1.raw
  modified_base (275)..(275): a, c, t, g, unknown or other
  misc_feature (275)..(275): n is a, c, g, or t
  modified_base (358)..(358): a, c, t, g, unknown or other
  misc_feature (358)..(358): n is a, c, g, or t
  modified_base (387)..(387): a, c, t, g, unknown or other
  misc_feature (387)..(387): n is a, c, g, or t
  modified_base (397)..(397): a, c, t, g, unknown or other
  misc_feature (397)..(397): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgctaattttaaaaggtgtccagtgtgaggtgcagttggtggaggtccgggggggctggtaccgccgtgggggtccctagcctctcctgtgtaacctctggacttcaccctnacgtactctggatgagcgtggtccgccaggctccgaggggagggctggagtgggtgcgtaataaaaccaaagtgagggtgganagtagactacgtgccaccgtgagagcagngtcgcatctnaagagatgatcgaaggaagtctaacgtttgtatcgtagactaaaagtcgaaacacgtaccctagaacctaaagtccggaaacgaaccacgaacgtcccggttaattaaccgtttaaccgtgttaacccggcgtaaacgggggtccttcccgggtactaccggttacccgaaatttaaccggtaggtaaacctttagggttaccgggggaccccgtaaacggggtaaccccgtgggttaccccgtaccccgttactcccg

SEQ ID NO: 166201 - DNA, 710 bp, Homo sapiens
  misc_feature: GYAE6OF02HTN91.43.67.G01.1.454.CMB.1.raw
  modified_base (430)..(430): a, c, t, g, unknown or other
  misc_feature (430)..(430): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgctattttaaaggtgtccagtgtgaggtgcagttggtggaggtccgggggggcctggtaccgccgtggggggtcccttagacctctcctgtgtaacctctggtattccaccctcaagtaacgtctaggatgagcgtggttccgccgaggctccgaggggacggggcgtgggaggtgggttcggaccgtaattaaaaccaaaggtcggagggtggacaggtacgactagttgacgaccgtgagagcagtatcgactatctacgaagngatagattacgaaggaacgtactacgttgtattccgagtaaccaaaagttcggaaacgcgtacccgttaagaaacctaaaggtccgggaaacggacaaccgtaaggtcccgtttagttaacttaccgttcggttacccggactaacgggggttcctaccggtaccctaaccggttacccgtaagttaaacgtcggttaaaccgttacgggttacccggggacccgtaaaccggggggtaacccctttcggggtaacccctacccggttacccttaccccg

SEQ ID NO: 166202 - DNA, 604 bp, Homo sapiens
  misc_feature: GYAE6OF02FSMCW.43.67.G01.1.454.CMB.1.raw
  modified_base (404)..(404): a, c, t, g, unknown or other
  misc_feature (404)..(404): n is a, c, g, or t
  modified_base (432)..(432): a, c, t, g, unknown or other
  misc_feature (432)..(432): n is a, c, g, or t
  modified_base (452)..(452): a, c, t, g, unknown or other
  misc_feature (452)..(452): n is a, c, g, or t
  modified_base (509)..(509): a, c, t, g, unknown or other
  misc_feature (509)..(509): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcagttggtggaggtccggggggggcctggtaccgccgtggggggtcccttaggactctcctgtgtaacctctggattcaccctcacgtaacgtctggatgagctggttccgccaggctccgagggagggctggagtgggtggccgtaataaaaccgaaagtgagggtggacagtagactacgtgcaccgtgagaggcagattcgcatctnaagagatgattcaagaaggcacggtttnatctagactaaatcgaaacngtcctagacaagtacggaggaccagacggtcccgtagttaacttaccgtgttcccgngtacgggccttcgggccaccgttccggaataacgtcgtaacgttagttcggggacctaacggggtaacccctgggtcctacccggtcttaccccg

SEQ ID NO: 166203 - DNA, 719 bp, Homo sapiens
  misc_feature: GYAE6OF02FIECA.43.67.G01.1.454.CMB.1.raw
  modified_base (406)..(406): a, c, t, g, unknown or other
  misc_feature (406)..(406): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcagttggtggaggtccgggggggctggtaccgccgtgggggtcccttagctctcctgtgtaacctctggacttcaccctcagtaacgtctggatgagctggttccgccaggcctccgagggggtaacgggcgtgggaggttgggttcggtaccgtaaattaaaaccgaaaaggtggaggggtgggacaggtagactacgtgccaccgtgagnggcagattcgcatctacaagagatgaattcgaaggaacggtcctaaagtttgtaactcgtacgaacctaaaagtacgaaacgcggtaccccgttagaaacctaaacgttcccgggaaaggtaaccaaccgtaagggtccccgtttaaggtttaaaccgtttacccgtttacggtaccccggtacggtaacggggtcccgttacccggttaccaaccgtttaccccggaattaaaggtaccggaacgtttacgggttccgggggaccctaaccggggtaaccccgtcgggtaccccgacccggttccctacccg

SEQ ID NO: 166204 - DNA, 410 bp, Homo sapiens
  misc_feature: GYAE6OF02FXIKC.43.67.G01.1.454.CMB.1.raw
  modified_base (307)..(307): a, c, t, g, unknown or other
  misc_feature (307)..(307): n is a, c, g, or t
  modified_base (321)..(321): a, c, t, g, unknown or other
  misc_feature (321)..(321): n is a, c, g, or t
  modified_base (337)..(337): a, c, t, g, unknown or other
  misc_feature (337)..(337): n is a, c, g, or t
  modified_base (384)..(384): a, c, t, g, unknown or other
  misc_feature (384)..(384): n is a, c, g, or t
  modified_base (405)..(410): a, c, t, g, unknown or other
  misc_feature (405)..(410): n is a, c, g, or t
tcagtgtgagtagtcacgaccggtgctcgatttagagtatacatattgggttggccgtattaaaaccaaaagtgagggtgggacagtagactacgttgcacccgtgagaggcagattcgccatctcaagagatgattcagaaggcacgttgtatctgcaaatgaacagcctgacaatcgaggacacagccgtgtattactgttccgcagggctcggtcactccgataatgactattggggccagggaaccctggtcaccgtctcctcagccctccaccaagggccccatcggtcttcccccctggcnccctgctccaggcncacctccgagagcacngcggccctgggctgcctggtcaaggctacttcactactcacactgancgggctggcaaggcgcatagnnnnnn

SEQ ID NO: 166205 - DNA, 572 bp, Homo sapiens
  misc_feature: GYAE6OF02GHBZC.43.67.G01.1.454.CMB.1.raw
  modified_base (401)..(401): a, c, t, g, unknown or other
  misc_feature (401)..(401): n is a, c, g, or t
  modified_base (469)..(469): a, c, t, g, unknown or other
  misc_feature (469)..(469): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcagttggtggagtccgggggggcctggtaccgccgtgggggtcccttagactctcctgtgtaacctctggattcaccctcagtaacgtctggatgagctggttccgccaggcctccgagggagggctggagtgggttgccgtataaaccaaagtgagggtggacaggtagactacgttgcaccgtgagaggcagattcgccatctanaagagatgattcgaagaaggcacgttgtatcagacaaatcgaacagcctagaaccaatcgaggacacngccgtagtattacgtgttccgacgagggccttcgggactaccgtccgaattaacgtcgaacttagtgggacctacggggtaccctggtccaccggtctacccg

SEQ ID NO: 166206 - DNA, 783 bp, Homo sapiens
  misc_feature: GYAE6OF02JSJME.43.67.G01.1.454.CMB.1.raw
  modified_base (418)..(418): a, c, t, g, unknown or other
  misc_feature (418)..(418): n is a, c, g, or t
tcagtgtgagtagtcacgaccggtgctcgatttagagtatacatattgggtttgggggggaggaggagccccagccttgggattcccaagtgttttcattcagtgatcaggactgaacacagaggactcaccatggagtttgggctgagctggattttccttgctgctatttaaaggtgtccagtgtgaggtgcaggttggtggaggtccggggggccgtggtaccgcgtcgggggtcccttagaccgtctcctgtcgtaacctctggtacgttcacccgtcaacggtaacgtctggtatgagtcgtggttccgcgaggctaccgagggacgggctgggaggtgggttggaccggtaagtaaaaccgaaaaggtggagggtacgggataacggtacgtacgtacgttgaccgtaccgngtaacggaggcgtaagtagtaccgcgatactacgaacgagtctagtaacttacgaaggtaaacggtctaaacggtttcgttatacgtcgaaagtaaacgaggtaaccaatcccgaaagtaacccgagttaccgggaaacggtaaccctaagggtccgttaaacccggttgttaaccgtttaaccgtcgttacccgaaacgggtaaccggtccggtttaccccggtaccgttaacctaacccggggttaaactttaccggttaaggaaccccttttaaggggggtttaccgggaaacccccggtttaacggggtaaccccggttacccgggggtttacctaaccccggtttacccggttacccccg

SEQ ID NO: 166207 - DNA, 742 bp, Homo sapiens
  misc_feature: GYAE6OF02I9WAV.43.67.G01.1.454.CMB.1.raw
  modified_base (349)..(349): a, c, t, g, unknown or other
  misc_feature (349)..(349): n is a, c, g, or t
tcagtgtgagtagtcacgaccggtgctcgatttagagtatacatattggggtttgggggggagaggagccccagccttgggattcccaagtgttttcattcagtgatcaggactgaacacagaggactcaccatggagtttgggctgagctggtattttcctgctgtcttaattttaaaggtgtccagtgtgaggtgctaggttggtggaggtccgggggggcctacgggtccggccggtgggggtccctaggacttccgtcctggtcgtaacctcgtggtacttccaccctcacgtaacgtcgtggatgagtcgtcggttccgcgacgctaccggagggagggctggnggttggtggaccgtaataaaacgaaggtggaagggtggacaggtagacgtacgtgaccgaccgtagaggagcgtaagcgtacgacctaagtaccgtacgtaaagagtaacgtcgtaattcaaacggggtaacgtcggttaaacggtttcgtaaagttccgtaggtaaactaaaacgttacggaacctaacggtaacccttgggaaaaccttaaacgtcgggaacggtaacccaaggtacccggtaccgtttaagttaacttaacccggtttcgtaccggaccgttaacggggtccttaccggtaccgtaccgttaaccgaagtaacgtcgaacgggtttaccggtacgggacccgttaacgggacccgttaggtacccgtacgtccccgtacg

SEQ ID NO: 166208 - DNA, 595 bp, Homo sapiens
  misc_feature: GYAE6OF02F68OE.43.67.G01.1.454.CMB.1.raw
  modified_base (279)..(279): a, c, t, g, unknown or other
  misc_feature (279)..(279): n is a, c, g, or t
  modified_base (306)..(306): a, c, t, g, unknown or other
  misc_feature (306)..(306): n is a, c, g, or t
  modified_base (407)..(407): a, c, t, g, unknown or other
  misc_feature (407)..(407): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgctattttaaaggtgtccagtgtgaggtgcagttggtggaggtccggggggggcctgggtaccgccgtggggggtcccttagactctcctgtcgtaacctctggattccaccctnagtaacgtctggatgagtctggttccncgaggctccgagggaggctgggaggtgggtgaccgtaataaaccgaaagtgagggtggacagtagactacgttgccaccgtgagagcgagattcgccatcncaagagatagatcgaagtagcctaggttgtatcgtagaacaaagtgaacagccgtagaactagtcgaaggacacgaggtccgtagttactcgttcgttccgcggacgtccgtcggtacacgtccgaagtaactgacgttaaggttcggggacctacgggtaccctggtacctacccggtccttacccg

SEQ ID NO: 166209 - DNA, 568 bp, Homo sapiens
  misc_feature: GYAE6OF02GHQD5.43.67.G01.1.454.CMB.1.raw
  modified_base (445)..(445): a, c, t, g, unknown or other
  misc_feature (445)..(445): n is a, c, g, or t
  modified_base (493)..(493): a, c, t, g, unknown or other
  misc_feature (493)..(493): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcagttggtggagtccgggggggcctggtaccgcctgggggtccttaggactctcctgtgtaacctctggattcaccctcagtaacgtctggatgagctggttccgccaggctccgagggaaggggctgggaggtgggtggaccgtattaaaaccgaaagtgagggtggacagtagactacgtgcaccgtgagaggcagattcgcatctacaagagatgattcagaaggcacgttgatcagacaaatgaacngcctagaaccaagtcgaagacagacgccgtattactacgtcgtccgancgggctcggtcacgtccgaataactcgtaactggttcgggacctacgggtaaccctggaccctaccgtctacccg

SEQ ID NO: 166210 - DNA, 621 bp, Homo sapiens
  misc_feature: GYAE6OF02H4KI0.43.67.G01.1.454.CMB.1.raw
  modified_base (307)..(307): a, c, t, g, unknown or other
  misc_feature (307)..(307): n is a, c, g, or t
  modified_base (383)..(383): a, c, t, g, unknown or other
  misc_feature (383)..(383): n is a, c, g, or t
  modified_base (393)..(394): a, c, t, g, unknown or other
  misc_feature (393)..(394): n is a, c, g, or t
  modified_base (411)..(411): a, c, t, g, unknown or other
  misc_feature (411)..(411): n is a, c, g, or t
  modified_base (443)..(443): a, c, t, g, unknown or other
  misc_feature (443)..(443): n is a, c, g, or t
  modified_base (454)..(454): a, c, t, g, unknown or other
  misc_feature (454)..(454): n is a, c, g, or t
tcagtgtgagtagtcacgaccggtgctcgatttagagtatacatattgggtttggggggggagaggagccccagccttgggattcccaagtgttttcattcagtgatcaggactgaacacagaggactcaccatggagtttgggctgagctggattttcctgctgctatttaaaaggtgtccagtgtgaggtgcagttggtggaggtccgggggggggcctggtaccgccgtggggggtccccttaggacctctcctgtcgtaacctctggattccaccctcagtaacgtctggatgagctggtccncaggctcgagggagggctggaggtgggttggacgtaataaaaccgaaagtggagggtggacagtagactacgtgcnccgtgagagnngtatcgcatctacaagngatgtattcaggaagctacgtgtatcgtaganaaatgaaaccngtaccgtagaacctaagtacggaacggaacacgacggtccgttagttaactacgtttcggtcccgaaggtcgggtcctcggtaccaccgtacgtaataacgtcggtaacgtttaggccggggaacctaacggggaaccccttcggtaccgtaccccgttctacccgg

SEQ ID NO: 166211 - DNA, 585 bp, Homo sapiens
  misc_feature: GYAE6OF02GZSJU.43.67.G01.1.454.CMB.1.raw
  modified_base (383)..(383): a, c, t, g, unknown or other
  misc_feature (383)..(383): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcagttggtggagtccggggggggcctgggtaccgccgtggggggtcccttagactctcctgtgtaacctctggattcaccctcagtaacgtctggatgagctggttccgccaggctccagggagggctggagtgggttgccgtataaaccaaagtgagggtggacagtagactacgttgcaccgtgagnggcagattcgcagtctcaagagatgattcagaagcagttgactctgacaaatgaacagcctgaacatcgaaggcacgagccgtgtaacttactcgttccgcgtaagggcctacgggtccaaccgtccgaataacgttgaaccgttaggtttcgggggaccctaagggggtaacccccttgggtcccgtaccgttctaccccg

SEQ ID NO: 166212 - DNA, 651 bp, Homo sapiens
  misc_feature: GYAE6OF02H0YP7.43.67.G01.1.454.CMB.1.raw
  modified_base (302)..(302): a, c, t, g, unknown or other
  misc_feature (302)..(302): n is a, c, g, or t
  modified_base (366)..(366): a, c, t, g, unknown or other
  misc_feature (366)..(366): n is a, c, g, or t
  modified_base (384)..(384): a, c, t, g, unknown or other
  misc_feature (384)..(384): n is a, c, g, or t
  modified_base (407)..(407): a, c, t, g, unknown or other
  misc_feature (407)..(407): n is a, c, g, or t
  modified_base (416)..(416): a, c, t, g, unknown or other
  misc_feature (416)..(416): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcagttggtggagtccgggggggctggtaccgccgtggggggtccttagactctcctgtgtaacctctggattccacctcagtaacgtctaggatgagctcgggttccnccgaggcctccgaggggaagggctggagtggggttggaccgtaataaaaccgaaagtgtagggnggacagtagactacggtncgaccgtgagagcagattcgcanctacgaagngatagattacagaagctacgttgtatcgtagactaaagtacgaactacgacttagaactaaagtccggaacgtaacaccgtagcccgttaagtaacgttacgttacgttccggaacgtcgggtacctcgggtactaaccggtccgaaagttaacgttgtaaaccgttaggtttccgggggaacccgttacggggtaaacccccgttagggtacccctaccggttcccttacccgg

SEQ ID NO: 166213 - DNA, 814 bp, Homo sapiens
  misc_feature: GYAE6OF02JDYPM.43.67.G01.1.454.CMB.1.raw
  modified_base (619)..(619): a, c, t, g, unknown or other
  misc_feature (619)..(619): n is a, c, g, or t
  modified_base (695)..(695): a, c, t, g, unknown or other
  misc_feature (695)..(695): n is a, c, g, or t
  modified_base (717)..(717): a, c, t, g, unknown or other
  misc_feature (717)..(717): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttggctgagctggattttccttgctgctaattttaaaaggtgtccagtgtgaggtgcaggttggtggaggtccgggggggctgggtaccgcgtcgggggtccttagactctcctgtcgtaacctctggtacttccacccctctaacgttaaccgtctagggatggtacgtcgttcgggttaccccgcccgagggccctacccggaagggggaaacggggtccgtggggtaagggttgggggttacgggaccccgttaaacgtttaaaaaacccgaaaagggttggtaacggggggtagggtacgaaggtaacggtaacttaaccggttcggacctaccccggtaggaacggacgggaccaaggtacgttccgacccgtattaccgtaacgaaacggtaagtagtttaggtaacctttaagaaggggtaaaacggcttaaacggtttgtaaacttcgtaaggaacaaaattcgaaaacccgngacgtacaaaccgtaataccgggaaggtaaccaccggtagcccggtttattaaccgttcgtttccgttaccccggngtaccggggtcttcccgggtanacccggtacccgtaagtattacggtaacctttggggtacccggggacccgttaaacggggtcccccttgggtaaccctaccccggttctacccccgg

SEQ ID NO: 166214 - DNA, 625 bp, Homo sapiens
  misc_feature: GYAE6OF02IEWXA.43.67.G01.1.454.CMB.1.raw
  modified_base (460)..(460): a, c, t, g, unknown or other
  misc_feature (460)..(460): n is a, c, g, or t
tcagtgtgagtagtcacgaccggtgctcgatttagagtatacatattgggtttgggggggagaggagccccagccttgggattcccaagtgttttcattcagtaatcaggactgaacacagaggactcaccatggagtttgggctgagctggattttccttgctgctattttaaaaggtgtccagtgtgaggtgcagttggtggaggtccgggggggcctggtaccgccgtgggggtcccttagactctcctgtgtaacctctggattcaccctcagtaacgtctggatgagctggttccgccaggctccgaggggagggctggagtgggttggccgtaataaaaccaaagtgagggtggacagtagactacgtgcaccgtgagaggcagacttcgcatctacaagagatgtattacgaaggtaacggctacggtttgtactcgtagacaaaatgaaacngcctagaacaagtcggaaggaaccacgacggtccgtagtaacttacgtcgttcccgcgtagggccttcgggtaccaccgttaccgaattaagtcggtacttaggttcggggacccgtaacggggtaacccccttgggtaccctacccggttccttaccccgtacg

SEQ ID NO: 166215 - DNA, 777 bp, Homo sapiens
  misc_feature: GYAE6OF02GYS50.43.67.G01.1.454.CMB.1.raw
  modified_base (257)..(257): a, c, t, g, unknown or other
  misc_feature (257)..(257): n is a, c, g, or t
  modified_base (270)..(270): a, c, t, g, unknown or other
  misc_feature (270)..(270): n is a, c, g, or t
  modified_base (698)..(698): a, c, t, g, unknown or other
  misc_feature (698)..(698): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcagttggtggagtccggggggctggtaccgccgtgggggtccctagactctcctgtgtacctntggattcaccctnacgtaacgtctggatcgagtctggttccgccacggcctccgaggggaacgggctcgggaggtgggttcggaccgtaaagttaaaaaccgaaaaggtgggaacgggttagggaacctaggtaaggtacctaacggttgaccgtacccgtagggaacggacggacgtaacggtactttacccgggacctaaagtttcccgttaaccggaaaacgtaaggtaaagttacgggttaaacttttaccgaaaacgggtaaacgttaccgtaacccgggttttaagtttaaccgtccgtagtaaaccgtaaaaacgttgaaaaccggtacgtacccttaaggaaacctaacgtacggaaaccggtaaccaacgtacggtacccgttagttaccgtttaacgttcgtacccggtacgaacgggtcgtacccggtanacccgttaaccgtagtaactacggaattacggttacggggactaaccggggtaccgttcggtactacccggcttacccg

SEQ ID NO: 166216 - DNA, 752 bp, Homo sapiens
  misc_feature: GYAE6OF02HLOFV.43.67.G01.1.454.CMB.1.raw
tcagtgtgagtagtcacgaccggtgctcgatttagagtatacatattgggtttggggggggagaggagccccagccttgggattcccaagtgttttcattcagtgatcaggactgaacacagaggactcaccatggagtttgggctgagctggattttcctgctgcttatttaaaaggtgtccagtgtgaggtgcgtagttggtgggagggtccgggggggcctggtaccggccggtcgggggtccttagactctacgtcgtacgtacctcgtggtacttccacctcgtacgtacgttcgtacggatggacgcgttccgggttcccgccgacggtccgttaccggaaggggtacgggggcgtaggggtaggttggggttcgggtaccggttaaaaacgtttaaaaaccgtaaaagggttcgggaacgggggtagggtaacgtaggtaacggtaaccgttaacggttcggaccgtaccggtaggaagacgggacgtaggtaacgttccgaccgtatcctaacgaagacgtatcgtagtacgaaggtacggacgttaacggttgtactacgtacgaacgtaactacgaactacgtaccgaataacgaacgtcggaagcaacggtacgacgttcgttaagttaccgttcgtccgtacgacggttccgtacggttccaacgttaccgaatacggttactacggttacggtccggtacgaccgggtaacccgtcggggtaaccctcgtcccgtaccg

SEQ ID NO: 166217 - DNA, 740 bp, Homo sapiens
  misc_feature: GYAE6OF02GEAKU.43.67.G01.1.454.CMB.1.raw
  modified_base (458)..(458): a, c, t, g, unknown or other
  misc_feature (458)..(458): n is a, c, g, or t
  modified_base (527)..(527): a, c, t, g, unknown or other
  misc_feature (527)..(527): n is a, c, g, or t
  modified_base (548)..(548): a, c, t, g, unknown or other
  misc_feature (548)..(548): n is a, c, g, or t
  modified_base (582)..(582): a, c, t, g, unknown or other
  misc_feature (582)..(582): n is a, c, g, or t
  modified_base (632)..(632): a, c, t, g, unknown or other
  misc_feature (632)..(632): n is a, c, g, or t
tcagtgtgagtagtcacgaccggtgctcgatttagagtatacatattgggtttgggggggaggaggagccccagccttgggattcccaagtgttttcattcagtgatcaggactgaacacagaggactcaccagtggtaggtttggctgagctggtattttccttgctgacttaagtttaaaggtgtccagtgtgaggtgctaggttggtggacgggtccggggggctcggtaccggcgtcgggggtcctagactctcgtgtagtacctctggtactccaccctgtacgtacgtcgtggatgacgtcgtcggtccgcctaggcctccggaaggggagggtcctgggtacggttggggttcggaccggttaaacgtaaaaaccgtaaaggtgggtaagggtacgggtacgaggttaacggtcgtaaccggttcgacccgtaaccggtagtacggacggntacgggattccgctacgtacgacgtagaacgtagtcgtacgttcgaaaggacgtcgtacgttatacgtntaacgtacaagtacgtaaacncggtaccaggtaaacctgaccggaagtaaccctnaaccgggttccctagttaaaccttccgaccgggttacgaggcccggtttnacccccgggttttaaacccgtttaggaacgttacgtacgggaaccgttacgggtacggggtaacccgtacccgggttaccgttaggtacccccttcgttccccgtacg

SEQ ID NO: 166218 - DNA, 954 bp, Homo sapiens
  misc_feature: GYAE6OF02HP5QF.43.67.G01.1.454.CMB.1.raw
tcagtgtgagtagtcacgaccggtgctcgatttagagtatacatattgggtttgggggggagaggagccccagccttgggattcccaagtgttttcattcagtgatcaggactgaacacagaggactcaccatggtagtttgggctgagctggtattttcctgctgcttaatttaaaggtgtccagtgtgaggtgctagttggtggacgggtccggggggggcctcgggtaccggtcccggttcggggggttaccccttaggaccgttccgtccgttcggtacggttaacccttcgtacggtacttccaccctacgtaacggttaacgtcgtaggtatcggagtccgttacggttcccgccgaggtccgtaccggaagggggtaacgggtcgtgggtacggttcggggttacggtaaccggttaaaacgttaaaaaccggaaaggtacgggtaacggggtacgggaacgtaggtaacggtaacttacggttacggaccgtaacccggtggaacggacgggaaccgtaggtacgttaccgaccgtaacgttaccgtaacgaaaggacgtaacgttaacggttaaccgttaaccgggtaaagggtaaaccgggtaacccgttttacggtttaaagtaacgttttaccgaacggtaaaacccgttaaaagttaacccggaaaaccgtaccggttaacccgtaacgtaaaccgtaaccgggttaaccggaaacggaaaccccttacggtaaccccgggtttaggttttaaccgttaacggtttttacccggtaccgggtttaacccggcggtaaaccggggtcccctttacgggtaccctaaccgttaccggtaaacgttaaccgttacggtaaccgtttaccggggacccgggtaacccggtaaccgggttaccccggtttaacggtaccccccttaaccggttccccgttacccgg

SEQ ID NO: 166219 - DNA, 799 bp, Homo sapiens
  misc_feature: GYAE6OF02IBMIQ.43.67.G01.1.454.CMB.1.raw
  modified_base (180)..(180): a, c, t, g, unknown or other
  misc_feature (180)..(180): n is a, c, g, or t
  modified_base (256)..(256): a, c, t, g, unknown or other
  misc_feature (256)..(256): n is a, c, g, or t
  modified_base (306)..(306): a, c, t, g, unknown or other
  misc_feature (306)..(306): n is a, c, g, or t
  modified_base (523)..(523): a, c, t, g, unknown or other
  misc_feature (523)..(523): n is a, c, g, or t
  modified_base (726)..(726): a, c, t, g, unknown or other
  misc_feature (726)..(726): n is a, c, g, or t
  modified_base (736)..(736): a, c, t, g, unknown or other
  misc_feature (736)..(736): n is a, c, g, or t
tcagtgtgagtagtcacgaccggtgctcgatttagagtatacatattgggtttggggggagaggagccccagccttgggattcccaagtgttttcattcagtgatcaggactgaacacagaggactcaccatggagttttggctgagctggtattttccttgctgtcttagtttaaagtntccagtgtgaggtgcagttggtggaggtccggggggctggccgcgtggggtcctagactctctgtcgtaacctcgnggacttccaccttcagttaacgtctaggatacggatccgttcggttaccnccgtaggccgtaccgggaagggggaacgggtcgtagggtacgggttcgggggtttcggtaacccggttaaaacgttaaaaaccggaaagggtttcgggtaacgggggttacgggtaacgtaaccgggtaacgtaccggtttaacggttacggaccggttaacccggtagggaacgggttaacggccgtaagtaaccgtttcggacccctaagttccncggtaaacggtacgagtttacggactttaaggacggtaacggtcgttaacggttgtacttcggtacaacgttaaagtccgaaaacgttcgcctaacgtaacgtaaacggttccggacggtaacccaacggtacggttaccgttagttacccgttaacgttcgtccgtcggtaacggttccggtacctacgaccttaaccggtnttaaacggtntaaccgttaggtccgggacccgtacgggtaaccctttcgggaaccttcccgggtcctaaccgg

SEQ ID NO: 166220 - DNA, 622 bp, Homo sapiens
  misc_feature: GYAE6OF02F0R5W.43.67.G01.1.454.CMB.1.raw
  modified_base (404)..(404): a, c, t, g, unknown or other
  misc_feature (404)..(404): n is a, c, g, or t
  modified_base (411)..(411): a, c, t, g, unknown or other
  misc_feature (411)..(411): n is a, c, g, or t
  modified_base (418)..(418): a, c, t, g, unknown or other
  misc_feature (418)..(418): n is a, c, g, or t
  modified_base (433)..(433): a, c, t, g, unknown or other
  misc_feature (433)..(433): n is a, c, g, or t
  modified_base (435)..(435): a, c, t, g, unknown or other
  misc_feature (435)..(435): n is a, c, g, or t
  modified_base (456)..(456): a, c, t, g, unknown or other
  misc_feature (456)..(456): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgctattttaaaggtgtccagtgtgaggtgcagttggtggaggtccgggggggctggtaccggccgtggggggtccctagacctcgtcctgtcgtaacctctggacttccaccctcacgtaactcgtaggatgagtcgtcgttccgccgagcctccgagggaacggggctggaggtgggtcggaccggtaataaaaccgaaggtaggaggtgggacagtagaccgtcgtcgcgaccgtagngagcagntacgacntacgtcaagagactntntacgagacggctacgttgatntagactaagtcaacgtagccttagaactagacgaacgactacgacgctagtacttacttcgtccgtagcggtacgtacggtccacctacggtaataattaccggtaacgttgggtacccgggacaaccggggttacccaccgggtcccgtaaccccgtcgtacccg

SEQ ID NO: 166221 - DNA, 738 bp, Homo sapiens
  misc_feature: GYAE6OF02JITOF.43.67.G01.1.454.CMB.1.raw
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggtattttccttgctgtcttattttaaaaggtgtccagtgtgaggtgcagttggtggaggtccgggggggcctggtaccgccgtgggggtccctagactctcctgtcgtaacctctggattccaccctcgtacgtaacgtctggatgagtcgtcggtccgccgtaggcctccggaaggggacgggtcgtagggtaggtgggttcggaccgttaaacgttaaaaaccgaaaggtggaggggtacggaacgaggtaggacgttaacggttcggaccgtacccggtggaacgtaggcgtagtaacgttccgacctatccgtaacgaaggagacgtgtaagtacgaaggaacggtcttaacggttgtaacctgtagaaccgtaaaagtcgaaaccgtcgaccttaaggaacccaagtaccgggaagaccgtaaccgacggttacccggttagtttaaacccttaggtttcccgacgggtacctaggggtcctacccggtacacccggttcgtaaacttaaggtcaaaccggtttacgggttaccgggcccggtaaacgggtccttacccgggtccctaccgttccctacccg

SEQ ID NO: 166222 - DNA, 729 bp, Homo sapiens
  misc_feature: GYAE6OF02H4TRB.43.67.G01.1.454.CMB.1.raw
  modified_base (501)..(501): a, c, t, g, unknown or other
  misc_feature (501)..(501): n is a, c, g, or t
  modified_base (552)..(552): a, c, t, g, unknown or other
  misc_feature (552)..(552): n is a, c, g, or t
tcagtgtgagtagtcacgaccggtgctcgatttagagtatacatattgggtttggggggggagaggagccccagccttgggattcccaagtgttttcattcagtgatcaggactgaacacagaggactcaccatggagtttgggctgagctggtattttccttgctgtactattttaaaaggtgtccagtgtgaggtgcagttgggtgggacgggtccggggggggcctgggtaccggccggtggggggtccccttagactctcctgtgtaacctctgtattccacctcagtaacgtctggatgagtcgttcggtcccaccgaggcctaccgagggggaacgggtcgtggggtaggttggggttacgggaccgttaaagttaaaaaccgaaaaggtagggtaagggggtacgggaacgtaaggtacggtaactacggttcgaccgtacccgtagggaaggacggacgacgtacgttccgactacgtactacgaagtacgtntacgtatacgagggaacgtagtcgttagtatcgtagaacaagtgaaaccgntaccagaacaatcggaaggactaccgtaacggtccgttaattaccttaacgttccgtaccggtcggaccggttcctaccgggtactaccgtaccgtaactaacggttcgtaacggtttccggtccgggggtaacccacggggttaacccgtcggtacgttaccccgtccgtaccccg

SEQ ID NO: 166223 - DNA, 934 bp, Homo sapiens
  misc_feature: GYAE6OF02GEV2B.43.67.G01.1.454.CMB.1.raw
tcagtgtgagtagtcacgaccggtgctcgatttagagtatacatattgggtttgggggggagaggagccccagccttgggattcccaagtgtttcattcagtgatcaggactgaacacagaggactcaccatggagtttgggctgagctggtattttccttgctgctattttaaaaggtgtccagtgtgaggtgctagttggtgggacgggtccggggggggcctgggtacccggccggtcggggggtcccgttagacctccgtccttgtcgtaacctcgtcggtacttccaccctcacgtaaccgtcgtggatgagcgttcggttccgccgacggcctaccggaagggggaacgggtcgtagggacggttggggttacggtaccgttaaaacgttaaaaaccgtaaaaggtagggtaaggggtagggtaaacgaaggtaacgtaacttacggttcggaccgtaacccgtaggaaggtagggacgtaaggtacttccggacctagtccgtaacgaaagggtagtaacgttacggaactttacggaaagggtaaacggttccggttaaacggtttacggttaaagttccgtaacggtaaaaccgtaaacgtttaaccgggaaaaccgtcccggtaaacccgttaaggaaaccgtaaaacgggtacccggtaaaacgggaaaccctaacggtaacccgggttaaccggtttacgggttttaaacttttaccccggttacgggtttaaccccggaaggtacccggggggttacccctttaccggggtaaccccttacccgggttaaccggttaaaattaccgggtaaccgggttttaaaccggttaccgggggttaccggggggaaacccccggttaaccgggggttaaaccccgtttcggggtaaccccgttacccccggtttaccctcccccggg

SEQ ID NO: 166224 - DNA, 873 bp, Homo sapiens
  misc_feature: GYAE6OF02IFNXM.43.67.G01.1.454.CMB.1.raw
tcagtgtgagtagtcacgaccggtgctcgatttagagtatacatattgggtttggggggggagaggagccccagccttgggattcccaagtgttttcattcagtgatcaggactgaacacagaggactcaccatggagtttgggctgagctggattttccttgctgcttaattttaaaaggtgtccagtgtgaggtgcagttggtgggaggtccggggggggcctggtaccgccgtgggggtcccttagctctccgtgtcgtacctcgtggtattcacctcacgtaacgtctggatgagcttcgggttcccgcgtacggtccgtaccggaacgggggtaaggggcgtaggggtaggttgggggttcgggtaccggttaaacgttaaaaacccggaaaaggtcgggtagggggttacgggaacgtaggtaaccggacgttaacggttcggacctacccggtaggacggacgggcgtaagtacgttacgaccgttactccgttacgaaagtaacggtattaacggtaattacgaaacgggtaaaccgttccggtaacggtttagttaacgtactacggtaacgtaaaacgttggaaaactaccgggtaaccctacggtaaaccgaaacgttaaccgggaaggaaacccgtaaccgtaacggggttacccgttaagtttaaccgtttacggtttacccggtttccggaaccgggtccgggttcccgttacgggttaacccttacccggttaacccgtaaatttaaccgggtaccggttaaaacggttttccgggttaccgggggggccccgttaaaaccggggttaacccccgtttcgggggtaaccccctacccgggttttaccccgaaccccgg

SEQ ID NO: 166225 - DNA, 794 bp, Homo sapiens
  misc_feature: GYAE6OF02IJVJN.43.67.G01.1.454.CMB.1.raw
  modified_base (184)..(184): a, c, t, g, unknown or other
  misc_feature (184)..(184): n is a, c, g, or t
  modified_base (717)..(717): a, c, t, g, unknown or other
  misc_feature (717)..(717): n is a, c, g, or t
tcagtgtgagtagtcacgaccggtgctcgatttagagtatacatattggggtttggggggggagaggagccccagccttgggattcccaagtgttttcattcagtgatcaggactgaacacagaggactcaccatggagtttgggctgagctggattttccttgctgacttattttaaaaggtntccagtgtgaggtgcaggttggtgggacggtccggggggggcctcgggtaccgccggtggggggtcccttagacctctcctgtacgtaacctctggtacttccacctcacgttaaccgtctaggtatgaacggtcgttcggttccgcccaggtccgtaccggaacgggggtaaggggtcttaggggaggttgggggttacggaccgttaaagttaaaaaccgaaaaggtggaagggtacgggaacgtaggtagtaactacggttagccgtaccgtaggagaaggccaagtaacttccgactatacctaacaaaggacggtaattaggactttaacgaaagggtaaaccggtaccgttaacgggttttagaacttaccgtagtaaaaccaaaaggttcgaaaaccgtacgtcccgttaaagaactaaacgtacggaacggaccacgtaacggttcgtaacgtttacttccggttacgtaacccggcggaaccgggttcctccggttaccgtaaccgttaccggaatttaaaccncggttaaccggttagtaccccggggggaccgaaaccgggttaaccccggtcgtaccccgtttaccggtcgtaccccg

SEQ ID NO: 166226 - DNA, 756 bp, Homo sapiens
  misc_feature: GYAE6OF02JD5RJ.43.67.G01.1.454.CMB.1.raw
  modified_base (604)..(604): a, c, t, g, unknown or other
  misc_feature (604)..(604): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgctatttaaagtgtccagtgtgaggtgctagttggtggaggtccggggggggcctggtaccgccgtgggggtcccttagactctcctgtcgtaacctcgtgacttcaccctcacgtaaccgtctggatgacgtcgtcggttcccgccgacggtccttaccgagggggaacgggtccgtagggtacggttggggttacggtacccggttaaacgttaaaaaacccgtaaaaggttcggggtaacgggggtacggggtaacgtaaggttaacggtaaccgtttaaccggttcgacccgtaaccccggtaggaacgggacgggacgaacggtacgttacccggacctacgttacctaacgaaaggtaacgagttacgtaattccggaaagaacgggtaccttaacggtttggtaaactccggtagaacctaaagtcgaaaccncggtaccctagaaccaagtacggacggacacggacgtaccggtattacgtttccgcgttccgaggtaccggtcctcggtaccactacgaatacgtacgtacttacgggtacggaccctaacggggtcccttaggccctaccgtctaaccccg

SEQ ID NO: 166227 - DNA, 935 bp, Homo sapiens
  misc_feature: GYAE6OF02I0FM9.43.67.G01.1.454.CMB.1.raw
tcagtgtgagtagtcacgaccggtgctcgatttagagtatacatattgggtttggggggggagaggagccccagccttgggattcccaagtgttttcattcagtgatcaggactgaacacagaggactcaccatggagtttgggctgagctggattttccttgctgtcttagtttaaaggtgtccagtgtgaggtgctaggttggtgggacgggtccgggggggcctgggtaccggccgtgggggtccctagactctccgtgtacgtaacctcgtgtacttccaccctcgagttacgtcgtggactgacgtcgttcggttcccgaccgaggtcctaccgggaaggggaacggggtcgtggggtaggttcggggttacgggtacccgttaaattaaaacccggaaaaggttcgggaacggggtagggaacgtaggtaaacgtacgtttacggttaccgaccggtaacccggttggaacgggtaacgggtagtaacggttacgttacccggaccttaacgttacccgtaacgtaaacgggtacgtaacgttacgttaacgtttaaccgggaaacggggtaacggttaaccggttaacgggtttacgggtttaacttaccgggtagttaaaccgtaaaaggtacccggtaaaacgttcggtaaccccggtaaacgttaacgaaacggttaacccggaaccgttaaacgacccggtaacggtcccggtttaacggtttaaacgttacccggttacgggttacccggtacccgggttaacgggggttccctacccggggttaccgtaaacccgttttccggtaaaccgtttaacgggtaccgtttaacccggggttaacgggttaccgggggtaaccccggtaaccggggttaacccgtaccccgggtttacccgttaccccggttcccgttacccccgg

SEQ ID NO: 166228 - DNA, 614 bp, Homo sapiens
  misc_feature: GYAE6OF02FV505.43.67.G01.1.454.CMB.1.raw
  modified_base (301)..(301): a, c, t, g, unknown or other
  misc_feature (301)..(301): n is a, c, g, or t
  modified_base (399)..(399): a, c, t, g, unknown or other
  misc_feature (399)..(399): n is a, c, g, or t
  modified_base (404)..(404): a, c, t, g, unknown or other
  misc_feature (404)..(404): n is a, c, g, or t
tcagtgtgagtagtcacgaccggtgctcgatttagagtatacatattgggtttggggggggagaggagccccagccttgggattcccaagtgttttcattcagtgatcaggactgaacacagaggactcaccatggagtttgggctgagctggattttccttgctgctattttaaaaggtgtccagtgtgaggtgcagttggtggagtccgggggggctggtaccgcgtgggcgtcccttagactctcctgtgtaacctcgtggattccacctcagtaaccgtctggatgacgctggtccncaggctcgagggagggctggagtggtcgacgtataaaacgaaagtgagggtggacagtagactacgtgacaccgtgagaggcagtactcgacatctanaaagngatgtatacgaaggtaacgctacgttggtaatcgtaggaactaaaagtgaaacgtcgtacccttagaaacctaagttacggaacggtaacacgaacggtccggttataacgttaacgtcgttaccgaggacgggtctacggtcaccgttaccgaataactgtaactaggttccgggaccgtaagggtacccctgggttacccacgttccc

SEQ ID NO: 166229 - DNA, 654 bp, Homo sapiens
  misc_feature: GYAE6OF02I6EX2.43.67.G01.1.454.CMB.1.raw
  modified_base (505)..(505): a, c, t, g, unknown or other
  misc_feature (505)..(505): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgctatttaaaggtgtccagtgtgaggtgcagtggtggagtcgggggggctggtaccgcgtgggggtccttagactctcctgtcgtacctctggtatcaccctcacgtaacgtctggatgagtctggttccgccaggctaccgaggggaacggggcgtagggaggtggggttggtaccgttaagttaaaaccgaaaggtaggacggggtaagggacgaaggttacggacgtacggttgaccgtacccgtagagaggtacctagtacttcggacctatctacgaagagtagtagtattacgaaggaacgagtacgttgtactacgtagtacaaagtcgtaacncgtacagaactagtacgacgacaccgacgacgtagttacttacgttacgttccgacggcgtcgttaccggtacaccgttacggtaactacgtcgaacgtttacggtggggacccgtacgggtacccgtggtaccgtccgttctacccgg

SEQ ID NO: 166230 - DNA, 898 bp, Homo sapiens
  misc_feature: GYAE6OF02GOCG9.43.67.G01.1.454.CMB.1.raw
tcagtgtgagtagtcacgaccggtgctcgatttagagtatacatattggggtttgggggggagaggagccccagccttgggattcccaagtgttttcattcagtgatcaggactgaacacagaggactcaccatggagtttgggctgagctggattttccttgctgctattttaaaaggtgtccagtgtgaggtgctaggttggtgggaggtccgggggggctgggtaccgccgtcggggggtcccttagactctccgtgtcgtaacctcgtggtacttcaccctcaagttaaccgtctggactgacgcgttcggttccgccgaggtccgtaccggagggggaacggggtcgtggggagggttcggggttacggtacccggttaaaacgttaaaaacccggtaaaggttacggggtaagggggtcgggaacggtaaggtaaccgggtacgttacggttacggccgtaacccggtggaacggaacggtcgaacggtacgttcccggactaaccgttccgtaagaaacgtacgtagttacggtaactttaagaaggtaacgggtaccgttaacggtttacggttacgttaccgtacgtaaacgttaaaacgtaacgggaaaccttaacggtaacccttaacgggtaaactaaacgggttaaccgggaaccgggaactaaccggtaaccgggttaccgtttacgtttaaactttaccgggtttaccggtttccccggaacgggtaacccgggttccggtaccgggttacccgtaccggttaccggtaaaacgtaacggttaacggttaaccggtttaacggggtttacccggggacccggttaaccggggggtaacccctttacccgggggtacccgttaccccggttacccgttacccgg

SEQ ID NO: 166231 - DNA, 858 bp, Homo sapiens
  misc_feature: GYAE6OF02JCS7X.43.67.G01.1.454.CMB.1.raw
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgaggctggtattttccttgctgtacttaattttaaaaggtgtccagtgtgaggtgctaggttggtggagggttccgggggggggccttacgggtaccggccggttcggggggttcccttaggtaccttccgttcccgtgttacgttaaacccgttcgttggtacttccctacccctcgtaacgttaaaccgtcgtacgggtaattcggacgtccgtttcgggtttacccggaccccggtagggtcccgttaccgggaagggggtaaacgggggtccggttggggaacgggtttggggggttcgggtaacccgttaaagttaaaaaacccggaaaggttagggtacggggttacgggacgtaaggttaggaacccgtttacggttcggaccgtaccccggtaggtaagacgggtcgtaaaggtaccgtttaccgacgtaccgttacgtaccggaaagtagtacgtagttacgttaacggacgtaaacgggtcttaaacgggttcgtaactttccggagtaacgtaaacgtacgaacgtaacgtccgtaaataccgaagttaccggaagggttaaacacccgtaagttcccggtagttaacgtttaccgtcgtttacggacgtacggtccgttccgtcgacgtaccgtaagtacgttcgtaacgttcggttacgggacgtacggtaacccgtggttaccctaccgttcctacccg

SEQ ID NO: 166232 - DNA, 719 bp, Homo sapiens
  misc_feature: GYAE6OF02JG83F.43.67.G01.1.454.CMB.1.raw
tcagtgtgagtagtcacgaccggtgctcgatttagagtatacatattgggtttgggggggagaggagcccagccttgggattcccaagtgttttcattcagtgatcaggactgaacacagaggactcaccatggagtttgggctgagctggattttccttgctgctatttaaaaggtgtccagttgtgaggtgcagttggtggaggtccggggggggcctgggtaccgccgtgggggtccctaggactcgtcctgtgtaacctcgtggtacttccaccctctacgttaacgtctggactgagtctggtccgccgaggtctccgaggggaagggcgtagggaggtgggttcggaccgttaacgtttaaaaccgaaaggttcggagggggtagggaacgtaggtagtacgttacggttcgaccgtaccggtagacggaaggtcgaaggtacttcgcctactccgtagaaacggagtagtgtacttagaacggtaagcttaacggttgtaactcgtaacgactaaagtacgaacgtacgtccgtagaactacgtacggtaacgaccaacggtcgtaccggtttagtacgttaaccgtcgttcccggaagtacggggtcctaccggtaccgtacgttacccggtaaggtaacctcgggtaaaccttcggggttacccggaccggaccggtacccgttagggaccccttaggttcccctaacgg

SEQ ID NO: 166233 - DNA, 682 bp, Homo sapiens
  misc_feature: GYAE6OF02HXKDA.43.67.G01.1.454.CMB.1.raw
  modified_base (410)..(410): a, c, t, g, unknown or other
  misc_feature (410)..(410): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggtattttccttgctgctattttaaaaggtgtccagtgtgaggtgcagttggtgggaggtccggggggggcctggtaccgccgtgggggtcccttagactctcctgtcgtaacctcgtggtattccaccctcagtaacgtctggatgagtcgttcggttccgccgaggcctccgaggggacggggctgggaggttggggttggaccgttaaattaaaaaccgaaaagtggagggtgggacagtagactacgtgccaccgngagaggcagtattcgcctatctacgaaagagatgtattacgaaggtaacggtctaacggtttgttaatctaggaactaaagtacgaaacacgtcctacgaacaaagtcgaaggacaacgaggcgtttaagttaacgttacgttcggttacccggaggtacggggtccttccgggtactaccggtaaccggaatttaacgcggtaaaccgttagggttccggggacccggtaacggggtaaccccttgggtaccctacccggtccttaccccg

SEQ ID NO: 166234 - DNA, 911 bp, Homo sapiens
  misc_feature: GYAE6OF02JQS9R.43.67.G01.1.454.CMB.1.raw
  modified_base (321)..(321): a, c, t, g, unknown or other
  misc_feature (321)..(321): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggtagtttggctgagctggtattttccttgctgacttaagttttaaaaggtgtccagtgtgaggtgcgtaggttggtgggacggtccgggggggtctggtaccgccggtcgggggttcccttagaccgtctccgttggtacgtaccgtcgtaggtacttccacccgtagtacgttaacgtctcggtancggtaacgtcgtcggttcccggaccgtaggtacccgtcccggaacgggggtaacggggtccggtagggtacgggttcggggtttacgggtacccgtttaaacgttaaaaaaccggaaaacgggttcgggtaacgggggtaggggtaaccgtaaggtaaccggtaacggtttaaccggtttacgggtaccctaaccccggttaagggaaccgggtaacgggtaccgtaacggtaaacgtttccggacctaacgttaccgacgttaaagaacgtagtacgtacgttccgaaacggaaacgccgttaacgttacgttcgtaccgttaacgaacgttaaacgacgtaaacgtcgtacccgtaacgtaacccggtaaaagtcccggtaaggaaacccgtaccgtaaggttaacccggtactttaagttaaccgtttcgttaaccccggacggttaaccgggtccgttaccgggtaccttaacccggaacgtttaaccggttaagttaaccccggtaaccgtttagggtaaccgggttcccgtaaaccggggtaccccggttacgggtaaccccgtacccgttccccgtaacccgg

SEQ ID NO: 166235 - DNA, 742 bp, Homo sapiens
  misc_feature: GYAE6OF02I0TAY.43.67.G01.1.454.CMB.1.raw
tcagtgtgagtagtcacgaccggtgctcgatttagagtatacatattgggtttgggggagaggagccccagccttgggattcccaagtgttttcattcagtgatcaggactgaacacagaggactcaccagtggagtttggctgagctggatttctgctgctaatttaaagtgtccagtgtgagtgcgtagttggtggacggtccggggggtcctggtacccgccggttcgggggtccccttagctctccgtgtcgtaacctcgtagacttacgaccctgtagtacgtcgtgactgacgtccgtggttccgccgcggtctcggaaggggaagggtcgtaggacggttgggttcggaccgttaacgttaaaaccgaaaggtacggagggtaggaccgtaaggtacgacgttacgttcgaccgtacccggtggtaacgaacggtcgtagaacgttccgacgtaactacgaacgtaaggacgtagtagtacgttaccgaaggtaacggccgttaagtttcgtaaattccgtaaggaactaaaacgttgaaaccgtcgtaccgtaaggtaaccttaaagcccggtttaaggaacccgacgtacggtaccgggttacttaaagttttcccgacggttccggacgtcgggtaccgtcgtacctaccgttacgaaggtttacacggttaccgtagttaacggggcccgtaacgggtccccttaaggtcccgtacccgtcgttaacccgg

SEQ ID NO: 166236 - DNA, 799 bp, Homo sapiens
  misc_feature: GYAE6OF02I4V0S.43.67.G01.1.454.CMB.1.raw
  modified_base (177)..(177): a, c, t, g, unknown or other
  misc_feature (177)..(177): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggtatttcctgctgctatttaaaggtntccagtgtgaggtgcgaggttggtgggacggtccggggggggcctggtaccggccgtcgggggtcccttagacctctcctgtcgtaacctcgtggacttccacctcgagttaacgtctggactgagtcgtcggtccgcacggctaccggagggaaggggtctgggtaggttgggttcggtaccgttaaagttaaaaaccgaaaggtaggtaggggtacggaacgtaggtaacgtaccgttaacggttacgccgaaccggttacgaaggtacgggactaggtaacgtttaccggaccgtacgttaccgtaacgtaaacggaggtaacgttacggaacgtttaaccgaaagggtaaccggtaacttaaccgggtttgttaacgttcgtaaggttaactaaaaggtcaaacggtaccgtccgttaacgaaataaaccggttcggaacggtaaaccgtaccgaacggttcccggtttaagttaaccctttaccgtccgggtttacccgaggttaaccgggtctaaccgggttccaaccggttaccggaatttaaccgtacggtaacgttaacggttaccgggacgtaaccgggtaacccttcgggtaacccttacggtcctaaccg

SEQ ID NO: 166237 - DNA, 697 bp, Homo sapiens
  misc_feature: GYAE6OF02JR8NY.43.67.G01.1.454.CMB.1.raw
  modified_base (522)..(522): a, c, t, g, unknown or other
  misc_feature (522)..(522): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggtattttccttgctgcttattttaaaggtgtccagtgtgagtgcagttggtggaggtccgggggggcctggtaccgccgtgggggtcccttagactcgtcctgtcgtacctgtgtactccacctcagtaacgtcgtggagtcgagtcgtcggttaccgccacggtcctaccggagggaaggggcctagggaggttggggttcggaccgttaacgttaaaaaccgaaaagtgggaagggttacgggactaaggtacgacgtacgtagcctacccgtgacgaggctaggacttcggctagtctacgaaagtagagtcgaattcgaagtaggtacaggtttactagtactacgtaacaaaagtcgaaacgtacnccgtataaccgaagtaccggaagtacacgacgggttatacgtacttaccgtacgtcccgacggtagggtcccgtacgtaccgtacgttaccgaacgtaactaggtaaccttagggttaccggacggttaccggtaaacccggttccggtacccgttaacccggttccctaacccg

SEQ ID NO: 166238 - DNA, 817 bp, Homo sapiens
  misc_feature: GYAE6OF02FURLX.43.67.G01.1.454.CMB.1.raw
  modified_base (179)..(179): a, c, t, g, unknown or other
  misc_feature (179)..(179): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgctattttaaaggtntccagtgtgaggtgcagttggtggaggtccgggggggctggtaccgccgtcgggggtccttagactctctgtcgtaacctctggacttccaccctcagtaaccgtctggatggtacgtcgtcggttcccgtaccgacggcttacccggaagggggaacgggggtcgtaggggagggttggggttacgggtaaccggttaaacgttaaaaaacccggtaaaagggtttagggaagggggttacgggtaaccgaagggttaaccggtaacgttaaccggttcggaaccctaacccgtaaggttaggaacgaggactaggtacctaccggtacccaattccgtaacgaaaggtaacgtagttagtaacgtttaacggaagggtaaaccgtccggttaaggttttagtaacgttacctaagtaacgtaaaagttacggaaactacggcgtttaaacgaaactaacggccgggtaaacggaaccgtacctaacgggtccgtttaaggttacgttaacccgttcgttacccggcgttaccggggtcctttaccggggtacaacgggttcccgtaataaacggtcgttaaccttacggggtcgggacccgtaacggtaaccccggtggttaccccctaggtcccc

SEQ ID NO: 166239 - DNA, 856 bp, Homo sapiens
  misc_feature: GYAE6OF02F294L.43.67.G01.1.454.CMB.1.raw
  modified_base (179)..(179): a, c, t, g, unknown or other
  misc_feature (179)..(179): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttccttgctgctattttaaaggtntccagtgtgaggtgcagttggtggaggtccgggggggcctggtaccgccgtggggggtccctaggactctccgtgtcgttaacctcgtaggtacttccgaccccttacgacggttaaccgttccgttagggaacgttggaacgtccgttcgggttccccgcccggtacggtccgtaacccggaggggggtaaacggggtcgtagggggtcgggttgggggttcgggaacccggttaaacgttaaaaacccgaaaggggttagggaagggggtacggggaacgtaacgggtacggtaacgttacggttcggacccgtaacccggtaggaacggagggacctaggtacgtcccggacctaacgtccctacgaaacggtagtaagtacgtatttaccggaaaggtacggacgttacggtttggtaacttcgtaggtaactaagttacgaaacgttacgaccgtagaaacctagggtacccgaagtacccgaacgttacgggcccgtttaaggttactttaaccgggttcccgtaaccggtacggtacgggtaccccgttacgggtccctaaccggtaccggtaaagttaaccgttcggtaaccggtttcgggtaacccggggacccggttaaccgggtaaaccccggttccgggtacccgtaccggtttcccgtacccgg

SEQ ID NO: 166240 - DNA, 1199 bp, Homo sapiens
  misc_feature: GYAE6OF02IM65Y.43.67.G01.1.454.CMB.1.raw
tcagtgtgagtagtcacgaccggtgctcgatttagagtatacatattgggtttgggggggagaggagccccagccttgggattcccaagtgttttcattcagtgatcaggactgaacacagaggactcaccagtggagtttggctgagcgtggtacttttccttgtcgtgtacgtttaagtttttaaaaggtcgttacccgtaggttcggtggtaggtgtacgtaggtttgggtagggtaccgggttcccgggggggggtcccgttacgggtacccggtcccgggttcgggggggttacccctttaggtaaccttccgttacccgttacggttaccggttaacccgttaccgttacgggtaaccgtttaccctaaccccgttaccgtaaacggttaaaccggtttccggttagggtaacgttacgggtaaacgttccggttacccgggtttacccccgaaccggtaacggggtcccttaacccgggaaacggggggtaaacgggggtcgttaaccgggggtaaggggttttcggggggtttaaccgggtaaccccggtttaaaaacggtttaaaaaaaccccggtaaaaacggggtttacgggggtaaacgggggttacggggtaaaacccgtaacggggtttaaacggtaacccggtttaaccgggtttccggacccgttaaccccgggtagggtaacgggtaaacggggtacccgaacggtttaccggtttaccgaacccgtaacgtttaacccgtaacgtaaaggtaacggtaacgtttaacgggtactttaaccgggtaaaacgggtaaaccgggtaccggttttaacggttaacggtttaaaccgtttaccggttaggtaaaacccgttaaaagggtttaaaccgaaacccggttaccggttaacccgtttaaacccgggtaaaacttaaccggggtttaacccggaaaacgggtaacctaaaccgggttaacccgggttaccgtttaaacggttttaaacccttttacggtttaaccccggggttaacccggtaccggtttaacccgggggtaaccccgtttacggttaaccctacccgggttttaacccggtaaaaagtttaaccgttaacggtaaccggggtttacgggtttaacccggggaaaccccgggtttacgggttaaaccccgtccccggggttaaccctcccgg

SEQ ID NO: 166241 - DNA, 664 bp, Homo sapiens
  misc_feature: GYAE6OF02H3CEV.43.67.G01.1.454.CMB.1.raw
  modified_base (261)..(261): a, c, t, g, unknown or other
  misc_feature (261)..(261): n is a, c, g, or t
  modified_base (395)..(395): a, c, t, g, unknown or other
  misc_feature (395)..(395): n is a, c, g, or t
  modified_base (421)..(421): a, c, t, g, unknown or other
  misc_feature (421)..(421): n is a, c, g, or t
  modified_base (486)..(486): a, c, t, g, unknown or other
  misc_feature (486)..(486): n is a, c, g, or t
  modified_base (515)..(515): a, c, t, g, unknown or other
  misc_feature (515)..(515): n is a, c, g, or t
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggattttcctgctgcttatttaaaaggtgtccagtgtgaggtgcagttggtggaggtccgggggggcctggtacccggcgtgggggtcccttagctctcctgtgtaacctnggtattccacctcagtaacgtctggatggagcgtcggttccgcctaggcctcgaggggaagggctggagtggggtcgacgtaataaaacgaaagtgagggtggacagtagacgtagtcgccgtaccgtggaagnggactagaacgttcacctatccgtanaagtacgaagttacgattacgaagaacggtcttaacgttgtacttcgacgtacaaagtagaaacngtacccagaaaccaacgtacgaacggtanaaccggtagttaccgtattaaccgttagtcgttaccggagaaccggggttctccgggtaactacccttacggtaaacgtagtacttaacgtaagggttcccgggacgtaaacgggttaccctggggtaacctcccgggtcttaccccgg

SEQ ID NO: 166242 - DNA, 1088 bp, Homo sapiens
  misc_feature: GYAE6OF02GKWNW.43.67.G01.1.454.CMB.1.raw
tcagtgtgagtagtcacgaccggtgctcgatttagagtatacatattggggtttgggggggagaggagccccagccttgggattcccaagtgttttcattcagtgatcaggactgaacacagaggactcaccatggtagttgggctgagctggtattttccttgtctgtacttaattttaaaaggtcgtacctagtgtggaggtgcgtaggttgggtgggacgggtcccgggggggggtcctacggggtacccgccgggttcgggggggttccccttaggtaccttccgttccttacggttacgttaaaccctcgttacgggtacttaccctacccgttacgtaacgttaaccgttcggtaggtaacgtcggtaacggtcgtttccgggttaccccgaccggtacggtccccgttaaccggggaacggggggtaacggggtaccggttaggggggttacgggggtttacgggggggttttaccggtaacccggttttaaaaaaaccggtttaaaaaaacccggtaaaaaggggtttacggggtaaacggggggttaacggggtaaaaccgttaagggtaaaccggtaaccgggtttaccggtttaccggacccggtaacccgggttaagggaacggtacgggtacccgtaaggttacccggtttacccggaccttaacgtaccgttaacggaaaggtaacgtacgttagtaaccgtttaaggaaacggaaggttccttaaggtttaacgtactggtaactaaacgtaacgtaaccggtaataccggttacccgaaagttaaaccggtacggtaaccggtaaaacgaacccctggggtaaaccctttcccggggtttagtttaaaaccccggtttcccggtttaacccgggtccggggtaaccggtttaccccgggggtaacccgttttaccgggtacccgttaaccgtttaacccgggaaagttttaaccggttaaaccggggtccgggttttaaaccggggaacccccggggaccggtttaaccccggggggtttaaccccttaccggggtttaaccccgtccccccgtttacgggttaaccccccc

SEQ ID NO: 166243 - DNA, 900 bp, Homo sapiens
  misc_feature: GYAE6OF02GI0SH.43.67.G01.1.454.CMB.1.raw
tcagtgtgagtagtcacgaccggtgctcgatttagagtatacatattggggtttgggggggagaggagccccagccttgggattcccaagtgttttcattcagtgatcaggactgaacacagaggactcaccatggtagtttcgggctgagcgtggtattttcctagctgcttatttaaaggtgtaccagtgtgaggtgctaggttggtgggacggtccgggggggctggacgtaccggtccggtgggggttcccttagactcctcctggtacgtaacctcgtaggtacttccgaccctacgtaacgttaaccgtcgtacgggtatacggagcgttacggttcccgacccgaggtcctaccggaaggggaacggggtcgtacggggtaaggttcggggttacggacccggttaaaacgttaaaaaacccggaaaaggtacggaaacgggttaacggtacggggtaacctaagggttaacggtaccgttacgggtttacgacccgtacccgggtaggaaggacggtacgtaagtacgttccggacctattaccgagtaacggtagtaacgtagtaacgtttacgaaacgggtaacgggtaccgttaacggtttacgttaacgttacggtaacgtaaaccgtaaaacggtttaaggaaacccgtaacggtacccctttaaagggaacccttaaacgggttacccgggaaaacggtaaccgttaaccggaacgggtttacccggtttaagttttaaccttacggtttaccgggttaccgtacgtaccggggtaccgttacgggtaccctaaccgggttacctaacgttaacgtacggttaacggttacgggtaccggggacccggttaaccggggtacccgttccggttaccgttaaccccgg

SEQ ID NO: 166244 - DNA, 731 bp, Homo sapiens
  misc_feature: GYAE6OF02HZRB5.43.67.G01.1.454.CMB.1.raw
  modified_base (445)..(445): a, c, t, g, unknown or other
  misc_feature (445)..(445): n is a, c, g, or t
tcagtgtgagtagtcacgaccggtgctcgatttagagtatacatattgggtttggggggggagaggagccccagccttgggattcccaagtgttttcattcagtgatcaggactgaacacagaggactcaccatggagtttgggctgagctggtattttccttgctgcttattttaaaaggtgtccagtgtgaggtgcagttggtgggacgggtccgggggggggccttgggtacccggccggttcgggggggttccccttaggaccttcctcctgttcgtaacctctggacttccaccctcagtacgtctggatgacgcgttcggtccgccgaggctccggaggggaacggggctgggaggttggggttcggaccgttaaagttaaaaaccgaaaggtgggagggtcgggacagtacgacgttacgtcgccgtaccggtgaagnggcagtacttcgactatcctacaagagatcgtaattcgaaggaaggtcctaggtttgactcgtacgactaaacgtacgtaaaccgcgtaccgtagaaaccgtaagtaccgggaacggtaacaaccggtacggttacccgtttaagttaacgtttaccgtcgggtttacccgacggtaaccgggttcgtaccggttaccgtaacctacggtaattaaccggtcgttaacgttacgggtccgggacccgttaacggggacccttgggtaccctcccggttcctacccg

SEQ ID NO: 166245 - DNA, 995 bp, Homo sapiens
  misc_feature: GYAE6OF02F1ZB7.43.67.G01.1.454.CMB.1.raw
  modified_base (182)..(182): a, c, t, g, unknown or other
  misc_feature (182)..(182): n is a, c, g, or t
tcagtgtgagtagtcacgaccggtgctcgatttagagtatacatattgggtttggggggggagaggagccccagccttgggattcccaagtgttttcattcagtgatcaggactgaacacagaggactcaccatggagtttgggctgagctggtattttccttgctgctaattttaaaggtntccagtgtgaggtgctaggttggtggtacggtccgggggggcctgggtaccggccggtcgggggttcccttagacctcgtccgtgtacgtaacctcgtacggtacttccaccctacgaacggttaaccgttcgtaggtactggtaacgtccgttcgggtttacccggacccgaacgggtccgtacccgggaagggggaaccggggtccgttagggggtacgggtttggggttacgggtaaccgttaaaggtttaaaaaacccgaaaagggtttggggaagggggttacgggaaccgttaacgggttacggtaaaccgttaccggttacggacccgtacccgggttaggtaacgggacgggtaccgtaacgtacggttacccgtaccgtaacttaccgtaacgtaaaggtacgtaacgttacggttactttaccggaaaagggtaaccgggtccgttaaacgggtttccgttaaagttcccggtaacggtaaaccggttaaaacgttaacgggaaaccgttaccggtaaccggttaaccgaaacggttaaacgtaccggggtaaccgtaaaccctaacgggttacccgggttacccggtttaaggtttaaccctttccggttacccgggttaccccgacgggttaaccggggttccccgtttaaccgggttccctaaacccggttcccggtaaacgttaaaccgttccgggtaaaacccggttttacggggttaccccggggtaaaccccggttaaccggggttaaccccggttaccgggtaaccccccgttaccggttaccccgttaccccgg

SEQ ID NO: 166246 - DNA, 798 bp, Homo sapiens
  misc_feature: GYAE6OF02F97KM.43.67.G01.1.454.CMB.1.raw
tcagtgtgagtagtcacgaccggtgctcgatttagagtatacatattgggtttgggggggagaggagccccagccttgggattcccaagtgttttcattcagtgatcaggactgaacacagaggactcaccatggagtttgggctgagctggtatttttccttgctgcttaattttaaaaggtgtccagtgtgaggtgctaggttgggtggacgggtccggggggggctcggtaccggccgtcggggggtcccttagactcctcctgtcgtaacctcgtggtacttccaccctcaacgtacgtcgtggatgacgtcgttcggttccgcgacggcctaccggaggggaacggggcgtgggagggttggggttcggaccgttaaagttaaaaccgaaaagggttgggaagggggttcggggaacaagggttacgtaaccgttacggttcgcccgtaacccggtaggaaggacggctaaggtacgttccgacctaattccgtaacgaaaggtagtacgttggtaactttccggaaaggaaccggtcgttaacggttttacgttacttaccgtaggtaaacctaaaacgtacggaaaccgtaccgtacccgtaggaaacccgtaaggtacccggaaggaaccctaccggacgggttacccgttaagtttaccttttaccgttacggttcccgacggtaacggggtcccttaccgggtacctcccggtactaacgtagtacggtaccgttaggtcccggggaccgtacgggtacccgttcggtacccgttacctcccggtacc

SEQ ID NO: 166247 - DNA, 803 bp, Homo sapiens
  misc_feature: GYAE6OF02JWZ02.43.67.G01.1.454.CMB.1.raw
tcagtgtgagtagtcacgaccggtgctcgatttagagtatacatattgggtttggggggagaggagcccagccttgggattcccaagtgttttcattcagtgatcaggactgaacacagaggactcaccatggagtttgggctgagctggattttccgttgctgtctattttaaaaggtgtctagtgtgagtgctagttggtggacggtcgggggcctgggtacgccgtgggggtccgtagactcgtccgtgtcggtaacctcgtggtacttcctaccgtcgtacgtaacgtcgtcggtagtacggacgtccgttcggttccccgccgtacggccgtaccggaggggaacggggtcctaggggtacggtcggggttacggaccggttaaacgttaaaaacccgtaaagggtgggtaacggggtcggggtaaacgtacgggttaacggacgttaacggttcggaccggtacccgtaggaacggaggtaacgaacggttaaagttccgtaaccgtacgtaccgttaacgaacggtaagtacggtacgtacgttacgaacggtaacgtacgtaacgtttcggtaacttacgtacgtaaccgtaaagtaccgtaacgtaaccgttaccgtacgaaaccgttacgtaaccggaacggaaaccgtaacgtaaccgtcggtaaccgttaacgttacgttacgggttaccgcggttacggtaccgtcggtaccgtcgtacgtaagtacgtacgtaacggtacgttacggaccggtaacggtaccgtacggtacccgtacgtacctacccgg

SEQ ID NO: 166248 - DNA, 762 bp, Homo sapiens
  misc_feature: GYAE6OF02GM1Q2.43.67.G01.1.454.CMB.1.raw
  modified_base (133)..(133): a, c, t, g, unknown or other
  misc_feature (133)..(133): n is a, c, g, or t
  modified_base (625)..(625): a, c, t, g, unknown or other
  misc_feature (625)..(625): n is a, c, g, or t
  modified_base (688)..(688): a, c, t, g, unknown or other
  misc_feature (688)..(688): n is a, c, g, or t
tcagtgtgagtagtcacgaccggtgctcgatttagagtatacatattgggtttgggggggagaggagccccagccttgggattcccaagtgtttcagttcagtgagtcaggactgacacagagactcaccgtntggtagtttcgggctgagcgtggattttccgtgctgtacttagttttaaaggtcgtccagttgtagacggtggactaggttggcgggacgggtccggggggggtcctcggggtaccggtccggttcgggggggttacccctaacgtccgttctccgttaggttcgtaaccgttcgtaggtacttccgaccctgtaacgttacggtcttggagttcggaagtcgtttcggtaacccgtcgacgtaccgtaccgggtaacggggtaagggtccggtaggggacggttggggttaccgtaaccggttaaaaacgtttaaaaacccaaaggggttgggaacggggttcgaacgtaacgtcggttaacggtaactcggtcccacggtggaaacgcggttccaagtacgtccgccttaagtccgtaggtaacgacgtattacggaacgtttccgaaggttaacggcgttaagttgtaactcgtaaggactaaacggtnaacgtacgctaacggactatccggacggacacgaccgttacgcgtttactacgtcggtaccgnggacgttcctaccggtctccgagtagtactcggtacttggcgacgaaccgtcggaccttgacccggtcctacgg

SEQ ID NO: 166249 - DNA, 522 bp, Homo sapiens
  misc_feature: GYAE6OF01AEZIZ.26.71.G05.1.454.CMB.1.raw
  modified_base (512)..(512): a, c, t, g, unknown or other
  misc_feature (512)..(512): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtccccctatttggtcatcttccaagataagaagcggccctcagggatccctgaccgaatttctggctccaactctggaacacagccactctgaccatcagcgggcccagccaacggatgagggagactactatgtcaggcgtgggagaatactattgtagtgttggcggagggaccaggcgtgaccgtccgtaggtccaggcccaaggcctcgccccccgtcggtccactctcgttccccncccgttcccg

SEQ ID NO: 166250 - DNA, 523 bp, Homo sapiens
  misc_feature: GYAE6OF01CU625.26.71.G05.1.454.CMB.1.raw
  modified_base (334)..(334): a, c, t, g, unknown or other
  misc_feature (334)..(334): n is a, c, g, or t
  modified_base (402)..(402): a, c, t, g, unknown or other
  misc_feature (402)..(402): n is a, c, g, or t
  modified_base (427)..(427): a, c, t, g, unknown or other
  misc_feature (427)..(427): n is a, c, g, or t
tcagagactatactcacgaccggtgctcgatttagtgtcgtcgcaagagagagggggctgggcctcaggaagcaacatcggaggtgcctcagccatggcatggatccctctcttcctcggcgtccttgcttactgcacaggatccgtggccttcgatgagctgattcagccaccctcagtgtccgtgtccccaggacagacagccacatcacctgctcggcagacaaattgggagatagaaatgctgctggtattaccagagccaggccagtcccctatttgtcatcttccaagataagaagcggccctcgagggatccctgaccgtaatttcnggcctccaactctgggaacacagccaactctgaccatcagccgggcccagcccaaggatggaaggganactactaattgcgaggcgtaggganaatactattggtagtggtttggcggtaggcgaggctgaccgtcgtaggtcagcccgaaggcctcgcccctcggtccactcctcgttccccgtcccg

SEQ ID NO: 166251 - DNA, 536 bp, Homo sapiens
  misc_feature: GYAE6OF01DM9ZN.26.71.G05.1.454.CMB.1.raw
  modified_base (334)..(334): a, c, t, g, unknown or other
  misc_feature (334)..(334): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggtcatcttccaagataagaagcggccctcagggatccctgaccgaatttcnggctccaactctagggaacacagccactctgaccatcagcgggcccagccaacggatgagggagactactattgtcaggcgtgggagaatactattgtagttgtttggcggagggaccaggctggacccgtccgtaggtccgacgacccgaaggcctcgccccccgtcggtccaccgtcctccgttccccgccccgttcccg

SEQ ID NO: 166252 - DNA, 509 bp, Homo sapiens
  misc_feature: GYAE6OF01DCPH8.26.71.G05.1.454.CMB.1.raw
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggtcatcttccaagataagaagcggccctcagggatccctgaccgaatttctggctccaactctggaacacagccactctgaccatcagcggggcccagcccaacggatgagggagactactatgtcaggcgtgggagaatactattgtagtgttggcggagggaccaggctgaccgtccgtaggtcaggcccaaggctcgccccctggccactctgttccccg

SEQ ID NO: 166253 - DNA, 587 bp, Homo sapiens
  misc_feature: GYAE6OF01DTUW4.26.71.G05.1.454.CMB.1.raw
  modified_base (331)..(331): a, c, t, g, unknown or other
  misc_feature (331)..(331): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaagttgggagatagaaatgctgcctggtattaccagaggccaggccagtcccctattttcggtctatcttccaagataagaaagccggacctcgagggatcccngaccgaatttctggctccaactctgggaacacacgccactctgaccatcagccggggcccacgacccgaacggagtaggaagggacgacgtaactaagtttcgtacgaagggtcggtagggaaggtaactaacgttagttggttaagttggttttaggcgggtaggtaccgagggcctcgggaaccgttccgtaggtccacggccccgaaggcccgtcgcccccgttcggtacacccgttcgtccgttaccccccg

SEQ ID NO: 166254 - DNA, 555 bp, Homo sapiens
  misc_feature: GYAE6OF01DU42D.26.71.G05.1.454.CMB.1.raw
  modified_base (338)..(338): a, c, t, g, unknown or other
  misc_feature (338)..(338): n is a, c, g, or t
  modified_base (404)..(404): a, c, t, g, unknown or other
  misc_feature (404)..(404): n is a, c, g, or t
  modified_base (414)..(414): a, c, t, g, unknown or other
  misc_feature (414)..(414): n is a, c, g, or t
  modified_base (421)..(421): a, c, t, g, unknown or other
  misc_feature (421)..(421): n is a, c, g, or t
  modified_base (441)..(441): a, c, t, g, unknown or other
  misc_feature (441)..(441): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccacgtccccttattttggtcatccttacaagataagaagcgccctagaggactcccgtgacctaatttcnggcctaccaactcgtaggaacacacgccactctacgaccatcgaggccgggcccacgccaaacggntggaaggganactactnttcgtcgaggtcgtgggaanaatacgtattgtagttggttgggtcggagggaccgaggtcgtcgtaccgtccgtacggtcgacgacccgaggcgtccgccccgtccggtcaccttcgtccgtccctcccgtccc

SEQ ID NO: 166255 - DNA, 939 bp, Homo sapiens
  misc_feature: GYAE6OF01D0HZF.26.71.G05.1.454.CMB.1.raw
  modified_base (205)..(205): a, c, t, g, unknown or other
  misc_feature (205)..(205): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacgagctcggtgtccttgatgagctgtattcacgcccaccctcgagtcgtccgtccgtccccgaggacacgacncgacccaaccactccaccgtgccgtccggacaagaaactaaaggttgggaataagtaagaaatgctcgccgttaggttacttaaccgaaggacggaccgacggacctaccggttcccctttagttttcggactacttccttaccgaaagtaataaaggaacggcccggtacccttacggaaacgggtacccttaccccgtacggtaaaacccgttaaatttttccggtacgggtcccttaacccgtaaaccgttccggttaacggggaaaaacccacggaaccggtaccccctaaacgttccgttaaccggaaaccctaacgttacccggaaacgggggcccccgggggaacccccaacgggaacccccggtaaaacggggtacgttacggggaaacgggggtaaactaaccggtttaaaccgtttaggtttacgggtaaccggtaggggttacccggggttaaggggaaacgttaaaaccgtttaaccggttttaaggttttacgggtttaaacgggtttttcgggggtttacgggggaaccgggggttaaaccgggggtaacccgtaacggggttccgttaacccgggtaaccccggttccggtttaacggggttacccgaaccgggtaaccccggtaacgggtcccgttaacccccggtcccccccggttacgggttacccctaaccgtttcccggtttacccccggttccccctaacccccgtttacccg

SEQ ID NO: 166256 - DNA, 510 bp, Homo sapiens
  misc_feature: GYAE6OF01BVD9F.26.71.G05.1.454.CMB.1.raw
  modified_base (505)..(505): a, c, t, g, unknown or other
  misc_feature (505)..(505): n is a, c, g, or t
tcagagactatactcacgaccggtgctcgatttagtgtcgtcgcaagagagaggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctatttggtcatcttccaagataagaagcggccctcagggatccctgaccgaatttctggctccaactctgggaacacagccactctgaccatcagcgggcccagccaacggatgagggagactactatgtcaggcgtgggagaatactagttgtagtgtttggcggagggaccaggctagaccgtctaagtcgagcccaaggctcgcccctcggtccactctcgttcccncctcc

SEQ ID NO: 166257 - DNA, 516 bp, Homo sapiens
  misc_feature: GYAE6OF01AW1IN.26.71.G05.1.454.CMB.1.raw
  modified_base (236)..(236): a, c, t, g, unknown or other
  misc_feature (236)..(236): n is a, c, g, or t
  modified_base (336)..(336): a, c, t, g, unknown or other
  misc_feature (336)..(336): n is a, c, g, or t
  modified_base (475)..(475): a, c, t, g, unknown or other
  misc_feature (475)..(475): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctatttggtcatcttccaagataagaggcggccctcagggatccctgaccgaatttcnggctccaactctggaacacagccgactctgaccatcagcgggcccagccaacggatgaggagactactattgtcaggcgtagggagaatactattgtagtgtttggcggtagggaccaggtctggaccgtcgtacggtnacggcccaaggctcgccccctaggccactcgtcgtcccccg

SEQ ID NO: 166258 - DNA, 520 bp, Homo sapiens
  misc_feature: GYAE6OF01CJ1WG.26.71.G05.1.454.CMB.1.raw
  modified_base (335)..(335): a, c, t, g, unknown or other
  misc_feature (335)..(335): n is a, c, g, or t
  modified_base (513)..(513): a, c, t, g, unknown or other
  misc_feature (513)..(513): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtcccccaggacagacagccaccatcacctgctcggcagacaaattgggagatagaaatgctgcctggtattaccagaggccaggccagtcccctattttggtcatcttccaagataagaagcggccctcagggatccctgaccgaatttcnggctccaactctgggaacacagccactctgaccatcagcgggcccagccaacggatgagggagactactattgtcaggcgtgggagaatactattgtagtgttggcggagggccgaggctggaccgtccgtaggtcgacggacccaggcctcgccccctcggtccactcctcgtcccncccctcc

SEQ ID NO: 166259 - DNA, 615 bp, Homo sapiens
  misc_feature: GYAE6OF01CH7XJ.26.71.G05.1.454.CMB.1.raw
tcagagactatactcacgaccggtgctcgatttagtgtcgtcgcaagagagagggggcgtgggcctcaggaagcagcatcggaggtgcctcagccatggcatggatccctctcttcctcggcgtccttgcttactgcacaggatccgtggccttcgatgagctgattcagcccacccgcagtgtccgtgtccccaggacagacagccaccatcacctgctcggcagacaaattgggagatagaaatgctgcctggtattaccagaggccaggccagtcccctatttggcatcttccaagataagaagcggccctcgagggactccctgaccgtaatttctggctaccaactcgtacgggaacacagcctactctacgaccatccaggccggggccccaaggacccgaaacgggagtacggaaggggacgtaaccgttaacctaagtttcggtaccgagggtcggtacggggaagtaacgttaacgttaagtttaggtaggttaggtttgggacgggacgggaccagggcgtcggtacccggtcgtaggtccacggtaccccgaaggtccctaccggtccccccgttcggtaccaccgttccgtcggttacccccc

SEQ ID NO: 166260 - DNA, 519 bp, Homo sapiens
  misc_feature: GYAE6OF01B5TQL.26.71.G05.1.454.CMB.1.raw
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggtcatcttccaagataagaagcggccctcagggatccctgaccgaatttctaggctccaactctgggaacacagccactctgaccatcagcgggcccagccaacggatggaggagactactattgtcaggcgtagggagaatactattgtagtgtttggcggagggaccaggctgaccgtctaggtcagcccaaggcctcgccccctcggtcaccgtctcgttccccgccctcccg

SEQ ID NO: 166261 - DNA, 750 bp, Homo sapiens
  misc_feature: GYAE6OF01AL6WR.26.71.G05.1.454.CMB.1.raw
  modified_base (238)..(238): a, c, t, g, unknown or other
  misc_feature (238)..(238): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtcgtccgtgtccccaggacagacagccaccatcacctgctcggcagacaaagttggganatagaaatgctgcctggtattaccagaggccaggccagtcccctagttttcggtcatcttccaagataagaagccggccctacgacgggactcccgtagaaccgtaatttcgtcggcctaccaactcgtacgggaaccacacgccaactctacgacccatccgaacggccggggaccccacggacccgaaacgggacgtacgggaacggggaacgtaaccgttaacttacgtttacggtaccgaagggtccggtaggggaacggtaaacgttaaccgttaaggtttacgggttaacgggtttgggttttaggggaccggggtaacggggtaacccgtaacggggtccgttaaccgggtaaccccgggtttaccccggttaaacggggttaccccgtaaaccggggtaccccccgtaaaacggggtcccccgttaccccgggtacccccccccggttacggggttaccccctaacccggtttccccggttcccgggttttacccccccccggg

SEQ ID NO: 166262 - DNA, 528 bp, Homo sapiens
  misc_feature: GYAE6OF01B4SDJ.26.71.G05.1.454.CMB.1.raw
  modified_base (403)..(403): a, c, t, g, unknown or other
  misc_feature (403)..(403): n is a, c, g, or t
tcagagactatactcacgaccggtgctcgatttagtgtcgtcgcaagagagaggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctatttggtcatcttccaagataagaagcggcccctcgagggactcccgtgaccgtaatttctggctccaactctagggaacacagccactctgaccatcaggccgggcccagccaacggatgaggganactactattgtcaggcgtggagaatactagttagtagtggttggcggagggaccaggctggaccgtccgtaggtcgacgcccgaaggcctcgccccctcggtccactcgtccgttcccgccctcc

SEQ ID NO: 166263 - DNA, 559 bp, Homo sapiens
  misc_feature: GYAE6OF01BTYPX.26.71.G05.1.454.CMB.1.raw
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaagttgggagatagaaatgctgctggtattaccagaggccaggccagtcccctattttggtcatcttccaagataagaagcggccctgagggactcccgtgaccgtaatttctggctccaactctaggaacacagccactctgaccatcaaggccgggcccacggcccaaacggataggaagggacgtaactactagttgcgaggcgtagggagaagtactagttggttagttgtttggacggagggaccgaggcgtacgaccggtccgtaggtccacggcccgaaggtccctaccggtcccccgtcggtaccaccgtccgtccgtcccccg

SEQ ID NO: 166264 - DNA, 671 bp, Homo sapiens
  misc_feature: GYAE6OF01CIESJ.26.71.G05.1.454.CMB.1.raw
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccccattttggtcatcttccaagataagaagcggccctcagggatccctgaccgaatttctggctccaactctgggaacacagccactctcgaccatcaggccgggcccacgacccgaacggagtaggacgggaacgacgtacgtagttcgtacgacgggtccggtaggggaacgtaaacgttaacttagtttacggttaggtttcgggtttacggggtacggggtaacggggtaaccggacgggtaccggtacgggtaccccggttaccggtaacggggtacccgtaacccgggaccccgaaacgggtccccgttccccggtaccccccccggttaccgggtaaccccttaccccggttccgtttccccggtttacccccgtacccccgtttacccccg

SEQ ID NO: 166265 - DNA, 550 bp, Homo sapiens
  misc_feature: GYAE6OF01AJI9J.26.71.G05.1.454.CMB.1.raw
  modified_base (231)..(231): a, c, t, g, unknown or other
  misc_feature (231)..(231): n is a, c, g, or t
  modified_base (432)..(432): a, c, t, g, unknown or other
  misc_feature (432)..(432): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctatttggtcatcttccaagataagaagcggccctcagggactccctgaccgtaatttctggctccaactcgtagggaacacagccactctgaccatcacgccgggacccagaccaacggatacggagggacgactacgtattcgtcgaggcgtagganaatacgtattcgtagtgtttaggcggtaggaccgaggctcggaccgtccgaggtcgacgcccgaaggcctaccgcccccgttcggtaccaccttccgtccgttccccgcccgttcccg

SEQ ID NO: 166266 - DNA, 507 bp, Homo sapiens
  misc_feature: GYAE6OF01EO2O3.26.71.G05.1.454.CMB.1.raw
  modified_base (231)..(231): a, c, t, g, unknown or other
  misc_feature (231)..(231): n is a, c, g, or t
  modified_base (331)..(331): a, c, t, g, unknown or other
  misc_feature (331)..(331): n is a, c, g, or t
  modified_base (476)..(476): a, c, t, g, unknown or other
  misc_feature (476)..(476): n is a, c, g, or t
  modified_base (500)..(500): a, c, t, g, unknown or other
  misc_feature (500)..(500): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctatttggtcatcttccaagataagaagcggccctcagggatccctgaccgaatttcnggctccaactctgggaacacagccactctgaccatcagcggggcccagccaacggatgagggagactactattgcaggcgtgggagaatactattgtagtgtttggcggagggaccaggctgaccgtctaggtcagcccaaggcncgcccctcggtcactctcgtcccncccgtcc

SEQ ID NO: 166267 - DNA, 530 bp, Homo sapiens
  misc_feature: GYAE6OF01AV632.26.71.G05.1.454.CMB.1.raw
  modified_base (492)..(492): a, c, t, g, unknown or other
  misc_feature (492)..(492): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtcccccaggacagacagccaccatcacctgctcggcagacaaattgggagatagaaatgctgcctggtattaccagaggccaggccagtcccctatttggtcatcttccaagataagaagcggccctcagggatccctgaccgaatttctggctccaactctgggaacacagccactctgaccatcagcgggcccagccaacggatggagggagactactagtgtcaggcgtgggagaatactagtaggtagttgtttgggcggaggggaccagggctggaccgtccgtaggtcgacgcccaaggccncgccccctcggtccacctccgtcgttcccgccctcccg

SEQ ID NO: 166268 - DNA, 831 bp, Homo sapiens
  misc_feature: GYAE6OF01C91KL.26.71.G05.1.454.CMB.1.raw
  modified_base (177)..(177): a, c, t, g, unknown or other
  misc_feature (177)..(177): n is a, c, g, or t
  modified_base (239)..(239): a, c, t, g, unknown or other
  misc_feature (239)..(239): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctnagtgtccgtgtccccaggaccagacagccaccatccacctgctcggcagacaaagttggganatagaatgactgcctggtataccagagccaggccagtcccctatttggctatcttaccaagtataagaacgcggacctcgacgggtactcccgtagaccgtaatttcgtacggccttacccgaaaccgttcgtacgggaaaccacgtacgcccctaacttccgtacgtaacccagttcccgaacgggaccccgggggtaccccaacgggaccccgaaaaccgggacgttaacgggaacggggtaacgtaaccgtttaaccgttaacgtttcggtaccgtaacggggtaccgggttaggggtaaacggtaaacgtttaaccgttaaggttttacgggtttaacgggtttggggtttttaccggggaaccgggggtaaccgggggtaaccccgttaacgggggtacccgttaccgggggtaacccccggtttaccccgggtaaacggggttaccccggaaacccggggtaacccccggtaaaaccgggggttccccgtttaacccccggggtaccccccccccggtttaccggggttaccccgttaaaccccggttttcccccggtttccccgggtttttaccccccccccggg

SEQ ID NO: 166269 - DNA, 679 bp, Homo sapiens
  misc_feature: GYAE6OF01D3X5J.26.71.G05.1.454.CMB.1.raw
  modified_base (206)..(206): a, c, t, g, unknown or other
  misc_feature (206)..(206): n is a, c, g, or t
tcagagactatactcacgaccggtgctcgatttagtgtcgtcgcaagagagaggggtacatgccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaatgctgcctggtattaccagaggccaggccagtcccctatttggtcatcttccaagataagaagcggccctcagggatccctgaccgtatttctggctccaactctaggaacacagaccactctacgaccatcacggccgggcccagacccgaacgggagtaggaacgggagaacctacgtagtttacggtacgagggtcggttagggaaggtaaacttaacgttaagttacggttaggttggtttaggggacgggtaaggggacccgaagggtccgtacgggtaacccgttaccggtaacgggtccaaccggaccccgtaaacgggtcccgtaccggtcccccccgttcgggttacccgtacccgttcccgttcccgggttaccccccgtccccgttaccccgttccgtaacggttaccttaaccggttccgttacccgttacggcggtccggggtcgttaccgggg

SEQ ID NO: 166270 - DNA, 515 bp, Homo sapiens
  misc_feature: GYAE6OF01DLQHM.26.71.G05.1.454.CMB.1.raw
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccacctcagtgtccgtgtccccaggacagacagccaccatcacctgctcggcagacaaattgggagatagaaatgctgcctggtattaccagaggccaggccagtcccctatttggtcatcttccaagataagagcggccctcagggatccctgaccgaatttctggctccaactctgggaacacagccactctgaccatcagcgggcccagccaacggatgagggagactactattgtcaggcgtgggagaatactattgtagtgtttggcggagggaccaggctgaccgtccgtaggtcagcccaaggcctacgccccctggtccacttcctcgttccccgccctcccg

SEQ ID NO: 166271 - DNA, 524 bp, Homo sapiens
  misc_feature: GYAE6OF01CTRNP.26.71.G05.1.454.CMB.1.raw
  modified_base (282)..(282): a, c, t, g, unknown or other
  misc_feature (282)..(282): n is a, c, g, or t
  modified_base (407)..(407): a, c, t, g, unknown or other
  misc_feature (407)..(407): n is a, c, g, or t
  modified_base (416)..(416): a, c, t, g, unknown or other
  misc_feature (416)..(416): n is a, c, g, or t
tcagagactatactcacgaccggtgctcgatttagtgtcgtcgcaagagagaggggtccatgccatggcatggatccctctcttcctcggcgtccttgcttactgcacaggatccgtggccttcgatgagctgattcagccaccctcagtgtccgtgtcccaggacagacagccaccatcactgctcggcagacaaattgggagatagaaatgctgcctggtattaccagaggccaggccagtccctattttggtcatcttccaagataagaagcggccctnagggactccctgaccgaatttctggctcaactctgggaacacagccactctgaccatcagcgggccagaccacgatgaggagactacattgtcgagcgtaggagtaatactatgtagtgtttggnggaggacgnggactcgaccgtcaggtcacgccgaaggctacgccccgtcggtccactccgtcgttccccgaccttcctcgacgttacgtacgttctacgtagcggtcgggcgtcggg

SEQ ID NO: 166272 - DNA, 536 bp, Homo sapiens
  misc_feature: GYAE6OF01BG58G.26.71.G05.1.454.CMB.1.raw
  modified_base (236)..(236): a, c, t, g, unknown or other
  misc_feature (236)..(236): n is a, c, g, or t
  modified_base (336)..(336): a, c, t, g, unknown or other
  misc_feature (336)..(336): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctatttggtcatcttccaagataagaagcggccctcgagggatccctgaccgaattcnggctccaactctaggaacacagccactctgaccatcacgccgggcccagcccaacggatggagggagactactattgcaggcgtgggagaatactagttgtagttggtttggacgggtagggaccgagggcctaggacccggtcgtaggtccacggccccaaggcctccgcccccgtacgtccacctcgtcgttcccccg

SEQ ID NO: 166273 - DNA, 524 bp, Homo sapiens
  misc_feature: GYAE6OF01DO5RG.26.71.G05.1.454.CMB.1.raw
  modified_base (236)..(236): a, c, t, g, unknown or other
  misc_feature (236)..(236): n is a, c, g, or t
  modified_base (405)..(405): a, c, t, g, unknown or other
  misc_feature (405)..(405): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctatttggtcatcttccaagataagaagcggccctcagggatccctgaccgaatttctggctccaactctgggaacacagccactctgaccatcagccggggcccagcccaacggataggacggganactactatgtcaggcgtgggagaatactagttgtagttggtttggcgggaggaccgaggcgtgaccgtccgtaggtcacggcccaaggctacgcccccgtgtccactcctcgtcccccg

SEQ ID NO: 166274 - DNA, 511 bp, Homo sapiens
  misc_feature: GYAE6OF01D2L9B.26.71.G05.1.454.CMB.1.raw
  modified_base (236)..(236): a, c, t, g, unknown or other
  misc_feature (236)..(236): n is a, c, g, or t
  modified_base (405)..(405): a, c, t, g, unknown or other
  misc_feature (405)..(405): n is a, c, g, or t
  modified_base (427)..(427): a, c, t, g, unknown or other
  misc_feature (427)..(427): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtccccattttggtcatcttccaagataagaagcggccctcaggggactccctgaccgaatttctaggctccaaactctgggaacacagccaactctagaccatcagcgggcccagccaacggatgaggganactactatgtcaggcgtggganaatactattgtagtgtttggcggaggcgaggctgaccgtcgtaggtcagcccaaggctacgcccctcggccactcgtgtccccg

SEQ ID NO: 166275 - DNA, 625 bp, Homo sapiens
  misc_feature: GYAE6OF01D9OVT.26.71.G05.1.454.CMB.1.raw
  modified_base (341)..(341): a, c, t, g, unknown or other
  misc_feature (341)..(341): n is a, c, g, or t
tcagagactatactcacgaccggtgctcgatttagtgtcgtcgcaagagagaggggcgtgggcctcaggaagcagcatcggaggtgcctcagccatggcatggatccctctcttcctcggcgtccttgcttactgcacaggatccgtgaccttcgatgagctgattcagcccaccctcagtgtccgtgtccccaggacagacagccaccatcacctgctcggcagacaaattgggagatagaaatgctgcctggtattaccagaggccaggccagtcccctattttggtcatcttaccaagataagaagcggccctgagggactccctgaccgtaatttcncggctccaactcgtggaacacgagccactctgaccatcgacggccggggaccctaggacccgaaacgggatcgggaacgggagtaaccgttacttaacgtttgtaccgaggggtccgtaggggaagtaagtaacgttatttaggtaggtttaggtttacggggacgggacgggaccgtagggccgttacggaacccggttccgtacgggtaccgacggtccccgaacgggtccctaccgtccccccggttacgggtacctacccgtcgttcccggttacccccc

SEQ ID NO: 166276 - DNA, 521 bp, Homo sapiens
  misc_feature: GYAE6OF01C57L8.26.71.G05.1.454.CMB.1.raw
  modified_base (426)..(426): a, c, t, g, unknown or other
  misc_feature (426)..(426): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccacctcagtgtccgtgtccccaggacagacagccaccatcacctgctcggcagacaaattgggagatagaaatgctgcctggtattaccagaggccaggccagtcccctatttggtcatcttcaagataagaagcggccctcagggactcccgtagaccgaatttctggtctccaactctagggaacacagccactctgaccatcagccggggcccagaccaacggatggaaggagactactattagtcgaggcgtggganaatactattgtagtgtttggcggaggacaggctgaccgcgtaggcagtcccaaggctcgcccccgtcggtccacgtcctcgtcccgccctacccg

SEQ ID NO: 166277 - DNA, 656 bp, Homo sapiens
  misc_feature: GYAE6OF01C1HY1.26.71.G05.1.454.CMB.1.raw
  modified_base (236)..(236): a, c, t, g, unknown or other
  misc_feature (236)..(236): n is a, c, g, or t
  modified_base (305)..(305): a, c, t, g, unknown or other
  misc_feature (305)..(305): n is a, c, g, or t
  modified_base (329)..(329): a, c, t, g, unknown or other
  misc_feature (329)..(329): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaagttgganatagaatgctgcctggtataccagagccaggccagtccctatttgcatctcaagataagacgcggcctnagggactccgtgaccgtaatttcnggcctccaactctaggaacacacgccactctagaccatcgacggccggggacccaggacccgaaacggagtacggaagggacgaaccgttaacgtacgttaggtacgacgggtcggttaggggaacgtaaacgttaacgttagtttacggttaaggtttaggtttacgggacgggtaacggggacccgtaggggtaccgttaccgggaacccggttacccggtaaagggttcccgaacgggtccccggtaaacgggcccctttacccgggacccccccgttacggggttacccctaacccgttcccgttacccgggtttaccccccc

SEQ ID NO: 166278 - DNA, 520 bp, Homo sapiens
  misc_feature: GYAE6OF01B42N8.26.71.G05.1.454.CMB.1.raw
  modified_base (470)..(470): a, c, t, g, unknown or other
  misc_feature (470)..(470): n is a, c, g, or t
  modified_base (505)..(505): a, c, t, g, unknown or other
  misc_feature (505)..(505): n is a, c, g, or t
tcagagactatactcacgaccggtgctcgatttagtgtcgtcgcaagagagaggggtccatgccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggtcatcttccaagataagaagcggccctcagggatccctgaccgaatttctggctccaactctgggaacacagccactctgaccatcaggccggggcccagcccaacggatggagggagactactattgtcaggcgtgggagaatactagttgtagttgttggcggagggaccaggctggaccgtctaggtcagccgaagctcgcccctggtcncgtcctcgtccctccctcctcacgtatacgtctcngacgcgggctacggg

SEQ ID NO: 166279 - DNA, 570 bp, Homo sapiens
  misc_feature: GYAE6OF01DX9K1.26.71.G05.1.454.CMB.1.raw
  modified_base (233)..(233): a, c, t, g, unknown or other
  misc_feature (233)..(233): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctattttggtcatcttccaagataagaagcggccctcgagggactccccgtagaccgtaaatttcgtggctacccaaactctagggaaccacacgcccactctgaccatcgagccggggcccagccaacggatggagggagactactagttgtcgaggcggtgggaagaatacgtagttaggtagttgtttgggacgggtagggaccgagggctcggaccgtccgtaggtccgacggacccaagggccctcggcccccctcggtaccaccgttcctccgttccccacccttcccg

SEQ ID NO: 166280 - DNA, 526 bp, Homo sapiens
  misc_feature: GYAE6OF01CZLVR.26.71.G05.1.454.CMB.1.raw
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggcatctccaagataagaagcggccctcagggactcctgaccgaatttctggctccaaactctaggaacacagccactctgaccatcagcgggcccagcccaacggatggaggagactactatgtcgaggcgtagggagaagtactagttgtagttggtttggcgggagggaccaggctcggaccgttccgtaggtcacggcccgaaggcctcggccccctggtccactcgtcgtaccccc

SEQ ID NO: 166281 - DNA, 522 bp, Homo sapiens
  misc_feature: GYAE6OF01AVUK8.26.71.G05.1.454.CMB.1.raw
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtcccccaggacagacagccaccatcacctgctcggcagacaaattgggagatagaaatgctgcctggtattaccagaggccaggccagtcccctattttggtcatcttccaagataagaagcggccctcagggatccctgaccgaatttctggctccaactctggaacacagccactctgaccatcagcggggcccagcccaacggatgagggagactactattgtcaggcgtgggagaatacgtattgtagttgtttggcggagggaccgaggcgtgaccgttcctaggtccaggcccaaggcctacggccccctggtccactctcgttccccc

SEQ ID NO: 166282 - DNA, 707 bp, Homo sapiens
  misc_feature: GYAE6OF01CB5C8.26.71.G05.1.454.CMB.1.raw
  modified_base (236)..(236): a, c, t, g, unknown or other
  misc_feature (236)..(236): n is a, c, g, or t
  modified_base (313)..(313): a, c, t, g, unknown or other
  misc_feature (313)..(313): n is a, c, g, or t
tcagagactatactcacgaccggtgctcgatttagtgtcgtcgcaagagagaggggcctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctatttggcatcttccaagataagaagcggccctnagggactccctgaccaatttctggctccaaactcgtaggaacacagccaactctacgaccatcgaccccggcggggaccccaggaccccgaaacgggacgttacggggggaacgtaaccgtacgttaagtttcggtaccgtaagggtccggttaggggaacgtaaacgttaccgttaagtttggttaacgggtttgggttttacggggacggggtaacgggggtacccgtaacggggtccgttacgggtacccggttacccggtaacgggttacccgaaccgggtacccccggtaaacggggtccccgttaacccgggtcccccccccggtttacggggttacccccttacccggttcccgtttccccggtttccccccgttaaacccccccgg

SEQ ID NO: 166283 - DNA, 508 bp, Homo sapiens
  misc_feature: GYAE6OF01CQK60.26.71.G05.1.454.CMB.1.raw
  modified_base (418)..(418): a, c, t, g, unknown or other
  misc_feature (418)..(418): n is a, c, g, or t
tcagagactatactcacgaccggtgctcgatttagtgtcgtcgcaagagagaggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggtcatcttccaagataagaagcggccctcagggactccctgaccgaatttctggctccaactctaggaacacagccactctgaccatcagcgggcccagccaacggatgaggagactactatgtcaggcgtagganaatactatgtagtgttggcggaggacaggctgaccgtctaggtcacgcccaaggcctcgccccctggtccactctcgttcccgccctccg

SEQ ID NO: 166284 - DNA, 530 bp, Homo sapiens
  misc_feature: GYAE6OF01A74ZJ.26.71.G05.1.454.CMB.1.raw
  modified_base (311)..(311): a, c, t, g, unknown or other
  misc_feature (311)..(311): n is a, c, g, or t
  modified_base (333)..(333): a, c, t, g, unknown or other
  misc_feature (333)..(333): n is a, c, g, or t
  modified_base (424)..(424): a, c, t, g, unknown or other
  misc_feature (424)..(424): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggtcatcttccaagataagaagcgccctnagggatccctgaccgaatttcnggctccaactctggaacacagccactctgaccatcaggccgggcccagccaacggatcggaaggagactactattcgtcgaggcgtggganaatactagttgtagtgtttggcggagggaccaggctgaccgtccgtaggtccagcccgaaggcctaccggccccctcggtccacttcctcgttccccgccctcccg

SEQ ID NO: 166285 - DNA, 513 bp, Homo sapiens
  misc_feature: GYAE6OF01DZ2LK.26.71.G05.1.454.CMB.1.raw
  modified_base (231)..(231): a, c, t, g, unknown or other
  misc_feature (231)..(231): n is a, c, g, or t
  modified_base (385)..(385): a, c, t, g, unknown or other
  misc_feature (385)..(385): n is a, c, g, or t
  modified_base (415)..(415): a, c, t, g, unknown or other
  misc_feature (415)..(415): n is a, c, g, or t
  modified_base (505)..(505): a, c, t, g, unknown or other
  misc_feature (505)..(505): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctatttggtcatcttccaagataagaagcggccctcagggatccctgaccgaatttctggctccaactctggaacacagccactctgaccatcagcgggcccagccaacggntgaggagactactattgtcaggcgtggganaatactattgtagtgtttggcggagggacaggctgaccgtcgtaggtcgacgcccgaaggcctcgccccctcggtccactctcgttcccncccgtccc

SEQ ID NO: 166286 - DNA, 540 bp, Homo sapiens
  misc_feature: GYAE6OF01DQ9VB.26.71.G05.1.454.CMB.1.raw
  modified_base (460)..(460): a, c, t, g, unknown or other
  misc_feature (460)..(460): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtataccagaggcaggccagtcccctatttggtcatcttccaagataagaagcgccctcagggatccctgaccgtaatttcgtggcctaccaactcgtagggaacacacgccactctacgaccatcgacggccggggcccagcccgaacggagtaggagggagactactattgtcaggcgtgggagaatactattgtagtggtttggngggtaggaccgaggctcggaccgtccgtaggtcacggcccaaggcctcgtccccctcggtccacctcctcgttccccccg

SEQ ID NO: 166287 - DNA, 603 bp, Homo sapiens
  misc_feature: GYAE6OF01DQSI1.26.71.G05.1.454.CMB.1.raw
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtcgtccgtgtccccaggacagacagccaccatcacctgctcggcagacaaagttggggagatagaaatgctgcctggtattaccagaggccaggccagtcccctattttggtcatcttccaagataagaacgcggccctcagggactcctgaccgtaatttctggctccaactcgtaggaacacacgccactctacgaccataccgacggccggggacccaggccccgaaacggacgtaggaagggacgaacttaacttagttcggtacgacgggtacggtagggaagtaaactacgttagttggtaggttggtttgggacgggtagggaccgtagggtcgtacggaccgttccgtacggtaccacggcccgacggtccgtaccggtcccccgtcggtaccctacctccgtcccggttcccccg

SEQ ID NO: 166288 - DNA, 517 bp, Homo sapiens
  misc_feature: GYAE6OF01A3VZS.26.71.G05.1.454.CMB.1.raw
  modified_base (310)..(310): a, c, t, g, unknown or other
  misc_feature (310)..(310): n is a, c, g, or t
  modified_base (332)..(332): a, c, t, g, unknown or other
  misc_feature (332)..(332): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggtcatcttccaagataagaagcggccctnagggatccctgaccgaatttcnggctccaactctgggaacacagccactctgaccatcagcggggcccagccaacggatgagggagactactattgcaggcgtgggagaatactagttgtagtgtttgggcggtagggaccaggctggaccgtcctaggtccagcccaaggcctcgcccctcggtccactctcgttcccgccctccc

SEQ ID NO: 166289 - DNA, 574 bp, Homo sapiens
  misc_feature: GYAE6OF01D2TYK.26.71.G05.1.454.CMB.1.raw
  modified_base (339)..(339): a, c, t, g, unknown or other
  misc_feature (339)..(339): n is a, c, g, or t
  modified_base (564)..(564): a, c, t, g, unknown or other
  misc_feature (564)..(564): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaagttgggagatagaatgctgcctggtattaccagaggccaggccagtcccctattttcggtcatcttccaagataagaacgcggccctgagggactccctagaccgtaatttcnggctccaactctggaacacagccactctgaccatcgacggccgggacccagaccgaacggatacggagggacactactagttcgacgaggtcggtagggagtaatacgtagttaggtaggttggtttagggacgggacgggaccgagggtctcggtaccgtccgtaggtccacggacccgaaggccctccgcccccgtcggtaccaccttccgtccgttcccccncccgttcccg

SEQ ID NO: 166290 - DNA, 513 bp, Homo sapiens
  misc_feature: GYAE6OF01CA7CZ.26.71.G05.1.454.CMB.1.raw
  modified_base (231)..(231): a, c, t, g, unknown or other
  misc_feature (231)..(231): n is a, c, g, or t
  modified_base (331)..(331): a, c, t, g, unknown or other
  misc_feature (331)..(331): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctatttggtcatcttccaagataagaagcggccctcagggatccctgaccgaatttcnggctccaactctgggaacacagccactctgaccatcagcgggcccagccaacggatgagggagactactattgtcaggcgtgggagaatactagttgtagtgtttggcggagggaccaggctgaccgtcgtaggtcacgcccaaggcctcgccccctcggtccactctcgtcccgccctccg

SEQ ID NO: 166291 - DNA, 526 bp, Homo sapiens
  misc_feature: GYAE6OF01EFX9K.26.71.G05.1.454.CMB.1.raw
  modified_base (395)..(395): a, c, t, g, unknown or other
  misc_feature (395)..(395): n is a, c, g, or t
  modified_base (402)..(402): a, c, t, g, unknown or other
  misc_feature (402)..(402): n is a, c, g, or t
  modified_base (516)..(516): a, c, t, g, unknown or other
  misc_feature (516)..(516): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctatttggtcatcttccaagataagaagcggccctcgagggactccctgaccgtaatttctggctccaactcgtgggaacacagccactctgaccatcaggccgggcccagccaacggntgagganactactattgcaggcgtggagaatactattgtagttgttggcggtaggacaggctgacgtcctaggtcacggcccaaggtcctacgccccctacggtccacgtctcgttccccncccttacccg

SEQ ID NO: 166292 - DNA, 509 bp, Homo sapiens
  misc_feature: GYAE6OF01BAVNJ.26.71.G05.1.454.CMB.1.raw
  modified_base (231)..(231): a, c, t, g, unknown or other
  misc_feature (231)..(231): n is a, c, g, or t
  modified_base (397)..(397): a, c, t, g, unknown or other
  misc_feature (397)..(397): n is a, c, g, or t
  modified_base (420)..(420): a, c, t, g, unknown or other
  misc_feature (420)..(420): n is a, c, g, or t
  modified_base (502)..(502): a, c, t, g, unknown or other
  misc_feature (502)..(502): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtccccctattttggtcatcttccaagataagaagcggccctcagggatccctgaccgaatttctggctccaactctgggaacacagccactctgaccatcagcgggcccagccaacggatggaggganactactattgtcaggcgtggganaatactattgagttgttggcggagggcaggctgaccgtctaggtcagcccaaggctcgccccctggtccactctcgttcccnccctccc

SEQ ID NO: 166293 - DNA, 679 bp, Homo sapiens
  misc_feature: GYAE6OF01CPHWQ.26.71.G05.1.454.CMB.1.raw
  modified_base (233)..(233): a, c, t, g, unknown or other
  misc_feature (233)..(233): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtataccagagccaggccagtcccctatttggctatcttaccaagataagagcgccctcgaggactccgtagaccgtaatttctcggctaccaactcgtaggaacacgaagcccactctacgaccatccgacggccgggacccacgaccgaacgggagtacggaagggaacgtacgtaacgtagttacgtacgaacgggtcgggtagggaagtaaacgttaacgttaagtttaggttaagggtttcgggttttacggggaccggggtaaggggtacgttacggtaacgggtccgttacgggtaacccggttaccgttaacgggtaccgtaccgggaccccggtaaacgggtccccgttacccgggtacccccccgttaccgggttacccgtacccgtttcccgttcccggtttccccccggtaccccccg

SEQ ID NO: 166294 - DNA, 540 bp, Homo sapiens
  misc_feature: GYAE6OF01EDNU8.26.71.G05.1.454.CMB.1.raw
  modified_base (530)..(530): a, c, t, g, unknown or other
  misc_feature (530)..(530): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtcccccaggacagacagccaccatcacctgctcggcagacaaattgggagatagaaatgctgcctggtattaccagaggccaggccagtcccctatttggtcatcttccaagataagaagcggccctcagggactccctgaccgaatttctggctccaactctgggaacacagccactctgaccatcagccgggcccagccaacggatgagggagactactattgtcaggcgtggagaatactattgtagttggtttgggcggtagggaccgaggctacggaccgtccgtaggtcacggtcccaaggtcctcggcccccctcggtccacgttcctccgttccccnccccttcccg

SEQ ID NO: 166295 - DNA, 508 bp, Homo sapiens
  misc_feature: GYAE6OF01EIK52.26.71.G05.1.454.CMB.1.raw
  modified_base (336)..(336): a, c, t, g, unknown or other
  misc_feature (336)..(336): n is a, c, g, or t
  modified_base (424)..(424): a, c, t, g, unknown or other
  misc_feature (424)..(424): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggtcatcttccaagataagaagcgccctcagggatccctgaccgaatttcnggctccaactctggaacacagccactctgaccatcagcggggcccagcccaacggatggaggagactactagttgtcaggcgtggganaatactagttgtagtgtttggcggagggaccaggctgaccgtcgtaggtcagcccaagctcgcccctggtccactctcgtcccc

SEQ ID NO: 166296 - DNA, 563 bp, Homo sapiens
  misc_feature: GYAE6OF01DQ6IQ.26.71.G05.1.454.CMB.1.raw
  modified_base (435)..(435): a, c, t, g, unknown or other
  misc_feature (435)..(435): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaagttgggagatagaaatgctgcctggtattaccagaggccaggccagtcccctattttggtcatcttccaagataagaagcggccctcagggactccctgaccgaatttctggctccaactcgtacgggaacacgacgcccactctgaccatcacggcgggcccacgccaacggatggaagggagactactattgtcgaggcgtggganaagtactattgtagtgtttggcggtagggacgaggcgtggtaccgtccgtaggtccgacggacccgaacgggtcctccggtccccctccgggttacccacttcctcgttccccctccccgttaccccg

SEQ ID NO: 166297 - DNA, 524 bp, Homo sapiens
  misc_feature: GYAE6OF01BQLLK.26.71.G05.1.454.CMB.1.raw
  modified_base (236)..(236): a, c, t, g, unknown or other
  misc_feature (236)..(236): n is a, c, g, or t
  modified_base (312)..(312): a, c, t, g, unknown or other
  misc_feature (312)..(312): n is a, c, g, or t
  modified_base (332)..(332): a, c, t, g, unknown or other
  misc_feature (332)..(332): n is a, c, g, or t
  modified_base (498)..(498): a, c, t, g, unknown or other
  misc_feature (498)..(498): n is a, c, g, or t
  modified_base (510)..(510): a, c, t, g, unknown or other
  misc_feature (510)..(510): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctatttggtcatcttccaagataagagcggcctnaggactccctgaccgattcngctcactctggaacacagccactctgaccatcgacggccggggccccagcccgaaacggatacgggacgggagaactacgtagttgcgaggcgtagggagtaatactagttgtagttgtttgggcggaggaccaggctgacccgtcgtacggtcacgcccaggccncgcccctcggcncctcgtcgtccccg

SEQ ID NO: 166298 - DNA, 807 bp, Homo sapiens
  misc_feature: GYAE6OF01BHUN7.26.71.G05.1.454.CMB.1.raw
  modified_base (175)..(175): a, c, t, g, unknown or other
  misc_feature (175)..(175): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccccacctngtcgtccgtccgtcccgagacacgacacgacccacactaccacctcgccgtcggacaacgaaactaaaggttgggaagtaagtaaagtaagtcgtacgtcgtcgttagttaacctacgaggaccgacgacgaccgtaccgttacctttagtttcgactacttcctaacgaaagtaagtaaggacggcccgtaccgtagggaacggtccttaccgacggtaaccgtttagttcgcgtaccctaacctaccgttacgggaaccggaaacctacgaccgtaccctacgttacgaccgaacctccgtacgggaccggggtccccgggaacccaccggtaacccggaacggtggtaacggggaacggtaacctaaccgtttaacgtttaggtaccggtaacggacggggttacgggtaagggtaaacttaacgtttaacggtttagtttacgggttaggttttcggggttacgggaacggggtaaccggacggtacggttccgtaaccggttacccggttaggtaccgggtaccgaacccgggtaacccggccggttcccgtccccccgggttaccccgttacggttacccgtacccctttccggtttacccccgttaccccctcccggtttacccg

SEQ ID NO: 166299 - DNA, 511 bp, Homo sapiens
  misc_feature: GYAE6OF01EWRX6.26.71.G05.1.454.CMB.1.raw
  modified_base (237)..(237): a, c, t, g, unknown or other
  misc_feature (237)..(237): n is a, c, g, or t
  modified_base (338)..(338): a, c, t, g, unknown or other
  misc_feature (338)..(338): n is a, c, g, or t
  modified_base (402)..(402): a, c, t, g, unknown or other
  misc_feature (402)..(402): n is a, c, g, or t
  modified_base (498)..(498): a, c, t, g, unknown or other
  misc_feature (498)..(498): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtcccccaggacagacagccaccatcacctgctcggcagacaaattggganatagaaatgctgcctggtattaccagaggccaggccagtcccctattttggtcatcttccaagataagaagcggccctcagggatccctgaccgaatttcnggctccaactctggaacacagccactctgaccatcagccgggcccagcccaacggatgaggganactactattgtcaggtcgtgggagaatactagttgtagttgttggcggaggacgaggctgaccgtcgtaggtcacgcccaggctcgcccctggccncgtctcgtccccg

SEQ ID NO: 166300 - DNA, 527 bp, Homo sapiens
  misc_feature: GYAE6OF01B0SH9.26.71.G05.1.454.CMB.1.raw
  modified_base (233)..(233): a, c, t, g, unknown or other
  misc_feature (233)..(233): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgactgcctggtattaccagaggccaggccagtcccctatttggtcatcttccaagataagaacgcggccctcagggatccctgaccgaatttctggctccaactctggaacacagccactctgaccatcacgcgggcccagccaacggataggaggagactactattgtcgaggcgtggagtaatacgtattagtagtgttggcggtagggacaggctgaccgtccgtaggtcagcccgaaggccgtacgccccctcggtccactcctcgttccccgtccctcccg

SEQ ID NO: 166301 - DNA, 512 bp, Homo sapiens
  misc_feature: GYAE6OF01BCON4.26.71.G05.1.454.CMB.1.raw
  modified_base (427)..(427): a, c, t, g, unknown or other
  misc_feature (427)..(427): n is a, c, g, or t
  modified_base (449)..(449): a, c, t, g, unknown or other
  misc_feature (449)..(449): n is a, c, g, or t
  modified_base (485)..(485): a, c, t, g, unknown or other
  misc_feature (485)..(485): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagagccaggccagtcccctatttggtcatcttccaagataagaagcgcctgagggactcctgaccgaatttctggctccaactctggaacacacgccactctagaccatcgacgccgggacccagaccgaacggatggaagggacactacgtattgtcaggcgtaggganaatactagttgtagtgtttggnggagggacaggctgaccgtctaggtcacgccaggcncgccctcgtcactctctcccgcctccg

SEQ ID NO: 166302 - DNA, 643 bp, Homo sapiens
  misc_feature: GYAE6OF01CMU4F.26.71.G05.1.454.CMB.1.raw
  modified_base (233)..(233): a, c, t, g, unknown or other
  misc_feature (233)..(233): n is a, c, g, or t
  modified_base (335)..(335): a, c, t, g, unknown or other
  misc_feature (335)..(335): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctatttggcatcttccaagataagaagcggccctcgagggacccctgacccgaatttcgnggcctccaactctagggaacacagccactctgaccatcacgccgggacccagacccgaacggagtaggaagggaagaactacgtagttacgtcgaagggtcggtaggggaataacgttaacgttaagtttaggttaaggttggttttaggggaccgggtaaggggaccctagggtcctacggtaacccggtccgtaagggtccgaacggtaccccgaaagggtcccttaccgggtacccccccgttcgggttacccgtaacccgttcccgttaccggtttacccccccgtccccgttcccgtaacccg

SEQ ID NO: 166303 - DNA, 527 bp, Homo sapiens
  misc_feature: GYAE6OF01DSQ7M.26.71.G05.1.454.CMB.1.raw
  modified_base (234)..(234): a, c, t, g, unknown or other
  misc_feature (234)..(234): n is a, c, g, or t
  modified_base (340)..(340): a, c, t, g, unknown or other
  misc_feature (340)..(340): n is a, c, g, or t
  modified_base (396)..(396): a, c, t, g, unknown or other
  misc_feature (396)..(396): n is a, c, g, or t
  modified_base (404)..(404): a, c, t, g, unknown or other
  misc_feature (404)..(404): n is a, c, g, or t
  modified_base (492)..(492): a, c, t, g, unknown or other
  misc_feature (492)..(492): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctattttggtcatcttccaagataagaagcggcccctcagggactcccctgaccgtaatttcgnggctaccaactctagggaacacagccactctgaccatcagccgggccagccaaggntgaggganactactattgcgaggcgtggagaatactagttgtagttgttggcggagggaccaggctcgaccgtcgtaggcgacgacccgaggtccncgccccctcggtcactctcgttccccgccctcccg

SEQ ID NO: 166304 - DNA, 528 bp, Homo sapiens
  misc_feature: GYAE6OF01EDHNZ.26.71.G05.1.454.CMB.1.raw
  modified_base (522)..(522): a, c, t, g, unknown or other
  misc_feature (522)..(522): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctatttggtcatcttccaagataagaagcggccctcagggatccctgaccgtaatttctggctccaactctagggaacacacgccactctgaccatcagccggggcccagccaacggatggagggagactactagttgtcgaggcgtgggagaatacgtattggtagttgttggcgggaggacgaggctggaccgtccgtaggtcgacgcccaaggcctcgccccctcggtccactctcgtccccncctccg

SEQ ID NO: 166305 - DNA, 544 bp, Homo sapiens
  misc_feature: GYAE6OF01C15KV.26.71.G05.1.454.CMB.1.raw
  modified_base (307)..(307): a, c, t, g, unknown or other
  misc_feature (307)..(307): n is a, c, g, or t
  modified_base (536)..(536): a, c, t, g, unknown or other
  misc_feature (536)..(536): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagagccaggccagtcccctatttgtcatcttccaagataagaagcggccctnagggatccctgaccgtaatttctggcctaccaactcgtagggaacacagcccactctgaccatcacgccgggcccagccgaacggatagagggaacgactactagttgtcgaggcgtagggagaagtacgtattaggtagttgtttgggcggtagggaccaggcgtcggtaaccgtccgtaggtcacggcccaaggcctcgcccccgtcggtccactcctccgtccccncccgtccc

SEQ ID NO: 166306 - DNA, 554 bp, Homo sapiens
  misc_feature: GYAE6OF01A3OL9.26.71.G05.1.454.CMB.1.raw
  modified_base (340)..(340): a, c, t, g, unknown or other
  misc_feature (340)..(340): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggtcatcttccaagataagaagcggccctcgacgggatccctgaccgtaatttcnggcctccaactctggaacacagccactctgaccatcacggccggggccccaggacccaacggatggaagggagaactaactagttcgtcgagggtcggtagggagtaagtacgtatttgtagttggtttcggcgggagggaccgaggccgtggacccgtcgtacggtcacggcccgaaggcctcgcccccgtcggtccacctcgtcgtcccccg

SEQ ID NO: 166307 - DNA, 677 bp, Homo sapiens
  misc_feature: GYAE6OF01A2782.26.71.G05.1.454.CMB.1.raw
  modified_base (338)..(338): a, c, t, g, unknown or other
  misc_feature (338)..(338): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagacggccaggccagtcccctatttggtcatcttccaagataagaagcggccctcagggactcccgtgaccgtaatttcnggctccaactcgtcgggaacacgagacccactctacgaccatcgacggccggggaccccacggacccgaacgggacgtagggaagggacgtaaccgttaaccgttagttggtaccgacgggacggtaggggaagtaaacgttaacgtagtttaggttaggttacgggttttacggggtacgggtaacgggtaaccggacgggtaccgtcgggtaaccccggttaccgtaacgggttaccgaacgggtcccccgaaagggtccccgtacccgggtcccccccgttaccgggtacccgtaaccgttccccgttccggttcccccctcccccgtttaccccg

SEQ ID NO: 166308 - DNA, 698 bp, Homo sapiens
  misc_feature: GYAE6OF01DZKE2.26.71.G05.1.454.CMB.1.raw
  modified_base (178)..(178): a, c, t, g, unknown or other
  misc_feature (178)..(178): n is a, c, g, or t
  modified_base (241)..(241): a, c, t, g, unknown or other
  misc_feature (241)..(241): n is a, c, g, or t
  modified_base (380)..(380): a, c, t, g, unknown or other
  misc_feature (380)..(380): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccaccctnagtcgtccgtcgtccccaggacagacacgccaccatccacctgctcggcagacaagttggganatagaatgctgcctgtatacgagacgccagcctagtccccttagtttcggtcacttcttaccaagtataaaggacgccgaccctacgacgggacctcccgtacgaacctaatttcgcggcctaccaactcgtaggaacncacgtccactctacgacctataccgacggccgggaccccaaggaccccgaacggtagtaacgggaacggtacgtaaccgttaaccgttagttaccggacgtacgggtacgggtagggaacgttaaacgttaacgtttaggtttacgggttaagggtttcgggtttacggggaaccggggtacgggtaaccgtacgggtaccggttccgggaacccgtttccgggtaacggtacccgaaccggtaccccgaacgggtccctacccgggtccccccgttacgggacccttacccggttcccgttccccggttaccccccg

SEQ ID NO: 166309 - DNA, 711 bp, Homo sapiens
  misc_feature: GYAE6OF01CQD7D.26.71.G05.1.454.CMB.1.raw
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggagtccgtcggccgttcgtatgagctgtattcacgccaccctccagtgtccgtcgtcccacggacagacacgccaccactcacctcgctcggcagaacaaattagggaggatagaaagtgctgccgtggtattaaccagaggccacggccacgtcccctattttggtcatcttccaagaataagaagcggccctacgaggtactccctacgaccgtaactttcgtcggacctaccaacgtcgtacgggaaacaccaacggcctaactcgtcgaacccaacgtcgacgggccggggccccaacgacccgaaacgggaagtcggaaacggggacgtaaccttactaacgtttggttaccgacggggacggtttaaggggagtaaaaccgtttaaggtttagtttcgggttaaagggttcgggttttcgggggacgggaaacggggtacccagggtacgtaccgggtacccgttaccgggtaggtacccgaacggaccccgaaacgggtcccgcccggtacccccggttacccgtacgacccgtttacttccccgggtccccttcccccgtacccg

SEQ ID NO: 166310 - DNA, 532 bp, Homo sapiens
  misc_feature: GYAE6OF01AGEQ0.26.71.G05.1.454.CMB.1.raw
  modified_base (332)..(332): a, c, t, g, unknown or other
  misc_feature (332)..(332): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaatgggagatagaatgctgcctggtattaccagaggccaggccagtcccctattttggtcatcttccaagataagaagcggccctcagggatccctgaccgaatttcnggctccaactctggaacacagccatctgaccatcagccgggcccagccaacggatgagggagactactattgcaggcgtggagatactagttagtagtgttggcggaggaccaggctggaccgtccgtaggtccgaggccccgaaggcctccggccccccgttcggtccaccgtcctccggttccccgtcccttaccccg

SEQ ID NO: 166311 - DNA, 523 bp, Homo sapiens
  misc_feature: GYAE6OF01B9GLB.26.71.G05.1.454.CMB.1.raw
tcagagactatactcacgaccggtgctcgatttagtgtcgtcgcaagagagaggggtccatgccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctatttggtcatcttccaagataagaagcggccctcagggatccctgaccgaatttctggctccaactctggaacacagccactctgaccatcaggccggggacccagaccaacggatggagggagactactatgtcgaggcgtgggagaatactagttgtagtgttggcggaggacgaggcgtgaccgtcgtacggtcagccaaggcctcgcccctcgccactctcgttcccaccctccctcacgtactacgtctcgtgcgtccggtgtacggg

SEQ ID NO: 166312 - DNA, 543 bp, Homo sapiens
  misc_feature: GYAE6OF01CYUN4.26.71.G05.1.454.CMB.1.raw
  modified_base (357)..(357): a, c, t, g, unknown or other
  misc_feature (357)..(357): n is a, c, g, or t
  modified_base (396)..(396): a, c, t, g, unknown or other
  misc_feature (396)..(396): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccaccctcagtgtccgtgtccccaggacagacagccaccatcacctgctcggcagacaaattgggagatagaaatgctgcctggtattaccagaggccaggccagtcccctatttggtcatcttccaagataagaagcggccctcagggactccctgaccgtaatttctggctccaactctggaacncagccactctgaccatcacgccgggcccagcccaacggntggaggagactactagttgtcaggcgtgggagaatactagttgtagttgtttgggcggtagggaccgaggcgtacggaccgtccgtaggtcacggccccgaagggcctccggtcccccctcggtccacctccgttcgttaccccccg

SEQ ID NO: 166313 - DNA, 558 bp, Homo sapiens
  misc_feature: GYAE6OF01DMTQY.26.71.G05.1.454.CMB.1.raw
  modified_base (230)..(230): a, c, t, g, unknown or other
  misc_feature (230)..(230): n is a, c, g, or t
  modified_base (286)..(286): a, c, t, g, unknown or other
  misc_feature (286)..(286): n is a, c, g, or t
  modified_base (311)..(311): a, c, t, g, unknown or other
  misc_feature (311)..(311): n is a, c, g, or t
  modified_base (323)..(323): a, c, t, g, unknown or other
  misc_feature (323)..(323): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccacatcacctgctcggcagacaaattggganatagaaatgctgcctggtataccagaggccaggccagtccctatttgcatctcaanataagaagcgcctcgagggactccngacgaatttcgnggctaccaaatcgtagggaacacgacgccctaactctacgacctatcacggccgggacccacgaccgaacggatacggaaggagaactacgtattgtcgaggtcgtagggaagaatacgtagttagtagtgttaggacgggtaggacgaggctcggaccgtccgtaggccgacggacccgaacggcctaccgccccctacggtccaccgttccgtcgttccccggcccttacccg

SEQ ID NO: 166314 - DNA, 516 bp, Homo sapiens
  misc_feature: GYAE6OF01BALCI.26.71.G05.1.454.CMB.1.raw
  modified_base (309)..(309): a, c, t, g, unknown or other
  misc_feature (309)..(309): n is a, c, g, or t
  modified_base (415)..(415): a, c, t, g, unknown or other
  misc_feature (415)..(415): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctatttggtcatcttccaagataagaagcggccctnagggatccctgaccgaattctggctccaactctgggaacacagccactctgaccatcagcgggcccagccaacggatgaggagactactagtgtcaggcgtggganaatactattgtagtgtttggcggaggaccaggctggaccgtccgtaggtcgacgcccaaggcctcgccccctcggtccactcctcgttccccgccctcccg

SEQ ID NO: 166315 - DNA, 511 bp, Homo sapiens
  misc_feature: GYAE6OF01DKI3B.26.71.G05.1.454.CMB.1.raw
  modified_base (177)..(177): a, c, t, g, unknown or other
  misc_feature (177)..(177): n is a, c, g, or t
  modified_base (236)..(236): a, c, t, g, unknown or other
  misc_feature (236)..(236): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctnagtgtccgtgtccccaggacagacagccaccatcacctgctcggcagacaaattggganatagaaatgctgcctggtataccagaggccagccagtcccctatttggtcatcttaccaagataagaagcggccctcagggatccctgaccgaatttcgtggctccaactctggaacacagccactctgaccatcagcgggccagccaagatgaggagactactatgtcaggcgtaggagaatactattgtagttgttggcgggtagggacgaggctgacccgtcgtaggtcaggtccccaaggcctcgccccctcgtccactcctcgtcccccg

SEQ ID NO: 166316 - DNA, 562 bp, Homo sapiens
  misc_feature: GYAE6OF01C7GAH.26.71.G05.1.454.CMB.1.raw
  modified_base (355)..(355): a, c, t, g, unknown or other
  misc_feature (355)..(355): n is a, c, g, or t
tcagagactatactcacgaccggtgctcgatttagtgtcgtcgcaagagagagggggggcctcaggaagcagcatcggaggtgcctcagccatggcatggatccctctcttccctcggcgtccttgcttactgcacaggatccgtggccttcgatgagctgattcagccaccctcagtgtccgtgtcccccaggacagacagccaccatcacctgctcggcagacaaattgggagatagaaatgctgcctggtattaccagaggccaggccagtccccctatttggtcatcttccaagataagaagcgccctcgagggatccctgaccgaatttctggctccaactcgtggaacncagccactctgaccatcgacgccgggcccacgccaacggatggaagggagacctactagttcgtacgaggcggtagggagaagtactagttagtagttggtttggcgggagggaccagggcctcggaccgtcgtaggcgacggcccgaagggcctaccggcccccgttaccggtccacgttccctccgttcccccgaccccgtaccg

SEQ ID NO: 166317 - DNA, 535 bp, Homo sapiens
  misc_feature: GYAE6OF01APJAU.26.71.G05.1.454.CMB.1.raw
  modified_base (238)..(238): a, c, t, g, unknown or other
  misc_feature (238)..(238): n is a, c, g, or t
  modified_base (470)..(470): a, c, t, g, unknown or other
  misc_feature (470)..(470): n is a, c, g, or t
tcagagactatactcacgaccggtgctcgatttagtgtcgtcgcaagagagaggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctccggagatgcattgaccaaaaaaatntgcttatggtaccagcagaagtcaggccaggcccctgtgctggtcatctacgaggacagcagaccgaccctccgggatccccgtagacgagacttctcgttaggccctccgagttccgagggacaagtcggaccctaccttgactgtcaggtcgggcccgaggtggagagtgaagctgactacttactgttactacaacgagacagttagtgtatcgagttgggtgttcggnggtacggaccaagcgtcgaccgtccgtggccacgtcccgaaggccgtccgcccccgtggtacccg

SEQ ID NO: 166318 - DNA, 536 bp, Homo sapiens
  misc_feature: GYAE6OF01B4M46.26.71.G05.1.454.CMB.1.raw
  modified_base (233)..(233): a, c, t, g, unknown or other
  misc_feature (233)..(233): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtccccctattttggtcatcttccaagataagaagcggccctcagggatccctgaccgaatttctggctccaactctagggaacacagccactctgaccatcagcgggcccagccaacggataggagggagactactattgtcaggcgtagggagaatactagttgtagtgttggcggagggaccgaggcgtcggaccgtccgtaggtcgacgacccaaggtcctcggcccccctcggtccacctctcgttccccgcccgttcccg

SEQ ID NO: 166319 - DNA, 518 bp, Homo sapiens
  misc_feature: GYAE6OF01DLJRT.26.71.G05.1.454.CMB.1.raw
  modified_base (381)..(381): a, c, t, g, unknown or other
  misc_feature (381)..(381): n is a, c, g, or t
tcagagactatactcacgaccggtgctcgatttagtgtcgtcgcaagagagaggggggactcctgtgccccaccatggacacgctttgctccacgctcctgctgctgaccatcccttcatgggtcttgtcccagatcaccttgaaggagtctggtcctgcgctggtggagcccacgcagaccctcacgctgacctgctccgtctctggattctcactcaccacgactgaggtgaatgtggcctgggtccgtcaggcccccggaaaggccctggagtggcttgcactcatttactggagtgatctcaagcggtacaatccgtctctgagatcgactcaccatcaccaggacacctcaaagccggtgtcctacaatgaccganatgaatccctgtgacacgaggcacatattactgtgcacacagtcctagcgctacgcgagaaagatatgatagttggggacctaggggtattttcgggcctacccggtcctaccccagccctccgacccgaacccggg

SEQ ID NO: 166320 - DNA, 532 bp, Homo sapiens
  misc_feature: GYAE6OF01CHJGF.26.71.G05.1.454.CMB.1.raw
  modified_base (296)..(296): a, c, t, g, unknown or other
  misc_feature (296)..(296): n is a, c, g, or t
  modified_base (384)..(384): a, c, t, g, unknown or other
  misc_feature (384)..(384): n is a, c, g, or t
  modified_base (408)..(408): a, c, t, g, unknown or other
  misc_feature (408)..(408): n is a, c, g, or t
  modified_base (419)..(419): a, c, t, g, unknown or other
  misc_feature (419)..(419): n is a, c, g, or t
  modified_base (427)..(427): a, c, t, g, unknown or other
  misc_feature (427)..(427): n is a, c, g, or t
  modified_base (457)..(457): a, c, t, g, unknown or other
  misc_feature (457)..(457): n is a, c, g, or t
  modified_base (512)..(512): a, c, t, g, unknown or other
  misc_feature (512)..(512): n is a, c, g, or t
tcagagactatactcacgaccggtgctcgatttagtgtcgtcgcaagagagaggggggactcctgtgccccaccatggacacgctttgctccacgctcctgctgctgaccatcccttcatgggtcttgtcccagatcaccttgaaggagtctggtcctgcgctggtggagcccacgcagaccctcacgctgacctgctccgtctctggattctcactcaccacgactgaggtgaatgtggcctgggtccgtcacggcccccggaaaggccctggagtggcttgcactcatttacgnggagtgatctcaagcgtacaatccgtctctgagatcgactcaccatccacaggacacctccaaagccggtgtcctacaatcgaccganatcgaatcctagtgacacgagcanatatactgtanccacaacngtaccgagcgactacgacgagaaaagatanagaacttagttcgggacctaagggttattttcggactacccgttccaccccgtanccctccgaccgtaacccggg

SEQ ID NO: 166321 - DNA, 626 bp, Homo sapiens
  misc_feature: GYAE6OF01B2GNP.26.71.G05.1.454.CMB.1.raw
  modified_base (237)..(237): a, c, t, g, unknown or other
  misc_feature (237)..(237): n is a, c, g, or t
  modified_base (363)..(363): a, c, t, g, unknown or other
  misc_feature (363)..(363): n is a, c, g, or t
tcagagactatactcacgaccggtgctcgatttagtgtcgtcgcaagagagaggggctgggcctcaggaagcagcatcggaggtgcctcagccatggcatggatccctctcttcctcggcgtccttgcttactgcacaggatccgtggccttcgatgagctgattcagcccaccctcagtgtcccgtgtccccaggacagacagccacatcacctgctcggcagtacaaagtggganatagaaatgctgctgtatacagagcaggccagtcccctatttgcatctcaagataagaagcgcctgagggactcctgaccgtaatttcgtggctaccaactctaggaacacagccactctagaccngtacgacggccgggggacccacgacccgtaaacggactagggaacggggaactacgttaacttaggttcgtaccgagggtacggttagggaaggtaactaacgttagtttagggttaagttggggtttacgggacgggaacgggaccgttagggaccgttacgacccgttaccgtacgggtaccgaacggtacccccgaagggtccccgtttacccggccccccgttacggtaccctacttccccgttcccggttaccccccc

SEQ ID NO: 166322 - DNA, 694 bp, Homo sapiens
  misc_feature: GYAE6OF01B9FGH.26.71.G05.1.454.CMB.1.raw
  modified_base (237)..(237): a, c, t, g, unknown or other
  misc_feature (237)..(237): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtcgtccccaggacagacagccacatccacctgctcggcagacaaagtggganatagaatgctgcctggtattaccagacggccaggccacgttccccttagttttcggtctacgttccttaccaaagtataaggaacgcggaccctacgacgggtactcccgtacgaaccgtaatttccgtggtacctacccaactcgtacgggaaccacgacgcctacgtctacgaccctagtccgacgggcccggggacccaacggacccgaaacgggacgtacgggaacgggacgaaccgttaacgttattacggtacgaacgggcgggtaggggtaacgtaaagttacgttaagtttgggtaaggtttagggtttacgggaccggggtacgggaacccgtaggggtccgtacggtaacccggttcccggtaacggtaccgaccggtaccccgaaggtcccgtcccgtaccccccgttacgggtaccctaccgttcccgttacccggttccccccg

SEQ ID NO: 166323 - DNA, 753 bp, Homo sapiens
  misc_feature: GYAE6OF01DNK4F.26.71.G05.1.454.CMB.1.raw
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtcgtccgtgtccccaggacagacagccaccatcacctgctcggcagacaaattgggagatagaatgctgcctggtattaccagacggcaggccagtcccctatttggcatcttaccaagataagaagcggccctcacgggactccctagacccgtaatttcgtggcctccaactcgtacgggaaccacgacgccaactcctacgaccactccgaacggccgggggaccccaacggaccccgtaaacgggaacgtacgggaacgggggaacgtaaccttaaccgttacgtttacggtaccggtaaggggtacccgggtagggggaacgtaaaacgtttaaccggttaagttttacgggttaagggtttcggggtttttaacgggggaccgggggtaacggggacccggtaacgggttaccggttaccgggtaaccccgggttaccccggttaaacgggggttacccgaaccgggtaccccccggtaaaacggggtccccgttaccccgggtccccccccggtttacccgggttcccggttaaccccgttcccgtttccccggtttaccccccccg

SEQ ID NO: 166324 - DNA, 526 bp, Homo sapiens
  misc_feature: GYAE6OF01AZCP1.26.71.G05.1.454.CMB.1.raw
  modified_base (426)..(426): a, c, t, g, unknown or other
  misc_feature (426)..(426): n is a, c, g, or t
  modified_base (518)..(518): a, c, t, g, unknown or other
  misc_feature (518)..(518): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtccccctatttggtcatcttccaagataagaagcggccctcagggatccctgaccgaatttctggctccaactctgggaacacagccactctgaccatcagccgggcccagcccaaacggataggagggagaactactattgtcaggcgtggganaatactattgtagttgttggcggagggaccaggctgaccgtcgtaggtcgagcccgaaggcctcgcccccgtggtccacgtcctcgttcccnccctcccg

SEQ ID NO: 166325 - DNA, 787 bp, Homo sapiens
  misc_feature: GYAE6OF01E1TZG.26.71.G05.1.454.CMB.1.raw
  modified_base (240)..(240): a, c, t, g, unknown or other
  misc_feature (240)..(240): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccggtggccttcgatgagctgacttcacgcccaccctcagtcgtccgtcgtcccaggacagacacgccaccatccacctgctcggacagaactaagtggganataagaatgctcgccgtaggtactaccgagacggccgacggccctacgttacccctttagtttcggtactaaccgttacctaacgaaagtaacggaacggaccggcccgtaccgtaacccggggtagtacccccgacgtttacccggaacggtttacctttccggaaccgttccctaaaccggtaaccctacggggtaaacgtaacccaacgtacccgaccgtaccctagtacccgaacgtacccgggaccggaccgttaccccggggaaacccggaaccggtaacccgggaaacggggtaacggtaacgggtaacgggtaacggttaacgtaacgttacggttacggtacgggaacgggtacgggtagggtaagttaagttaacgttaggtttaggtacgggtttaggggttacgggacggggacggtacggacggtccgtacggtacccgtaccggtaccggtacggaccgtaccgacccggtccgtcccgtaccccgttccggtaccgtacccgttcccgttcccgttccccgtcccgttaccg

SEQ ID NO: 166326 - DNA, 525 bp, Homo sapiens
  misc_feature: GYAE6OF01A8KQN.26.71.G05.1.454.CMB.1.raw
  modified_base (316)..(316): a, c, t, g, unknown or other
  misc_feature (316)..(316): n is a, c, g, or t
  modified_base (339)..(339): a, c, t, g, unknown or other
  misc_feature (339)..(339): n is a, c, g, or t
  modified_base (513)..(513): a, c, t, g, unknown or other
  misc_feature (513)..(513): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtcccgtgtcccccaggacagacagccaccatcacctgctcggcagacaaattgggagatagaaatgctgcttggtattaccagaggccaggccagtcccctatttggtcatcttccaagataagaagcggccctnacgggatccctgaccgaatttcnggctccaactctaggaacacagccactctgaccatcagccgggcccaggcccaacggataggagggagactactattgtcgaggcgtgggagaatacgtattggtaagttgtttggcggagggaccaggctcggaccgtccgtaggtcaggcccgaagcctcgcccctcggccnctctcgtacccc

SEQ ID NO: 166327 - DNA, 516 bp, Homo sapiens
  misc_feature: GYAE6OF01A69XH.26.71.G05.1.454.CMB.1.raw
  modified_base (333)..(333): a, c, t, g, unknown or other
  misc_feature (333)..(333): n is a, c, g, or t
  modified_base (415)..(415): a, c, t, g, unknown or other
  misc_feature (415)..(415): n is a, c, g, or t
  modified_base (509)..(509): a, c, t, g, unknown or other
  misc_feature (509)..(509): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggtcatcttccaagataagaagcggccctcagggactccctgaccgaatttcnggctcaactctggaacacagccactctgaccatcagcgggcccagccaacggatgaggagactactattgcaggcgtggganaatacgtattgtaggttgttggacggagggaccgaggctgaccgtcctaggtcgacgcccgaaggctcgccccctggtccactcctcgttcccnccctccc

SEQ ID NO: 166328 - DNA, 643 bp, Homo sapiens
  misc_feature: GYAE6OF01DEKA3.26.71.G05.1.454.CMB.1.raw
  modified_base (235)..(235): a, c, t, g, unknown or other
  misc_feature (235)..(235): n is a, c, g, or t
  modified_base (344)..(344): a, c, t, g, unknown or other
  misc_feature (344)..(344): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaagtgganataagaatgctgcctggtataccagacggccaggccagtccccttatttcggtctatcttaccaagataagaacgcggcctgacgggactcccgtagaccgtaatttcnggcctccaactcgtagggaaccacgacgccactcgtacgacccataccgacgggtccggggaccccagggaccccgaaacgggtacgtacgggaacgggaacgtaactaaccgttagttcggtacgagggtcggtagggaagtaattacgttagtttagggtagttgggtttgggacgggtacgggaccgagggtccgtacgggtacccgttaccggtagggtaccgacggtaccccgaagggtcccctaccgggtcccccgttcgggtaccctaccgttccgttcccgttaccccccg

SEQ ID NO: 166329 - DNA, 543 bp, Homo sapiens
  misc_feature: GYAE6OF01ARM74.26.71.G05.1.454.CMB.1.raw
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtcccccaggacagacagccaccatcacctgctcggcagacaaattgggagatagaaatgctgcctggtattaccagaggccaggccagtccccctattttggtcatctccaagataagagcggccctcagggatcctgaccgaattctggcctccaactctgggaacacacgccactctgaccatccagccggggcccacgccaacggatcggagggagactactagttgtcgaggcgtagggagaatactattgtagtgtttgggcggtagggaccaggcgtgactagtccgtaggtccacggacccgacggcctcgaccccccgtcggtacccacctcgtccgttccccgtcccccg

SEQ ID NO: 166330 - DNA, 692 bp, Homo sapiens
  misc_feature: GYAE6OF01DOJWO.26.71.G05.1.454.CMB.1.raw
  modified_base (231)..(231): a, c, t, g, unknown or other
  misc_feature (231)..(231): n is a, c, g, or t
  modified_base (308)..(308): a, c, t, g, unknown or other
  misc_feature (308)..(308): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccacatcacctgctcggcagacaaagttggganatagaaatgctgcctggtataccagagccaggcagtcccctatttggtcatcttccaagataagagcgcctcagggntccctgaccgaatttcgaggcctaccaactcgtagggaacacgacgcccgactctagacccatacaggccgggccccaagacccgaaacggagtacggaacggggaagtaaccgtacgtagtttacgtacgagggtaccggtaggggaagtaaagttaacgttaagtttcggttaaggtttgggtttttacggggaccggggtaagggggtaacccgtacggggtaccgttaccgggtaaccccgggttcccgtaacggggttacccgaaccgggtacccccgtaaacggggtcccgttacccgggtccccccccgttaccgggttccccgtaaacccgtttcccgttaccccggtttccccccgtaccccccgtttacccccg

SEQ ID NO: 166331 - DNA, 538 bp, Homo sapiens
  misc_feature: GYAE6OF01D86F5.26.71.G05.1.454.CMB.1.raw
  modified_base (309)..(309): a, c, t, g, unknown or other
  misc_feature (309)..(309): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctatttggtcatctccaagataagagcgccctnagggatccctgaccgaatttctggctccaactctggaacacagccactctgaccatcagcgggcccacgccaacggatggacgggagacgtactagttgtcgaggcgtggagatacgtattagtagtgtttggacggtacgggacgaggccgtggaccgtccgtaggtccgacgacccgaggcctccggcccccgtcggtccaccttcgtccgttccccgcccgtcccg

SEQ ID NO: 166332 - DNA, 510 bp, Homo sapiens
  misc_feature: GYAE6OF01DOQQ4.26.71.G05.1.454.CMB.1.raw
  modified_base (305)..(305): a, c, t, g, unknown or other
  misc_feature (305)..(305): n is a, c, g, or t
  modified_base (310)..(310): a, c, t, g, unknown or other
  misc_feature (310)..(310): n is a, c, g, or t
  modified_base (326)..(326): a, c, t, g, unknown or other
  misc_feature (326)..(326): n is a, c, g, or t
  modified_base (421)..(421): a, c, t, g, unknown or other
  misc_feature (421)..(421): n is a, c, g, or t
  modified_base (504)..(504): a, c, t, g, unknown or other
  misc_feature (504)..(504): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagagccaggccagtcccctatttggtcatcttccaagatagaagcgcctnagggntcctgaccgaatttcnggctccaactctagggaacacacgccactctagaccatcaggccgggcccaagccaaacggatggagggagactactagttgcgaggcggtgganaatactattgtagtgttggcggaggacgaggctgaccgtcgtaggtcgacgcccaggcctcgccccctcgtcactctctcccnccctcc

SEQ ID NO: 166333 - DNA, 562 bp, Homo sapiens
  misc_feature: GYAE6OF01DOFHY.26.71.G05.1.454.CMB.1.raw
  modified_base (552)..(552): a, c, t, g, unknown or other
  misc_feature (552)..(552): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaagttggagatagaaatgctgcctggtattaccagaggccaggccagtcccctatttggtcatctcaagataagaagcgcctcgagggtactcctgaccgtaatttctggcctaccaactcgtaggaacacgagcccactctcgaccagtcacggcgggacccacgaccgaacgggagtagagggactacgtacgtagttcgtcgaggtcggtaggagtaatactagttagtagttaggttggacggtaggacgtggactcggtaccgtccgtaggtcgacgacccgaacggccgtaccgcccccgtcggtccacctcgtccgttccccncccgttcccg

SEQ ID NO: 166334 - DNA, 719 bp, Homo sapiens
  misc_feature: GYAE6OF01CA98P.26.71.G05.1.454.CMB.1.raw
  modified_base (234)..(234): a, c, t, g, unknown or other
  misc_feature (234)..(234): n is a, c, g, or t
  modified_base (338)..(338): a, c, t, g, unknown or other
  misc_feature (338)..(338): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaatgctgcctggtattaccgagaggccaggccagtcccctattttggcatcttaccaagataagaagcggccctcgaggactccgtagaccgtaatttcncggctaccaactcgtaggaacacacgccactctacgaccatcgacggccggggacccaacgacccgaaacgggagtacgggaacggggaacgtaccgttaacgttaacgttcggtacgtacggggtaccgggtaaggggtaacgtaaacgttaacgttaagtttagggttaacgggtttggggttttacggggaccggggtaacggggtacccggtacgggtaccggttaccggtaacccggttcccggttaacggggtacccgaaccgggtacccccggaaacggggtccccgttacccgggtaccccccccgtttacgggttacccctacccggttaccccgtttaccccggtttccccccgtaaccccgttacccccg

SEQ ID NO: 166335 - DNA, 683 bp, Homo sapiens
  misc_feature: GYAE6OF01BTNRT.26.71.G05.1.454.CMB.1.raw
  modified_base (231)..(231): a, c, t, g, unknown or other
  misc_feature (231)..(231): n is a, c, g, or t
  modified_base (338)..(338): a, c, t, g, unknown or other
  misc_feature (338)..(338): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccacgtcccctattttggctatcttaccaagataagaacgcggccctcgagggactccctgaccgtaatttcnggacctccaactcgtaggaacacacgcccactctacgaccagtcgacggccggggaccccacggaccccgaaacgggacgtagggaacggggtaacgtaaccgttacgtttaacgtttttaccggaagggtacggttacggggaataaacgttaccgttaagtttaggttaacggttagggtttcgggacggggtaacggggtaccgagggtaccgtacggtaacccggttccgtacgggtaccgtacggaccccgtaagggcccgttcccggccccccgttacgggtcccttaacccgttcccgttacccggtttacccccctaccccgttccccgttaacccg

SEQ ID NO: 166336 - DNA, 626 bp, Homo sapiens
  misc_feature: GYAE6OF01DHYJ8.26.71.G05.1.454.CMB.1.raw
  modified_base (332)..(332): a, c, t, g, unknown or other
  misc_feature (332)..(332): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccacctcagtgtccgtgtccccaggacagacagtcaccatcacctgctcggcagacaaatgggagatagaatgctgcctggtataccagaggccaggccagtcccctatttggcatctccaagataagaagcggaccctcagggactcctgaccgtaatttcnggcctaccaactcgtagggaacacgacgccactctacgaccatccgacggccggggcccaacggacccaaacgggagtaggacgggagtactaacgttagttcgtacgagggcgtagggaagtaaattacgttaagtttgtaaggttggtttagggcgggtagggacccgtaagggccgtacggtacccggtaccgttaacgggtccgaaccggaccccgtaaacgggtcccttacccgggtcccccccgttacgggtccctaacccggttcccgtttccggttacccccccgg

SEQ ID NO: 166337 - DNA, 576 bp, Homo sapiens
  misc_feature: GYAE6OF01DACOX.26.71.G05.1.454.CMB.1.raw
  modified_base (231)..(231): a, c, t, g, unknown or other
  misc_feature (231)..(231): n is a, c, g, or t
  modified_base (312)..(312): a, c, t, g, unknown or other
  misc_feature (312)..(312): n is a, c, g, or t
  modified_base (329)..(329): a, c, t, g, unknown or other
  misc_feature (329)..(329): n is a, c, g, or t
  modified_base (564)..(564): a, c, t, g, unknown or other
  misc_feature (564)..(564): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtccccttatttggtcatcttccaagataagagcgcctcagggntccctgaccgaatttcnggctaccaactcgtaggaacacacgccactctgaccatcgaggccgggcccagccaacgggatggaaggacgactacgtattggtcgaggtcgtgggagtaagtacgtagttaggtagttggttgggacgggtagggaccgtagggcctacggtaccgtccgtagggtccgacggtaccccgaagggtccctaccggcccccgttcggtcctaccgttcccgttccgttcccccnccccgttacccg

SEQ ID NO: 166338 - DNA, 583 bp, Homo sapiens
  misc_feature: GYAE6OF01C5XJH.26.71.G05.1.454.CMB.1.raw
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaagttgggagatagaaatgctgcctggtattaccagaggccaggccagtccccctattttggtcatcttccaagataagaagcggccctcgagggactcccgtgaccgtaatttcgtcggctacccaactctagggaacacacgccactctgaccatcgacgccggggcccaagccccgaaagggatcggaagggacgacgtactagttgtcgaggtcggtagggaagtaatacgttattaggtaggttgtttgggcgggtagggaccgagggtctcggtaccgtccggtaggtccgaacggacccgaaggcctaccgcccccgtggtcccaccttccgtcgttcccccgtcccttccccg

SEQ ID NO: 166339 - DNA, 520 bp, Homo sapiens
  misc_feature: GYAE6OF01A2WCX.26.71.G05.1.454.CMB.1.raw
  modified_base (405)..(405): a, c, t, g, unknown or other
  misc_feature (405)..(405): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggcatcttccaagactaagaagcggccctcagggactccctgaccgtaatttctggctccaactctgggaacacagccactctgaccatcacgccgggcccagcccaacggatggagganactactattgtcaggcgtgggagaatactagtagtagtgttggcggtagggaccaggctcggacgtccgtaggcacgcccaaggcctcgccccctcgtccactcgtcgtcccccg

SEQ ID NO: 166340 - DNA, 668 bp, Homo sapiens
  misc_feature: GYAE6OF01D3OXU.26.71.G05.1.454.CMB.1.raw
  modified_base (231)..(231): a, c, t, g, unknown or other
  misc_feature (231)..(231): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagcccaccctcagtcgtccgtcgtccccaggacagacagccaccatcacctgctcggcagacaatgganatagaatgctgcctgtataccgagagaccaggcctacgtccccttatttcggctattcttaccaagtataagaacggccgccctacgaggctacccgtagaccgtaatttcgcgtcctaccaacgtcgtacgggaaccacgacgccacttcacgaccagtccgaacggtcccggggacccacggacccgaaaggacgtaggaacgggataaccgttacgttagttcggtcgtaacgggtcggtaagggaacgtaagttaacgttagtttacggttaaggttcgggtttacggggacgggtaacgggtaccgagggtcccgtacggtacccggttccgtaaggttcccgaaccggtacccgacggtccctaccccgggtccccgttaaccggtcccttaacccgttcccgtttcccggttcccccgtccccttacccg

SEQ ID NO: 166341 - DNA, 597 bp, Homo sapiens
  misc_feature: GYAE6OF01BVTQ7.26.71.G05.1.454.CMB.1.raw
  modified_base (234)..(234): a, c, t, g, unknown or other
  misc_feature (234)..(234): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccacatcacctgctcggcagacaaagttggganatagaaatgctgcctggtattaccagaggccaggccagtcccctatttggcatcttccaagataagagcggcctcgaggactccctgaccgtaatttctggctaccaactcgtacgggaacacagccactctgaccatcaggccgggacccaggccaaggagtaggacgggagactactagttcgtcgaggccggtagggactaatacgtagtttaggtaagtggtttgggacgggtaggggaccgaggtcgtacgggtacccgttccgtaaggtccgtaacggcccgaaacggggtccctaccgggtccccccgttacgggtccctaccgttcccttccgttacccccgcccctttaccccg

SEQ ID NO: 166342 - DNA, 560 bp, Homo sapiens
  misc_feature: GYAE6OF01AKXX6.26.71.G05.1.454.CMB.1.raw
  modified_base (234)..(234): a, c, t, g, unknown or other
  misc_feature (234)..(234): n is a, c, g, or t
  modified_base (351)..(351): a, c, t, g, unknown or other
  misc_feature (351)..(351): n is a, c, g, or t
  modified_base (539)..(539): a, c, t, g, unknown or other
  misc_feature (539)..(539): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctatttggcatctccagataagaagcgccctcagggatccctgaccgaatttctggctccaactcgtagggaacncagccactctcgaccatcgacgcgggcccagcccgaacggagtggaagggagaactactattgcgaggccgtagggagaatactagttaggtagttggttagggcgggtagggaccgaggcgtacggaccgtcctagggtcgacggacccgaaggcccgtacggtcccccgtacggtccaccgttccnccgtttccccacccgttcccg

SEQ ID NO: 166343 - DNA, 588 bp, Homo sapiens
  misc_feature: GYAE6OF01A8LBW.26.71.G05.1.454.CMB.1.raw
  modified_base (230)..(230): a, c, t, g, unknown or other
  misc_feature (230)..(230): n is a, c, g, or t
  modified_base (430)..(430): a, c, t, g, unknown or other
  misc_feature (430)..(430): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaattggganatagaatgctgcctggtattaccagagccaggccagtcccctattttggcatcttccaagataagaacgcggccctgagggactccctgaccgtaatttctcggctccaactctcggaacacgacgccactctcgaccatcacggccgggacccagccgaacggataggaggagactactagttgacgaggcgtaggganaatactagttacgtaggttggtttgggacgggtagggaccgaggtccgtacggtacccgttccgtagggtacccgaacggtccccgaaagggcccgtaccggtccccccgttcgggtacctaccgttcccgttccggttcccccgcccctttaccccg

SEQ ID NO: 166344 - DNA, 657 bp, Homo sapiens
  misc_feature: GYAE6OF01BLKX8.26.71.G05.1.454.CMB.1.raw
  modified_base (230)..(230): a, c, t, g, unknown or other
  misc_feature (230)..(230): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaatggganatagaatgctgcctggtattaccagacggccaggccacgtccccttagttttcggtctattccttaccaagataaaggaacgccggaccctcgagggtactcccgtacgaaccgtaatttcgtggcctaccaactcgtacgggaactacgacgcccactcctacgaacctagtcgacggcccgggacccgacgacccgaacgggagtaggacgggaacgtacgtacgtagttcggtacgacgggtcggtagggaagtaattaacgttagtttaggtaggttgggtttacgggacgggtacgggaccgacgggtaccgtacggtacccgttccgtaacggtcgaccggtaccccgaacggtcccgtacccgggtccccccgtcggtaccctacccgttaccgttcccgttcccccgtccccttacccg

SEQ ID NO: 166345 - DNA, 582 bp, Homo sapiens
  misc_feature: GYAE6OF01C1Q60.26.71.G05.1.454.CMB.1.raw
  modified_base (343)..(343): a, c, t, g, unknown or other
  misc_feature (343)..(343): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccaccctcagtcgtcccgtgtccccaggacagacagccaccatcacctgctcggcagacaaagttggagatagaaatgctgcctggtataccgagaggccaggccacgtcccctatttgtcatctcaagataagaacgcggccctgacgggactcccgtgaccgtaatttcgnggtcctaccaactcgtaggaacacacgccactctacgaccatccgaggccgggccaacgacccgaacggtatggaacggagaactactagttcgagaggtcgtagggaagaactactagttagtaggttggttcgggaggacgggaccgaggcgtcggaccgttcgtacggtacacggacccgaacgggtccctcccggacccccgttcggtaccacccgttccgtccgttaccccccg

SEQ ID NO: 166346 - DNA, 552 bp, Homo sapiens
  misc_feature: GYAE6OF01D62BV.26.71.G05.1.454.CMB.1.raw
  modified_base (236)..(236): a, c, t, g, unknown or other
  misc_feature (236)..(236): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctattttggtcatcttccaagataagaagcggccctcagggatccctgaccgaatttctggctccaactctggaacacagccactctgaccatccagcggggcccagccaacggatgaagggagactactattgcgaggcgtgggagaatactagttaggtagttggtttggacgggagggtaccgaggccgtggacccggtccgtacgggtccgacggccccgaaaggccgtaccggtcccccgtcggtaccaccttccgtccgttacccccg

SEQ ID NO: 166347 - DNA, 608 bp, Homo sapiens
  misc_feature: GYAE6OF01AR9SV.26.71.G05.1.454.CMB.1.raw
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggcatcttccaagataagaagcggccctcagggatccctgaccgaatttctggctccaactctggaacacagccactctgaccatcaggccggggccccacggacccaaacgggagtcggaaggggacgaacttactagtttcgtacgagggcgtaggggaagtaagtacgttaagttgggtaagttggttttcgggacgggtacgggacccgtagggccgttacggaacccggttccgttacgggtccaacgggtccccgaaacgggtcccgttccggaccccccgttcgggtcctacccttccgttccgtttcccccccgg

SEQ ID NO: 166348 - DNA, 546 bp, Homo sapiens
  misc_feature: GYAE6OF01E0MRB.26.71.G05.1.454.CMB.1.raw
  modified_base (322)..(322): a, c, t, g, unknown or other
  misc_feature (322)..(322): n is a, c, g, or t
  modified_base (536)..(536): a, c, t, g, unknown or other
  misc_feature (536)..(536): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccccttattttggtcatcttccaagataagaagcgccctcagggactcccngaccgaatttctgctccaactctgggaacacacgccactctgaccatcaggccgggccccagacccaacggatggagggacgactacgtagttgcgaggcgtagggagaatacgtattgtagtgttggcggagggacaggctggaccgtccgtaggtccgacgcccgaaggcctaccggcccccgttcggtcctaccgttccttcgttcccccncccgttcccg

SEQ ID NO: 166349 - DNA, 757 bp, Homo sapiens
  misc_feature: GYAE6OF01B59MS.26.71.G05.1.454.CMB.1.raw
  modified_base (232)..(232): a, c, t, g, unknown or other
  misc_feature (232)..(232): n is a, c, g, or t
  modified_base (357)..(357): a, c, t, g, unknown or other
  misc_feature (357)..(357): n is a, c, g, or t
tcagagactatactcacgaccggtgctcgatttagtgtcgtcgcaagagagagggggcctcaggaagcagcatcggaggtgtctcagccatggcatggatccctctcttcctcggcgtccttgcttactgcacaggatccgtggccttcgatgagctgattcagccaccctcagtgtccgtgtccccaggacagacagccaccatcacctgctcggcagacaaagttggganatagaaatgctgcctggtattaccagacggccaggccacgtcccccttattttggtctattcttaccaaagataaggaacgccggccctagacgggtactccccgtagaacccgtaattttccgnggtcctacccaactcgtacgggaaaccacgacgccctactctacgaccatcgacggcccggggacccaacggacccgaaacgggacgtacgggaacggggaacgtaaccgttaacgttaagtttcggtacgtaacgggtacggttaggggaaagtaaacgttaacgttaagtttagggttaacggtttgggttttacgggggaccggggtacggggaacccggtacggggtaccgttaccgggtaaccccggttcccggttaaacggggtccggtaaccgggtaccccccggtaaaggggtccccgttaccccgggtaccccccccggttaccggggttacccctaacccgtttacccggtttaccccggtttaccccccctacccccgtttacccccgg

SEQ ID NO: 166350 - DNA, 572 bp, Homo sapiens
  misc_feature: GYAE6OF01AJ9KW.26.71.G05.1.454.CMB.1.raw
  modified_base (236)..(236): a, c, t, g, unknown or other
  misc_feature (236)..(236): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtccccctattttggtcatcttccaagataagaagcggccctcagggatccctgaccgaatttctggctccaactctggaacacagccactctgaccatcacgccggggacccagcccaacggatggacgggagactactattgtcacgggcgtgggagtaataacgtattacggtagttggtttaggcggtagggacccgagggcgtaggacccgtaccgtagggttccacggccccgaaacggtccctaccggtcccccccgttacgggtcccaccttcccgttcggttcccccccg

SEQ ID NO: 166351 - DNA, 620 bp, Homo sapiens
  misc_feature: GYAE6OF01CTLBQ.26.71.G05.1.454.CMB.1.raw
  modified_base (310)..(310): a, c, t, g, unknown or other
  misc_feature (310)..(310): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccacatcgactgctcggcagacaaattgggagatagaaatgctgcctggtattaccagagccaggccagtcccctatttgtcatctccaagtataagaagcggcctnagggatcctgaccgtaattctggctcaactcgtggaacacagtcccaactctagaaccatcgaacggccgggggacccaacggcccgaaaccgggaatacgggaaggggaagaaccgttaaccgtaagttggtaccgaagggtccgttaggggaacgaaagttaaccgttaagtttggttaaggttgggttttagggacggggacggggaacccgtagggtcctacgggtaccgttacccgttagggtacgacgccccgaaagggccctacggccccccgtcggtaccaccgttccgtcggttccccccg

SEQ ID NO: 166352 - DNA, 665 bp, Homo sapiens
  misc_feature: GYAE6OF01AR78R.26.71.G05.1.454.CMB.1.raw
  modified_base (233)..(233): a, c, t, g, unknown or other
  misc_feature (233)..(233): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtcccgtgtcccccaggacagacagcccacatcacctgctcggcagacaaattggganatagaatgctgcctggtattaccagaggccaggccagtcccctatttcggtcatccttccaagtataaagaacgccggtccctcgacgggactccccgtggaacccgtaatttccgtggcctacccgtaaacctcgtacgggtaaaccacgaacgcccactcctagacccatccgacggccggggaccccaacggcccgaacggatacgggaacgggaagtaacctacgttagttacgtacgtagggtacggtagggaagtaacttacgtaagtttaggtacgttgggtttgggacgggtacggtaccgagggtcctaggacccgttcgtaacgggtccaacgggccccgtaaagggcccgttcccgggcccccccgttacggtacccgtacccgttaccccgttccggttaccccctaaccccgttccccg

SEQ ID NO: 166353 - DNA, 671 bp, Homo sapiens
  misc_feature: GYAE6OF01D5HZZ.26.71.G05.1.454.CMB.1.raw
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccacatcacctgctcggcagacaaagttggagatagaaatgctgcctggtacttaccagaggccaggccagtcccctatttggtcatcttccaagataagagcggccctagagggactccctgaccgtaatttcgtggtcctaccaactcgtagggaaccacgacgccctactctacgacccatccgaacggccggggaccccacggacccgaaacgggacgtaggaacggggtaacgaccttaacgttagtttcggtacgacgggtccgggtagggaacgtaaacttacgttaagtttaggttaaggttgggtttaggggtacgggtaacggggtaccgagggtaccgttcgggtaaccccggttccgttaagggtacccgaccggtaccccgaacgggtcccgtacccggtccccccgttccgggtaccctacccgttcccgttcccgtttcccccgtaccccgttacccg

SEQ ID NO: 166354 - DNA, 538 bp, Homo sapiens
  misc_feature: GYAE6OF01CPRJJ.26.71.G05.1.454.CMB.1.raw
  modified_base (231)..(231): a, c, t, g, unknown or other
  misc_feature (231)..(231): n is a, c, g, or t
  modified_base (527)..(527): a, c, t, g, unknown or other
  misc_feature (527)..(527): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagagccaggccagtcccctatttggcatcttccaagataagagcggccctcagggctccgtgaccgtaatttctggctccaactctggaacacgagccacgtctgacatcagccgggccagccaacggatcggaggacgactactattgtcgaggcgtggagaatactagtgtagtgtttggacggtagggaccgaggtcgtaggacccgtcgtacggcgtacgaccccgaagggcctcggcccccctcggtccaccttcctccgttccccncccgttacccg

SEQ ID NO: 166355 - DNA, 720 bp, Homo sapiens
  misc_feature: GYAE6OF01CRWUV.26.71.G05.1.454.CMB.1.raw
  modified_base (237)..(237): a, c, t, g, unknown or other
  misc_feature (237)..(237): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaaccatcacctgctcggcagacaaattggganatagaaatgctgcctggtattaccagaggccaggccagtcccctattttggtcatctcaagataagaacgcggcctcgacgggactccctgaccgtaattttccgtggtcctcctaactcgtaggggaaaccacgacgccctactcacgaaccatcgacggccggggaccccaaggaccccgaaacgggtagtacgggaacgggaacgaaccgttaacttaacgttcggtacgtacgggtccggttaggggaaacgtaaacgttaaccgttaaggtttagggtttaacgggttagggtttttacggggaccggggtacggggaacccggtacggggttccgttaccgggtaaccccggttacccggttaacggggttacccgaaccgggtacccccggaaacgggtcccgttacccgggtaccccccccgttacggggttacccttaaccccgttcccggttcccgggttttaccccccccgg

SEQ ID NO: 166356 - DNA, 822 bp, Homo sapiens
  misc_feature: GYAE6OF01BHSTK.26.71.G05.1.454.CMB.1.raw
  modified_base (239)..(239): a, c, t, g, unknown or other
  misc_feature (239)..(239): n is a, c, g, or t
  modified_base (345)..(345): a, c, t, g, unknown or other
  misc_feature (345)..(345): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagcccaccctcagtcgtccgtcgtccccaggacagacacgccaccatccacctgctcggcagacaaagttggganatagaatgctgcctggtattaccagaggccaggccagtcccctattttggtctattcttaccaagataagaacgcggccctgagggactccctgaccgtaatttcnggcctccaactcgtacgggaaacacacgccactcctacgaccacgtccgaacgggtccgggggacccccgaaggacccccggtaaacggggaacgttacggggaaacgggggtaacgggtaaaccctttaaccgttaaacggttttacgggtaccgggtaaacgggggtacccggggttaaggggggtaaacgtaaaacgtttaaaccgttaaggtttttaagggtttaagggtttacgggggtttttacgggggaaccgggggtaacgggggtaacccggtaaggggtacccggttaaccggggtaacccccggtttacccggttaacgggggttacccgtaacccggggtaacccccgtaaacgggggttcccccgttacccgggtcccccccccggtttaccgggttaccccttaaccccggtttcccgtttacccccgggttttacccccccgtacccccgttttaccccccg

SEQ ID NO: 166357 - DNA, 517 bp, Homo sapiens
  misc_feature: GYAE6OF01ASL8L.26.71.G05.1.454.CMB.1.raw
  modified_base (504)..(504): a, c, t, g, unknown or other
  misc_feature (504)..(504): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttcggtcatcttccaagataagaagcggccctcagggatccctgaccgtaatttctggctccaactctcggaacacacgccactctgaccatcacgcgggcccagacccaacggataggagggagactactatgtcaggcgtgggagaatactagttgtagtgtttggcggaggaccaggctgaccgtcgtaggtcacgcccgaggctcgccccctgaccnctcgtcgttcccc

SEQ ID NO: 166358 - DNA, 625 bp, Homo sapiens
  misc_feature: GYAE6OF01DK8JR.26.71.G05.1.454.CMB.1.raw
  modified_base (237)..(237): a, c, t, g, unknown or other
  misc_feature (237)..(237): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagcccaccctcagtgtccgtcgtccccaggacagacacgccaccatccacctgctcggcagacaaagttgganatagaaatgctgcctggtattaccgagaggccaggccacgtccccttatttggtcatcttccaagataagaagcgcctgagggactccctagaccgtaatttcgtcggactacccaacgtctacgggaaacacacgccactctacgaccatcgacggccgggcccaagcccaaacgggatacggaacgggagtacctactagttcgcgagggcgtagggaataattacgtagttaggttaggttggtttagggacgggtagggacccgagggtccgtacggtacccgtccgtaagggtccgaacggaccccgtaaggtccccgtacccggtccccccgttacgggtcctacccgttcccgttcccggtttcccccgccccgttacccg

SEQ ID NO: 166359 - DNA, 543 bp, Homo sapiens
  misc_feature: GYAE6OF01BE0IR.26.71.G05.1.454.CMB.1.raw
  modified_base (295)..(295): a, c, t, g, unknown or other
  misc_feature (295)..(295): n is a, c, g, or t
tcagagactatactcacgaccggtgctcgatttagtgtcgtcgcaagagagaggggggactcctgtgccccaccatggacacgctttgctccacgctcctgctgctgaccatcccttcatgggtcttgtcccagatcaccttgaaggagtctggtcctgcgctggtggagcccacgcagaccctcacgctgacctgctccgtctctggattctcactcaccacgactgaggtgaatgtggcctgggtccgtcaggcccccggaaaggccctggagtggcttgcactcattttacnggagtgatctcaagcggtacaatccgtctctgaggaatcgactcaccatcaccgaggacacctcgaaacgccgggtgtccttacaatcgacccgacatagaatcccgtagtcggactacgaggcactatattactgtgcacacagtctagcgactacgacgagaaagatatgactagttcggggactaggggtaattttcggaccgtacccgttcctaccccgagtcccctcccaaccgtaaccgggg

SEQ ID NO: 166360 - DNA, 607 bp, Homo sapiens
  misc_feature: GYAE6OF01AZO66.26.71.G05.1.454.CMB.1.raw
  modified_base (236)..(236): a, c, t, g, unknown or other
  misc_feature (236)..(236): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtacttaccagaggccaggccagtccctatttgcatcttcaagataagagcgcctcaggactccctgaccgtatttctggcctccaactcgtacggaacacacgcctactctacgaccatcgacggccggggacccacggacccaaacgggataggaacgggacgtacgtaactagttcggacgacgggtcgtagggaagaagttacgtaagtttggtaaggttggtttcgggacgggtagggaccgtagggtcctacggacccggttaccgtacgggtaccgacggaccccgaagggtcccttccgggtaccccccttacgggtacccaccggttcccgttccggttccccccg

SEQ ID NO: 166361 - DNA, 520 bp, Homo sapiens
  misc_feature: GYAE6OF01DA8W3.26.71.G05.1.454.CMB.1.raw
  modified_base (234)..(234): a, c, t, g, unknown or other
  misc_feature (234)..(234): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacttgctcggcagacaaattggganatagaaatgctgcctggtattaccagaggccaggccagtcccctattttggtcatcttccaaagataaagaagcggccctcagggatccctgaccgaatttctggctccaactctagggaacacagccactctgaccatcagcgggccagcaacggatgagggagactactattgtcaggcgtgggagaatactatagtagtgtttggcggtagggaccaggctgaccgtcctaggtcagcccaaggcctagccccctcggtccactctcgttccccgccctcccg

SEQ ID NO: 166362 - DNA, 627 bp, Homo sapiens
  misc_feature: GYAE6OF01AOKDH.26.71.G05.1.454.CMB.1.raw
  modified_base (240)..(240): a, c, t, g, unknown or other
  misc_feature (240)..(240): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccaccctcagtgtccgtgtccccaggacagacagcccaccatccacctgctcggcagacaaagttggganatagaaatgctgcctggtattaccagaggccaggccacgtcccctattttggtcatcttccaagataagagccgcctcgagggactccctagaccgtaactttcgtggcctaccaacgtctacgggaacacacgccactctacgaccatcgacggccgggccccaggaccccgaacggagtacggaagggacgaccgttaagtacgttcgtaccgaggtcggtagggaagaactacgttagtttaggtacggttaggtttcggggacgggtagggaccagggtccgtacggtacccggttccgtaacgggtccgaacggtccccgaaacgggtcctaccccgggtcccccgttcggacccgtaccttccgttccggttacccccccg

SEQ ID NO: 166363 - DNA, 626 bp, Homo sapiens
  misc_feature: GYAE6OF01BQ3NN.26.71.G05.1.454.CMB.1.raw
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaatgggagatagaaatgctgcctggtattaccagaggccaggccagtcccctattttggtcatcttccaagataagaagcggccctcgagggactccctgaccgaatttctggctccaactctagggaacacacgccactcctgaccagtccacggccggggacccacgccgaaacgggagtacggaagggacgacgtacgtagttcggtacgagggtccggtagggtaagaacgtaacgttagttaggttaggttggtttagggaccgggtagggtaacccgtagggtaccgtcggtaacccggttccgtaacgggtccgaacggtaccccgaacgggtccgtaccgtccccccgtacggtaccctaccgttccgttcccgttccccgccccgttacccg

SEQ ID NO: 166364 - DNA, 727 bp, Homo sapiens
  misc_feature: GYAE6OF01ADNKA.26.71.G05.1.454.CMB.1.raw
  modified_base (232)..(232): a, c, t, g, unknown or other
  misc_feature (232)..(232): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccacctcagtgtccgtgtccccaggacagacacgccaccatccacctgctcggcagacaatggganatagaatgctgcctggtattaccagaggccaggccacgtcccctatttggcatcttaccaagataagaacgcggccctcgacgggtactcccgtagaccgtaatttccgtggtacctaccaaccgttcgttacgggaaacctacgacgaccctaccgttactacggaaccctagttccgaacgggtcccgggggaccccctaagggaaccccgaacggggtaactacgggaacggggaacgtaaccgttaaccgttagttacgtaccgtaagggtccgggttaggggaacgtaagttaaccgtaagttttacggtaacgggttcgggtttacggggacgggtaacggggtaacccgtagggtaccgttcggaacccgtttaccgggtacggtaccgaccgggacccggtaaggtccccgttcccgggtacccccccgtttacgggtacccctaacccgttcccggttcccggttcccccgtcccgtttaccccgg

SEQ ID NO: 166365 - DNA, 786 bp, Homo sapiens
  misc_feature: GYAE6OF01BO0GZ.26.71.G05.1.454.CMB.1.raw
  modified_base (233)..(233): a, c, t, g, unknown or other
  misc_feature (233)..(233): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccacgtcccctagttttcggctactcttccaagataaagacgcggccctagacggggtactccccgtgaacccgtaacttttccgtcgggtacctaccctaaaccgtcgttacggggaaacctaccgaacgtaccccgaaccttccgtacgaacccctacgttaccgaaccgggaccgggggaccccctaacgggaccccgaaacggggtacgttacgggaacggggtaacgaaccgtttaaccgttaacgtttcggtaccgtaacggggtccggttaaggggtaacggtaaacttaaccgtttaggtttaacggtttaggtttaggggttttacgggaccgggggtaacgggtacccggtacggggtacccgttaccgggtaaccccggttacccggtaacgggttacccgaacggtcccccggtaaacgggtcccggttacccggtaccccccccgttacgggttaccctaacccggttcccgttacccgtttccccccgtaccccccgtttacccg

SEQ ID NO: 166366 - DNA, 524 bp, Homo sapiens
  misc_feature: GYAE6OF01BQN67.26.71.G05.1.454.CMB.1.raw
  modified_base (231)..(231): a, c, t, g, unknown or other
  misc_feature (231)..(231): n is a, c, g, or t
  modified_base (333)..(333): a, c, t, g, unknown or other
  misc_feature (333)..(333): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtccccctattttggtcatcttccaagataagaagcggccctcagggatccctgaccgaatttcnggctccaactctgggaacacagccactctgaccatcagccgggcccagccaacggatgagggagactactattgtcaggcgtgggagaatactattgtagttgttggcggagggaccgaggctcggaccgtccgtaggtccaggcccaaggcctcgcccccgtcggtccactctccgtccctcccgtcccg

SEQ ID NO: 166367 - DNA, 587 bp, Homo sapiens
  misc_feature: GYAE6OF01A33NY.26.71.G05.1.454.CMB.1.raw
  modified_base (234)..(234): a, c, t, g, unknown or other
  misc_feature (234)..(234): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctatttggtcatcttccaagataagagcggcctcgaggatccctgaccgtaatttctggcctccaactctagggaacacacgcccactctcgaccatcgacggccgggcccacgccgaacggataggagggacgtactactattgtacgagggcccgtagggaagaattacgtagttagttaggttgggtttagggacgggtacgggaccgacggtcgtcggaccgtccgtacggtaccgacggacccgaacggtccgtccggcccccgttccggtcctaccgttccgtccgttcccccgtcccgttcccg

SEQ ID NO: 166368 - DNA, 537 bp, Homo sapiens
  misc_feature: GYAE6OF01DAEJV.26.71.G05.1.454.CMB.1.raw
  modified_base (233)..(233): a, c, t, g, unknown or other
  misc_feature (233)..(233): n is a, c, g, or t
  modified_base (405)..(405): a, c, t, g, unknown or other
  misc_feature (405)..(405): n is a, c, g, or t
  modified_base (429)..(429): a, c, t, g, unknown or other
  misc_feature (429)..(429): n is a, c, g, or t
  modified_base (465)..(465): a, c, t, g, unknown or other
  misc_feature (465)..(465): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccacatcacctgctcggcagacaaattggganatagaaatgctgcctggtattaccagaggccaggccagtcccctatttggtctatcttccaagataagaagcggccctcgagggctcccgtgaccgaatttctggctacccaacgtctagggaacacacgccactctgaccatcagccgggcccagccaacggatgaagganactactattgcgaggcgtaggganaagtactagtggttagtggtttgggcggagggacgnggcgtggacccgtctacggcacggcccaaggcctcgccccctcggtccactccgtcgtccccgcccttcccg

SEQ ID NO: 166369 - DNA, 592 bp, Homo sapiens
  misc_feature: GYAE6OF01CN93J.26.71.G05.1.454.CMB.1.raw
  modified_base (232)..(232): a, c, t, g, unknown or other
  misc_feature (232)..(232): n is a, c, g, or t
  modified_base (300)..(300): a, c, t, g, unknown or other
  misc_feature (300)..(300): n is a, c, g, or t
  modified_base (304)..(304): a, c, t, g, unknown or other
  misc_feature (304)..(304): n is a, c, g, or t
  modified_base (308)..(308): a, c, t, g, unknown or other
  misc_feature (308)..(308): n is a, c, g, or t
  modified_base (317)..(317): a, c, t, g, unknown or other
  misc_feature (317)..(317): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtcgtccgtgtccccaggacagacagccaccatcacctgctcgcagacaaatgganatagaatgctgctgtataccagagccaggccagtccctatttcggcatctacaagataagagcgcctnaggntccngactattcngctcaactcgtaggacacacgccactctacgaccatcgacggccgggcccacgaccaacggagtacggagggaacgtactaactagttcgtacgagggtcggtagggaagtaaatacgttaagttggttaggttgggtttgggacgggtagggaaccgagggtccgtacggtaccgtaccgtaggtaccgacggaccccgaacgggtccctcccggtccccccgttacggtccctaacccgttcccgttacccggttcccccgtccccttacccg

SEQ ID NO: 166370 - DNA, 821 bp, Homo sapiens
  misc_feature: GYAE6OF01BVFXC.26.71.G05.1.454.CMB.1.raw
  modified_base (250)..(250): a, c, t, g, unknown or other
  misc_feature (250)..(250): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcacgcccaccctcagtcgtcccgtcgtccccaggacagacagccaaccatccacctgcctcggacaagaacaaagttggggaanataagaaatgactcgaccttaggtaacttaccgaggacggcccgaacggcccgtaaccggttacccccttaagtttttcgggtaccactttaccctttaacccgaaaaggtaaacgttaaaacgggaaaccggcccgggtacccccgttacggaacggggtacccttaccccgtaacggtaaacccgttaagttttccgtacgggacccttaccgaaacgttcggtaacgggaaacaccgacggaccctacgtacctacgaacctacgtaccggacgggcccggggacccctaacggacccgaaacgggtacgtaacgggggaagggtaaccgtaaccgttaagttacggtttccgaacggtacgggtaccgggttaaagggggaaacttaaacggtttaacgtttacgggtttaagggttacgggtttacgggtttacgggggacggttaacggggaccggtacggtacgggtaccggaccggttacccggtaggtccgaaacccggtcccgaaacggtcccctcccggtaccccgttacggacctacccgtcgtttccccgtcccccgg

SEQ ID NO: 166371 - DNA, 696 bp, Homo sapiens
  misc_feature: GYAE6OF01CGX9Q.26.71.G05.1.454.CMB.1.raw
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccaccctcagtgtcccgtgtccccaggacagacacgccaccatccacctgcctcggcagacaagttggagatagaaatgctgcctaggtacttaccagaggccaggccacgtccctatttcgcatctacaagataagagcgcctcgaggactccgtgaaccgtaatttcgcggaccttaccaaactcgtagggaaccacgacgacccacttaccgacgaaccctacgtaccgacgggcccggggaccccacggaccccgaaacgggacgtagggaagggtaacctaacgttaacgttaagtttcggaccgagggtacgggtaggggaaagtaacgttaacggttagtttacgggttaggtttggggtttacgggacgggtacgggaccgtagggtccgtaccggtaacccggttaccgtacggggttaccgaaccggtccccggtaaaccgggtcccgttaccccggcccccccggtttacggtacccctaccggtttccccggtttaccccggttccccccccgg

SEQ ID NO: 166372 - DNA, 542 bp, Homo sapiens
  misc_feature: GYAE6OF01AZEXX.26.71.G05.1.454.CMB.1.raw
  modified_base (231)..(231): a, c, t, g, unknown or other
  misc_feature (231)..(231): n is a, c, g, or t
  modified_base (404)..(404): a, c, t, g, unknown or other
  misc_feature (404)..(404): n is a, c, g, or t
  modified_base (450)..(450): a, c, t, g, unknown or other
  misc_feature (450)..(450): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtcccccaggacagacagccaccatcacctgctcggcagacaaatggganatagaaatgctgcctggtattaccagaggccaggccagtcccctatttggtcatcttccaagataagaagcgccctcgagggatccctgaccgtaatttctggctccaactctagggaacacacgccactctcgaccactcagcgggcccagccgaaacggataggacggganaactactagttgtcgaggcgtggagaatactattgtagtgtttggnggtaggaccaggctgaccgtccgtaggtccacggcccgaaggcctacgtcccccgtcggtccaccgttcctccgttccccgcccgttacccg

SEQ ID NO: 166373 - DNA, 303 bp, Homo sapiens
  misc_feature: GYAE6OF01DMUK9.26.71.G05.1.454.CMB.1.raw
  modified_base (300)..(303): a, c, t, g, unknown or other
  misc_feature (300)..(303): n is a, c, g, or t
tcagagactatactcacgaccggtgctcgatttagtgtcgtcgcaagagagagggggccctcagggatccctgaccgaatttctggctccaactctgggaacacagccactctgaccatcagcgggcccagccaacggatgagggagactactattgtcaggcgtgggagaatactattgtagtgtttggcggagggaccaggctgaccgtcctaggtcacgcccaaggctcgccccctggtcactctcgttccccaccctcctcagtatagtctctgagcggctggcaaggcgcatagnnnn

SEQ ID NO: 166374 - DNA, 537 bp, Homo sapiens
  misc_feature: GYAE6OF01D6ZKM.26.71.G05.1.454.CMB.1.raw
  modified_base (372)..(372): a, c, t, g, unknown or other
  misc_feature (372)..(372): n is a, c, g, or t
  modified_base (453)..(453): a, c, t, g, unknown or other
  misc_feature (453)..(453): n is a, c, g, or t
tcagagactatactcacgaccggtgctcgatttagtgtcgtcgcaagagagaggggggactcctgtgccccaccatggacacgctttgctccacgctcctgctgctgaccatcccttcatgggtcttgtcccagatcaccttgaaggagtctggtcctgcgctggtggagcccacgcagaccctcacgctgacctgctccgtctctggattctcactcaccacgactgaggtgaatgtggcctgggtccgtcacgggcccccggaaaggccctggagtggcttgcactcatttactggagtgatctcaagcggtacatccgtctctgagaatcgactcacatcacagggacacctcaaagccggtgtcctanatgacgacatgaactctgtgacacaggcacatattactgtgcacacacgtcctaggcggtactacgacgaagaaagatagngtacgttagttcggggacctaggggttaatttcgggtacctacccgttcctaccccgacgtcccctaccgacccgtaacccggg

SEQ ID NO: 166375 - DNA, 746 bp, Homo sapiens
  misc_feature: GYAE6OF01B6CMB.26.71.G05.1.454.CMB.1.raw
  modified_base (235)..(235): a, c, t, g, unknown or other
  misc_feature (235)..(235): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtcgtccgtgtccccaggacagacagccaccatcacctgctcggcagacaagtgganatagaatgctgcctggtatacagaggccaggccacgtcccctatttcggtcatctacaagataagacgccggccctacgacgggtactcccgtagaccgtatttacgcggtaccttaccaaccgtcgtaacgggaacctacgacgccctacctctacgacctacgtccgacgggccggggaccccaacggacccgaaacgggtacgtaacgggaacggggaacgtaaccgttaacgttaagtttacggtacggaacgggtcgggttaaggggaacgttaaacgttaacgtttaagtttagggtttaaggtttcgggttttacggggaaccggggtaacgggtaacccggtaacgggtccggttaccgggtaaccccggttaccggttaacggggtacccgaacccgggtacccccggtaaacggggtccccgttaccccgggtacccccccggttaccgggttaccccgttaacccggtttccccggtttccccgggtttaccccccccgg

SEQ ID NO: 166376 - DNA, 678 bp, Homo sapiens
  misc_feature: GYAE6OF01C52Q6.26.71.G05.1.454.CMB.1.raw
  modified_base (238)..(238): a, c, t, g, unknown or other
  misc_feature (238)..(238): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagcccaccctcagtcgtccgtcgtccccaggacagacagccacatcacctgctcggacagacaaagttggganatagaaatgactgcctggtattaccgagacggccaaggccacgttcccctattttcggacattccttaccaaagtataaaggaacgccggccctacgaacgggactccccgtgtaacccgtaatttcgacggtccttacccaacttcgtagggaaaccacgaacgccctacgtcctacgtaaccagtcccgacggcccggggacccaacggacccgaaacgggagtacggaacggggtaacaacgttactaagttcgtacgagggtacggtagggaacgtaaatacgttaagttagttaggtttgtttagggacgggtacgggtaccggtaggtccgtcggtacccgtacccggtaggtccgaaccggacccgaacgggtcctacccggccccccgttacggtccctaccttccgttcccgttcccccaccccgttaccc

SEQ ID NO: 166377 - DNA, 530 bp, Homo sapiens
  misc_feature: GYAE6OF01C08VT.26.71.G05.1.454.CMB.1.raw
  modified_base (357)..(357): a, c, t, g, unknown or other
  misc_feature (357)..(357): n is a, c, g, or t
  modified_base (362)..(362): a, c, t, g, unknown or other
  misc_feature (362)..(362): n is a, c, g, or t
  modified_base (494)..(494): a, c, t, g, unknown or other
  misc_feature (494)..(494): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtcccgtgtccccaggacagacagccaccatcactgctcggcagacaagtgggagatagaatgactgcctggtactaccagaggccaggccagtcccctatttcgcatctacaagataagagcgcctgaggctcagactattcgtgctacaactcgcggtaacacacgaccactcanaccancgacggccgggccagaccaagcgaggagacactatagtcgtacgaggcgtaggaacgtatacgtgttaggtgtaggttgggcggaggcgaggtcgtcgtaccgtcgtacggacgaccggcccgaaggtcccncggtccccctgggaccctacgtgtcccgttaccccg

SEQ ID NO: 166378 - DNA, 811 bp, Homo sapiens
  misc_feature: GYAE6OF01A88T2.26.71.G05.1.454.CMB.1.raw
tcagagactatactcacgaccggtgctcgatttagtgtcgtcgcaagagagaggggctggcctcaggaagcagctatcggaggtgcctcagccatggcatggatccctctcttcctcggcgtccgttgcttactggtccacaggatccgtggccttcgatgagctggattcagccaccctcgagtggtccgtcgtccccgaggaacagacgacgaccacctatcacctgcctcggcagacgtaaagttggaagtataagaaatgactgaccgtggtaacttaccgagacggcccaggcccacggttacccccttagttttcggacctaagttcctttaccgtaagtaacgtaacgaaacggtacccgggtacccttaccggaaaggggtaccttacccccgtaggtaaacccgtttaagtttccgtacgggtacctaccccgtaacgttcgtaaccggggaaaccctaccgaccggaccctaccgtactacgaaccctagtacccggacggacccggggcccctaacggtacccctaaacgggagtaacggaagggaacgtaaccttaaccgttacgttaccggtacgaacggggtaccgtaacggggaacgtaaacggtttacgtttaggtttacgttagggtttacgggtttaggggaccggggtacgggtaaccggtagggtaccgtacggtaaccccggtacgtaacgggttaccgaaccgggtaccccggaaagggtcccttacccgggtaccccccgttacgggttacccgttaccgttacccggtccccggttaaacccccccg

SEQ ID NO: 166379 - DNA, 681 bp, Homo sapiens
  misc_feature: GYAE6OF01DAGTK.26.71.G05.1.454.CMB.1.raw
  modified_base (298)..(298): a, c, t, g, unknown or other
  misc_feature (298)..(298): n is a, c, g, or t
  modified_base (318)..(318): a, c, t, g, unknown or other
  misc_feature (318)..(318): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaagttgggagatagaaatgactgcctgtataccagagccagccagtcccctatttggcatcttaccaagataaganccggccctagacggctaccngaccgtatttcgtcgcctaccaactcgtaggaacacgacgaccactctagaacctagtccgaacggcccggggacccaacggacccaaacgggactacgggaagggacgtaaacgtacttagttacgtacgtaacgggtcgtaggggaacgtaaacgttacgtttaagtttaggttacgggtttagggttttacggggacggggtaacgggtacccgaggggtaccgtaccggtaacccggtcccgttaaagggtcccgtaaaccggtaccccgtaacgggccccgttacccggcccccccggttacggggtacccctaaccgttcccgtttacccgtttccccccgtaccccgtttaccccg

SEQ ID NO: 166380 - DNA, 701 bp, Homo sapiens
  misc_feature: GYAE6OF01CE4PH.26.71.G05.1.454.CMB.1.raw
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccacatcacctgctcggcagacaaagttggagatagaatgctgcctaggtattaccgagacgccgaggcctacgtccccttagttttcggtctacttcctaccaaagataacgaacgccgtccctacgagggtactccccgtagaccgtaatttcgtcggactacccaacgttccgtagggaaaccacacgacccaacctcgtacgaccatccgacggccgggacccacggacccgaacgggacgtacggaagggtaacgtacttaacgtagttcgtacgagggcgtagggaactaagttacgtaagttacggttaggttgggtttacgggacgggtaacgggacccgtaggggtaccgttaccgggtaacccgttcccggttaaacgggtacccgaccgggtaacccccgaacgggttccccgtaccccgggttacccccccgttcgggttaccctaccccgtttccgttacccggttccccccctaaccccgtttaccccg

SEQ ID NO: 166381 - DNA, 304 bp, Homo sapiens
  misc_feature: GYAE6OF01ADRS3.26.71.G05.1.454.CMB.1.raw
  modified_base (300)..(304): a, c, t, g, unknown or other
  misc_feature (300)..(304): n is a, c, g, or t
tcagagactatactcacgaccggtgctcgatttagtgtcgtcgcaagagagaggggggccctcagggatccctgaccgaatttctggctccaactctgggaacacagccactctgaccatcagcggggcccagccaacggatgagggagactactattgtcaggcgtgggagaatactattgtagtgtttggcggagggaccaggctgaccgtcctaggtcagcccaaggctcgccccctggtcactctgttcccgccctcctcagtatagtctctgagcgggctggcaaggcgcatagnnnnn

SEQ ID NO: 166382 - DNA, 543 bp, Homo sapiens
  misc_feature: GYAE6OF01BL09I.26.71.G05.1.454.CMB.1.raw
  modified_base (236)..(236): a, c, t, g, unknown or other
  misc_feature (236)..(236): n is a, c, g, or t
  modified_base (528)..(528): a, c, t, g, unknown or other
  misc_feature (528)..(528): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctattttggtcatcttccaagataagaagcggccctcagggatccctgaccgaatttctggctccaactctgggaacacagccactctcgaccatccacggccggggaccccagccccaacggactggaggagactactattagtcagggcgtagggagaattactagttgttagttgtttgggcgggtacgggaccagggcctggaccggttcgtagggtcacggcccaaggctcgcccctggtacccncgttcctcgtccccg

SEQ ID NO: 166383 - DNA, 803 bp, Homo sapiens
  misc_feature: GYAE6OF01D5ZXG.26.71.G05.1.454.CMB.1.raw
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtcgtccccaggacagacagccaccatcacctgctcggcagacaaagttgggagataagaaatgactgcctggtacttaccgagaggccaggccacggtccccttagttttcggtctattccttaccaagataaaggaacgccggccctcgaacgggactccccgtaggtaacccgtaatttcgtacggtcctacccgtaaacgttacgtacggggaaaccaccgaacgacccaaccttcctaacgaaccctacttccggaacggcccgggggaccccctaacggaccccggaaacgggtaacgtacggggaaacgggggtaacgtaaccgtttaaccgttacgttttacgggtacccgtaaggggtccgggttacggggaaaggttaaacgttaaccggtttaaggttttacgggtttaaggggtttgggttttacggggtaaccggggggaacggggtaacccggtaggggtcccgttacgggtaaccccgggttacccgggttaacggttacccggaaccggtacccccggtaaacggtccggttcccccggtacccccccgttccgggttacccctaaccgtttccccgttaccggttcccccctaccccgtttaccccg

SEQ ID NO: 166384 - DNA, 658 bp, Homo sapiens
  misc_feature: GYAE6OF01DHQKN.26.71.G05.1.454.CMB.1.raw
  modified_base (234)..(234): a, c, t, g, unknown or other
  misc_feature (234)..(234): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccacctcagtgtccgtcgtccccaggacagacagccacatcactgctcggcagacaagttggganatagaatgctgctggtactaccagagccgagctacgtccctatttgcatctaccaagataagacgccgcctcgacgggactccgtacgtaaccgtaatttcgtcggcctacctaacgtacgtacgggaacctacgacgacctaccgtctacgaacctacgtccgaacgggcccggggacccaacggacccgaaaccggagtacgggaagggactaaccgttacgttacgttacggtacggaacgggtcgggtaaggggaacgtaagttaacgttagttagggttaggttaggtttacggggaccgggtaggggtacccgagggtaccgtacggtacccggttaccggtacggtaccgacggtacccgtaacggcccgtacccggtcccccgtacggtaccctacgttcccgtccggttcccccg

SEQ ID NO: 166385 - DNA, 570 bp, Homo sapiens
  misc_feature: GYAE6OF01CMKDU.26.71.G05.1.454.CMB.1.raw
  modified_base (233)..(233): a, c, t, g, unknown or other
  misc_feature (233)..(233): n is a, c, g, or t
tcagagactatactcacgaccggtgctcgatttagtgtcgtcgcaagagagaggggggactcctgtgccccaccatggacacgctttgctccacgctcctgctgctgaccatcccttcatgggtcttgtcccagatcaccttgaaggagtctggtcctgcgctggtggagcccacgcagaccctcacgctgacctgctccgtctctggattctcactcaccacgactgaggtnaatgtggccgtgggtccgtcacggcccccggaaaggcccgtggagtggcttgcactctatttacgtggagtgatctcaagcggtaacaattccgtctctgaggaatcgactcacatcacacgggacacctacaaacggtaccgggtgtacctacaatcgaccacatacgaactccgtagtcggaacagacggcaacattacttacgtgtgacaacacgtacgtcctaggccgacgtacgacgaagaaaagaatatagacttaggtcggggacctaagggttacttttcgggtaccacccggttcctaccccgagcccctaccgaaccgtaacccggg

SEQ ID NO: 166386 - DNA, 542 bp, Homo sapiens
  misc_feature: GYAE6OF01AVHX2.26.71.G05.1.454.CMB.1.raw
  modified_base (306)..(306): a, c, t, g, unknown or other
  misc_feature (306)..(306): n is a, c, g, or t
  modified_base (314)..(314): a, c, t, g, unknown or other
  misc_feature (314)..(314): n is a, c, g, or t
  modified_base (327)..(327): a, c, t, g, unknown or other
  misc_feature (327)..(327): n is a, c, g, or t
  modified_base (414)..(414): a, c, t, g, unknown or other
  misc_feature (414)..(414): n is a, c, g, or t
  modified_base (532)..(532): a, c, t, g, unknown or other
  misc_feature (532)..(532): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtcccccaggacagacagccaccatcacctgctcggcagacaaatgggagatagaaatgctgcctggtattaccagaggccaggccagtcccctatttggcatcttccaagataagagcgccctnaggatccngaccgtaatttcngctccaactctggaacacagcccactctgaccatcaggccgggcccagcccaacgggatggagggagtactactattgtcgaggcgngggagaatactattagtaggttgtttgggcggtagggaccgaggcgtggaccgttcgtaggtacgacgacccgaaggcctccggcccccgttcggtcctaccgttcctccgttccccncccgttcccg

SEQ ID NO: 166387 - DNA, 683 bp, Homo sapiens
  misc_feature: GYAE6OF01C0UU4.26.71.G05.1.454.CMB.1.raw
  modified_base (235)..(235): a, c, t, g, unknown or other
  misc_feature (235)..(235): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaagttggganatagaaatgctgcctggtattaccagaggccaggccagtccccctattttggtcatcttccaagataagaagcggccctcgagggatccctgaccgtaatttctaggctacccaactcgtacgggaactacacgccaactctgaccatcgaacggccggggaccccacggacccgaaacgggataggaaggggaacgacttaacgtaatttcgtaccgaggtacggtaggggtaacgaaacgtttaacgttaagtttggttaacggtttgggttttacgggcggggtaacgggggtaaccgacggggtaccgttacgggtacccgttacccgttaaggggtccgaaacggtacccccggaaacgggtcccttacccgggacccccccgttacgggttcccgtaacccgttcccgtttccggttcccccccgtacccccgtttaccccg

SEQ ID NO: 166388 - DNA, 529 bp, Homo sapiens
  misc_feature: GYAE6OF01ADBMC.26.71.G05.1.454.CMB.1.raw
  modified_base (234)..(234): a, c, t, g, unknown or other
  misc_feature (234)..(234): n is a, c, g, or t
  modified_base (362)..(362): a, c, t, g, unknown or other
  misc_feature (362)..(362): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtcccccaggacagacagccaccatcacctgctcggcagacaaattggganatagaaatgctgcctggtattaccagaggccaggccagtccccctattttggtcatcttccaagataagaagcggccctcagggatccctgaccgaattctggctccaactctgggaacacagccacnctgaccatcagcggggcccagccgaacggatgagggagactactattgtcaggcgtgggagaatactattgtagtgttggcggtagggacaggcgtgaccggtcctaggtccgacgcccaagggcctcgcccccgtcggtccacttcctccgttcccgcccttcccg

SEQ ID NO: 166389 - DNA, 597 bp, Homo sapiens
  misc_feature: GYAE6OF01BAL9Q.26.71.G05.1.454.CMB.1.raw
  modified_base (314)..(314): a, c, t, g, unknown or other
  misc_feature (314)..(314): n is a, c, g, or t
  modified_base (324)..(324): a, c, t, g, unknown or other
  misc_feature (324)..(324): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggtcatctcaagataagagcgcctgaggactccngaccgattcngctcaactctaggaacacacgccactctacgaccatcgacggccgggcccacgacccgaacgggacgtacggaagggacgtaactaacgtattacggtcgagggcggtagggacaaagttacttaagtttggttacggttgggttttacgggcggggtaacgggtaccgagggtcgtacggacccggttccgtaagggtccgacggtacccgaacggtcctaccgccccccgttcggtccaccgttccgtcccgttcccccgcccttaccccg

SEQ ID NO: 166390 - DNA, 541 bp, Homo sapiens
  misc_feature: GYAE6OF01BEEAD.26.71.G05.1.454.CMB.1.raw
  modified_base (234)..(234): a, c, t, g, unknown or other
  misc_feature (234)..(234): n is a, c, g, or t
  modified_base (426)..(426): a, c, t, g, unknown or other
  misc_feature (426)..(426): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtcccccaggacagacagccaccatcacctgctcggcagacaaattggganatagaaatgctgcctggtattaccagaggccaggccagtcccctatttggtcatcttccaagataagaagcggccctcagggactccctgacccgtaatttctggctccaaactctgggaacacagcccactctgaccatcgagcgggcccagccaacggatgagggagactactattgtcaggcgtggganaagtactattgtagtgtttgggcggtagggaccagggctaggaccgttctaggttccgaggccccaagggcctaccgcccccgtcggtccactcctcgttccccgcccttacccg

SEQ ID NO: 166391 - DNA, 793 bp, Homo sapiens
  misc_feature: GYAE6OF01EN8YV.26.71.G05.1.454.CMB.1.raw
  modified_base (180)..(180): a, c, t, g, unknown or other
  misc_feature (180)..(180): n is a, c, g, or t
tcagagactatactcacgaccggtgctcgatttagtgtcgtcgcaagagagagggggctgggcctcaggaagcagcatcggaggtgcctcagccatggcaatggactccctctcttcctcggcgtccttgcttactgcacaggactccgtggccttcgatgagctgattcgagccacctnagtcgtccgtcgtccccgaggacagacagccaccatccacctgcctcggacagacaagttcggactatagaactcgctcgcctaggtacttaccgagacggccacggccctacgttccccgttagttttcgggacctacttccgttacccgaaagtaacgtaaacggaaccgtcccggtaccctacggaacgggtaccttccccgtaggtaacccgttaacgtttccgtacgggtacccttaccgaaacgttccgtacggaaccacgacgaccctactcgtacgacctacgtaccgacgggtccggggaccccaacggacccgaaacgggacgtacgggaacgggtaactaaccgttacgttacgtttcggtaccggaacgggtacgggtagggtaaacaacgtttttttaaccgaggttttagggttaacggtttcggggtttacggggaccggggtaacggggtaccgtaggggttacccgttacgggtaaccccggtttacggtacgggttacccaacccgggtacccgtaaaccgggtccccgttaccccggtccccccggtttacggttaccctaacccgttttcccgttaccccggtttaccccccc

SEQ ID NO: 166392 - DNA, 680 bp, Homo sapiens
  misc_feature: GYAE6OF01C7UKH.26.71.G05.1.454.CMB.1.raw
  modified_base (239)..(239): a, c, t, g, unknown or other
  misc_feature (239)..(239): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccaccctcagtcgtccgtcgtccccaggacagacagccaccatcacctgctcggcagacaaattggganatagaatgctgcctggtattaccagacgccaggccacgttcccctattttgcatccttacaagtataagaagccgcctcgagggactcccgtagaccgtatttcgtaggctcccaaacttctagggaaccacgtacgccctaactcctacggaacctactaccggacgggtacccggggaccccaacgggaccccaaacgggacgttacgggaacggggaacgtaaccgttaccgtaagttcggtacgacgggtacggtagggaacgtaaattacgttaggttttggtacggttggtttgggggaccggtaggggtaccctagggtccgtacggtaccccggttacgtaacgggtccgaaccgggtccccaaagggtccccttccccgggtaccccccttcggggtaccctaacccgttcccgttcccggtttaccccccc

SEQ ID NO: 166393 - DNA, 605 bp, Homo sapiens
  misc_feature: GYAE6OF01BTT49.26.71.G05.1.454.CMB.1.raw
  modified_base (234)..(234): a, c, t, g, unknown or other
  misc_feature (234)..(234): n is a, c, g, or t
  modified_base (307)..(307): a, c, t, g, unknown or other
  misc_feature (307)..(307): n is a, c, g, or t
  modified_base (311)..(311): a, c, t, g, unknown or other
  misc_feature (311)..(311): n is a, c, g, or t
  modified_base (315)..(315): a, c, t, g, unknown or other
  misc_feature (315)..(315): n is a, c, g, or t
  modified_base (323)..(323): a, c, t, g, unknown or other
  misc_feature (323)..(323): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtcccccaggacagacagccaccatcacctgctcggcagacaaattggganatagaatgctgcctggtattaccagaggccaggccagtcccctatttggcatcttcaagataagagcgccctnaggntccngacattcngctcactctggaacacagccactctgaccatcgacggccgggcccacgacccgaaacgggacgtacggaagggaacgtaacctaacgttagttcggtacgagggtccggtagggaagtaagttaacttagtttaggttaggttgggtttgggacgggtacggggtaccgacgggtcctacggtacccggtccgtacgggtccgacggtaccccgaagggtccctccggtcccccccgtcggtaccctaccgttcccgttccgttcccccgtcccgttccccg

SEQ ID NO: 166394 - DNA, 513 bp, Homo sapiens
  misc_feature: GYAE6OF01EWMN7.26.71.G05.1.454.CMB.1.raw
  modified_base (236)..(236): a, c, t, g, unknown or other
  misc_feature (236)..(236): n is a, c, g, or t
  modified_base (336)..(336): a, c, t, g, unknown or other
  misc_feature (336)..(336): n is a, c, g, or t
  modified_base (427)..(427): a, c, t, g, unknown or other
  misc_feature (427)..(427): n is a, c, g, or t
  modified_base (447)..(447): a, c, t, g, unknown or other
  misc_feature (447)..(447): n is a, c, g, or t
  modified_base (500)..(500): a, c, t, g, unknown or other
  misc_feature (500)..(500): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctattttggtcatcttccaagataagaagcggcctcagggatccctgaccgaatttcnggctccaactctgggaacacagccactctgaccatcgacgccggggcccagccaacggatggagggacgactactatgtcaggcgtggganaatactattgtagtgttggnggaggacaggctgaccgtcgtaggtcagcccgaggcctcgccccctcggtccncgtctcgtccccg

SEQ ID NO: 166395 - DNA, 631 bp, Homo sapiens
  misc_feature: GYAE6OF01BWRS2.26.71.G05.1.454.CMB.1.raw
tcagagactatactcacgaccggtgctcgatttagtgtcgtcgcaagagagaggggggactcctgtgccccaccatggacacgctttgctccacgctcctgctgctgaccatcccttcatgggtcttgtcccagatcaccttgaaggagtctggtcctgcgctggtggagcccacgcagaccctcacgctgacctgctccgtctctggattctcactcaccatgactgaggtgaatggtggccgtgggtccgtcgacggaccccggaaaggcccgtggagtcggcttgctactctatttacgtggagtgatccgtacgaacgtcggtaacaacgttccgtctcgtgaggaactcgactcaccactcgaacgacggaccacccgtaccgaaacggtccgggtacgttaccttaacgaacgtcgaaccgactagtacgtaactccgtggtacgacacgacggccaactattacttactgtcgactaacgactacgtaccgtacggcgtacctaacggacgaaagtaaaagtacttaacgtacgtaacgttacggttacggggacgttaaggggttaacttttcggacccgtacccgttccctaccccgacgtccccgtacccgtaaacccggg

SEQ ID NO: 166396 - DNA, 674 bp, Homo sapiens
  misc_feature: GYAE6OF01D150Q.26.71.G05.1.454.CMB.1.raw
  modified_base (230)..(230): a, c, t, g, unknown or other
  misc_feature (230)..(230): n is a, c, g, or t
  modified_base (294)..(294): a, c, t, g, unknown or other
  misc_feature (294)..(294): n is a, c, g, or t
  modified_base (298)..(298): a, c, t, g, unknown or other
  misc_feature (298)..(298): n is a, c, g, or t
  modified_base (314)..(314): a, c, t, g, unknown or other
  misc_feature (314)..(314): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccacatcacctgctcgcagacaaagttggganatagaaatgctgcctgtattaccagagcagcagtccctattgcatctcaagataagagcgcctnaggntcctgaccgtaattcngctaccaactcgtaggaacacagccactcgtacgaccatcgacggaccggggcccaagacccgaaacgggagtaggaaggggaaacgaccgttaacgttagtttcggtaccgagggtccggtaggggaagtaaacttaacgttaagtttggttaaggttgggttttacggggcgggtaacggggaacccgtagggtaccgttacgggaaccccgttacccgttaacggggttacccgaaaccgggtacccccgtaaacggggtccccgttacccgggtacccccccccgttaccgggttacccgtaaaccccgtttcccgtttaacccgggtttcccccccgtccccccgttacccccgg

SEQ ID NO: 166397 - DNA, 913 bp, Homo sapiens
  misc_feature: GYAE6OF01BS5RM.26.71.G05.1.454.CMB.1.raw
  modified_base (183)..(183): a, c, t, g, unknown or other
  misc_feature (183)..(183): n is a, c, g, or t
  modified_base (247)..(247): a, c, t, g, unknown or other
  misc_feature (247)..(247): n is a, c, g, or t
tcagagactatactcacgaccggtgctcgatttagtgtcgtcgcaagagagagggggctgggcctcaggaagcagcatcggaggtgcctcagccatggcatggactccctctcttcctcggcgtccttgcttactgcacaggactccggtggccttcgatggagctgattcacgcccaccctnagtcgtccgtcgtcccaggacagacacgccacatccactgcctcggacaagacaagttgggaanataagaaagtgactcgcgttaggtaactaccgaggacggccgacggcctacgttccctttagtttcgtactacgttacctaaccgaagtaagtaacggaacggcccggtaccccgtacggaacgggtacccttcccggtaacggtaacccgtttaactttccgtacgggtaccccttaaccgtaaaccggttaccggtaacgggaaaccctaccgaaccggtacccttaaccgtaccgtacgaaacccgtacggtaccccggaacgggggtccccggggaaccccctaacgggaaccccggtaaaaccggggtacggtaaacggggtaaacgggggtaacccttaaacccggtttaacgtttaaaccgggttacgggtaacccgggtaacgggggttaccgggttaaacgggggtaaaccttaacggttttaaaccggtttagggttttaacggggtttaacgggggttttacgggggttttacgggggaacccgggggttaaccggggtaacccggtaaccggggttacccgttaaccggggtaaccccgtttaccgggtaccgggtaccggaaccccgggtaccccgggtaacggtccccggtacccccggtcccccggttacggacccgttacccgtttccccggtccccggttacccccccg

SEQ ID NO: 166398 - DNA, 523 bp, Homo sapiens
  misc_feature: GYAE6OF01E0HLD.26.71.G05.1.454.CMB.1.raw
  modified_base (334)..(334): a, c, t, g, unknown or other
  misc_feature (334)..(334): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtccccctattttggtcatcttccaagataagaagcggccctcgagggatccctgaccgaatttcnggctccaactctgggaacacagccactctgaccatccagccggggcccagcccaacggataggagggagacctatattgtacaggcgtgggagaatactattgtagtgttggcggagggacaggctgaccgtctaggtcagcccaaggcctcggccccctcggtccactcctcgttccccacccgtccc

SEQ ID NO: 166399 - DNA, 664 bp, Homo sapiens
  misc_feature: GYAE6OF01BNN3H.26.71.G05.1.454.CMB.1.raw
  modified_base (287)..(287): a, c, t, g, unknown or other
  misc_feature (287)..(287): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatccacctgctcggcagacaaagttgggagatagaaatgctgcctggtatacgagagccagccacgtcccctatttgcntctcaagataagacgcgcctgaggactccctagaccgtaatttctcggacctccaacgtcgtacggaaccacacgaccactctacgaccatccgacggccggggacccacggaccccgaaacgggacgtacggaacggggaactaaccgttaacgttagtttacggtacgacgggtcgggtaagggaagtaaacgttacgttaagttacgggttaaggtttcggtttacggggcggggaacgggaccggagggtccgtacggtaacccggttccggtaacgggtaccaaccgggaccccgtaacgggtccccgttaccggtacccccccggttacggttaccccgtacccgttcccgttcccggtttacccccccgg

SEQ ID NO: 166400 - DNA, 736 bp, Homo sapiens
  misc_feature: GYAE6OF01ALAAH.26.71.G05.1.454.CMB.1.raw
  modified_base (203)..(203): a, c, t, g, unknown or other
  misc_feature (203)..(203): n is a, c, g, or t
  modified_base (238)..(238): a, c, t, g, unknown or other
  misc_feature (238)..(238): n is a, c, g, or t
  modified_base (355)..(355): a, c, t, g, unknown or other
  misc_feature (355)..(355): n is a, c, g, or t
tcagagactatactcacgaccggtgctcgatttagtgtcgtcgcaagagagaggggggggccgtcgaggaagcagcatcggaggtgcctcagccatggcatggatccctctcttcctcggcgtccttgcttactgcacaggatccgtggccttcgatgagctgattcagccacctcagtcgtccgtcgtccccaggacagacncgccacatcacctgcctcggcagacaagttggganatagaatgactgctgtatacagagccaggccacgtcctagtttcggctactccttacaagataaggaacgccgggtccctagacgggtactcccgtacgtaaccgaacttttaccgnggtacccttacccgaaactccggttacgggaaaccctaacgacgtaccccgtaacgttccgttaacgaaacccgtaccttaccggaccgggtacccggggaccccacgggtaaccccggaacggtacggtacggaacggggaacgtaaccttacgttaacgttcggtaacgcgggtacgggtaggaacggtaacttacgttagttaggtcggtttacgggttagggaccgggtaagggtacccgacgggtaccgtacgggttaccccgtacggtaacgggttacccgacggtccccggtaaacgggtcccgttacccggacccccgtttcgaaccccgttccgtacccggtttccccgtttcccccggccccgtttacccg

SEQ ID NO: 166401 - DNA, 754 bp, Homo sapiens
  misc_feature: GYAE6OF01CS5BZ.26.71.G05.1.454.CMB.1.raw
  modified_base (177)..(177): a, c, t, g, unknown or other
  misc_feature (177)..(177): n is a, c, g, or t
  modified_base (241)..(241): a, c, t, g, unknown or other
  misc_feature (241)..(241): n is a, c, g, or t
tcagagactatactcacgaccggtgctcgatttagtgtcgtcgcaagagagaggggctgggcctcaggaagcagcatcggaggtgcctcagccatggcatggatccctctcttcctcggcgtccttgcttactgcacaggatccgtggccttcgatgagctgattcagcccaccctnagtgtcccgtgtccccaggacagacagcccaccatccacctgcctcggcagacaaagttggganatagaaatgctgcctggtacttaccagaggccaggccagtcccctatttggcatctaccaagataagaagccggaccctcgagggactcccgtgaccgtaatttccgtggccttaccgaacgttccgtacggggtaaaccacgaacgccctacttccgtacgaccctaagtccgaacgggtcccggggaccccacgggaccccgaaacgggacgtacgggaacggggtacgtaaccgttaaccgttaagtttcggtaccggtaagggtaccgggttaagggggaacgttaaacgttaaccgtttaaggttttacgggttaagggtttcgggtttacggggaccggggtacggggaaccgtacggggtaccgttaccgggtaaccccgggttaccgttaaccggggtaccgaacccgggtacccccgaaacggggttccccgttaccccgggtacccccccgttacccgggttacccgttaaccccgttcccgttcccgtttaacccccccccg

SEQ ID NO: 166402 - DNA, 758 bp, Homo sapiens
  misc_feature: GYAE6OF01CWU63.26.71.G05.1.454.CMB.1.raw
tcagagactatactcacgaccggtgctcgatttagtgtcgtcgcaagagagaggggtccatgccatggcatggatccctctcttcctcggcgtccttgcttactgcacaggatccgtggccttcgatgagctgattcagccaccctcagtgtccgtgtccccaggacagacagccaccatcacctgctcggcagacaagttggagatagaaatgctgcctggtactaccagacgccaggccacgtcccttagtttggtcatcttacaagataagaacgcggccctgaggactcccgtgaccgtaatttcgtcgcctaccaactcgtacggaaccacgacgaccactctacgaacccagtcgacgggcccggggcccctaacggaccgaaacgggagtagggaacgggtaacgtaacttaacgttagtttcggtaccgaagggtcgggtagggaacgttaaacgttaacgtttaggtttagggttagggttttaggtttacggggacggggtaacgggtaacccggtagggtacccggttacgggtaaaccccggttccggtttaacggggtacccgtaacccggaaccccggtaacgggtccccgttaccccgggtacccccccgttaccgggttacccctacccgttccccgtttcccggtttcccccccgtacccccgttaccccgttcgtaaccggtttacgtttaccggttacccttaccggttacgggtaccgggccgggtaccgtaccgggg

SEQ ID NO: 166403 - DNA, 543 bp, Homo sapiens
  misc_feature: GYAE6OF01AVBUX.26.71.G05.1.454.CMB.1.raw
  modified_base (295)..(295): a, c, t, g, unknown or other
  misc_feature (295)..(295): n is a, c, g, or t
tcagagactatactcacgaccggtgctcgatttagtgtcgtcgcaagagagaggggggactcctgtgccccaccatggacacgctttgctccacgctcctgctgctgaccatcccttcatgggtcttgtcccagatcaccttgaaggagtctggtcctgcgctggtggagcccacgcagaccctcacgctgacctgctccgtctctggattctcactcaccacgactgaggtgaatgtggcctgggtccgtcacggcccccggaaaggccctggagtggcttgcactcatttacnggagtgatctcaagcggtacaatccgtctctgagaatcgactcaccatcaccagggaccacctccaaacgaccgggtcggtaccttacaatgaccgacatgaatccctagtcgacacgaggcacatattactgtgcacacagtcctagcgctacgacgaagaaagatatagacttagttcgggacgagggtaattttcgggactaacccggttcctacccccagccccttcccgaacccgtaaccggg

SEQ ID NO: 166404 - DNA, 573 bp, Homo sapiens
  misc_feature: GYAE6OF01BOKH5.26.71.G05.1.454.CMB.1.raw
  modified_base (400)..(400): a, c, t, g, unknown or other
  misc_feature (400)..(400): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtccccctattttggtcatcttccaagataagagcggccctcagggactcctgaccgattctggctccaactctagggaacacacgcccactctcgaccatccacggccggggcccaggcccaaacggntaggagggagactactattgtcgaggtcgtagggagaatacgtagttgtagtggtttgggcgggtagggaccgaggcgtcggaccgttccgtacggttccgacggacccgaagggtccctaccggccccccgtcgggtccacttcccgtccggttcccccgccccgttccccg

SEQ ID NO: 166405 - DNA, 580 bp, Homo sapiens
  misc_feature: GYAE6OF01DO2KI.26.71.G05.1.454.CMB.1.raw
  modified_base (239)..(239): a, c, t, g, unknown or other
  misc_feature (239)..(239): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtcgtccgtcgtccccaggacagacagccaccatcacctgctcggcagacaaagttggganatagaaatgctgcctggtataccagaggccaggccagtccccttatttcggtcatcttaccaagataagacgcggcctcagggactccctagaccgtaatttctcggcctaccaactcgtcggaacacacgccactctcgaccacgtcacggccggggccccaaggcccgaacggacgtaggacgggacgaactacgttagtcgtacgagggcggtagggaagtaattactagttagtaggttggttaggcgggagggaccgaggcgtggacccgtcgtacggtacacggtcccgaacggccttaccggccccctacggcctaccgtcgtccggttccccg

SEQ ID NO: 166406 - DNA, 707 bp, Homo sapiens
  misc_feature: GYAE6OF01CV924.26.71.G05.1.454.CMB.1.raw
  modified_base (232)..(232): a, c, t, g, unknown or other
  misc_feature (232)..(232): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccacctcagtgtccgtgtcccaggcagacagccaccatcatctgctcggcagaactaagtggganatagaatgactgccttagtacttaccagacgccaggccacgttccccttagttttcggtcatcttaccaagtataagaacgccgtcctacgagggactccgtacgaccgtatttcgacggtctaccaactcgtacggaacacacgccactcgtacgaccacgtcgaacggccgggacccacgacccgaaacggacgtagggaacgggacgtaactaacgtacgttacgtacgaacgggtcggtacgggtaagtaacgttaacgttaaggtttacggttaagggtttcgggttttacggggaccggggtaacggggtaccgtacggggtaccggttaccgggtaacccgggttcccggtaacgggttacccgaacccgggtacccggtaaacggggtccccgttaccccgggtaccccgttacccggttacccttaaccggttccccggtttacccggttccccccggtacccccg

SEQ ID NO: 166407 - DNA, 520 bp, Homo sapiens
  misc_feature: GYAE6OF01EYKGD.26.71.G05.1.454.CMB.1.raw
  modified_base (512)..(512): a, c, t, g, unknown or other
  misc_feature (512)..(512): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctatttggtcatctccaagataagaagcggccctcagggatccctgaccgaatttctggctccaactctagggaacacagccactctgaccatcagccgggcccagccaacggatggagggagactactatgtcgaggcgtgggagaatactagttgtagtgtttggcggaggaccaggctgaccgtcgtaggtcgacgcccgaaggcctcgccccctcggtccactcctcgttccccncccgtccc

SEQ ID NO: 166408 - DNA, 793 bp, Homo sapiens
  misc_feature: GYAE6OF01C5DJS.26.71.G05.1.454.CMB.1.raw
  modified_base (232)..(232): a, c, t, g, unknown or other
  misc_feature (232)..(232): n is a, c, g, or t
tcagagactatactcacgaccggtgctcgatttagtgtcgtcgcaagagagagggggcctcaggaagcagcatcggaggtgcctcagccatggcatggatccctctcttcctcggcatccttgcttactgcacaggatccgtggccttcgatgagctgattcagccaccctcagtcgtccgtgtccccaggacagacagccacatcacctgctacggcagacaagttggganatagaatcgctcgccttaggtacttaccgaggacggaccacggcctacgttccccttaagttttcggtactactccttaccaaagtactaaacgaacgtccggacccttacggacgggtacctacccgtaggaacccgttaagtttccgtacggtaccttaacccgaacgttccggtaaacgggaaccctaacgaccggtccctaaccttcgtaccgaaccgtacgttaccggaaccgggaccccggggaccccgaaggacccccgtaaacgggtacgttaacggggaacgggtaacgttacccgttaaacgttacgttacgtacgggaacgggtaccgggttaagggtaaacgtaactttacggtaacggttttagggttaacgtttcggggtttaacgggaccggggtaaccgggtaacgtaccgggtaccttaccggggaaacccgtttcggtaacgggttcccgaacggttaccccgggacgggtaccccttcccgggacccccccgttaggttacccccgtagttccccgttccccgggtttacccccttaccccg

SEQ ID NO: 166409 - DNA, 756 bp, Homo sapiens
  misc_feature: GYAE6OF01BEPLI.26.71.G05.1.454.CMB.1.raw
  modified_base (233)..(233): a, c, t, g, unknown or other
  misc_feature (233)..(233): n is a, c, g, or t
  modified_base (333)..(333): a, c, t, g, unknown or other
  misc_feature (333)..(333): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtataccagaggccaggccagtcccctatttggtcatcttccaagataagagccggccctcgaggactccctgaccgtatttcnggtcctaccaactcgtagggaaccacgacgccactctacgaccatcgacggcccggggacccacggaccccgaaacgggacgtacgggaacggggtaacgtaaccgttaacgttacgtttacggtaccgaacggggtaccgggtaagggggtaacgttaaaacgtttaaccggtttaacgttttagggtttaaacgggtttcggggtttttacggggaaccgggggttaacggggtaaccccggtaaggggtacccgttacgggtaaccccggtttacccggttaacggggttacccgaaaccgggtaccccccggtaaacggggtccccgttacccgggtaccccccccggttaccgggttacccctaccccggtttaccccggtttccccggtttcccccccgtaacccccgtttaccccg

SEQ ID NO: 166410 - DNA, 799 bp, Homo sapiens
  misc_feature: GYAE6OF01D6HUY.26.71.G05.1.454.CMB.1.raw
  modified_base (235)..(235): a, c, t, g, unknown or other
  misc_feature (235)..(235): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcctaccttagtcgtccgtcgtccccaggacagacacgccacatcactgctcgcagacaagtggganatagaatgctgcctaggtactaccgaggacggccaggccctacggttccccttagttttcggactattccttaccaaagtaataaacggaacggtcccggacccttacggaacgggtacctaccccgtacggtaaccggttaaattttccggtacgggtacccttaaccgtaaaccttcggtaacgggaaaccacgaaccgtaccctaacttcgtaccgaaccgacgtaccggacgggacccggggacccaacggacccggaaacgggtagtacgggaacggggtaactaaccgttaacgttaacgtttacggtacggtaacggggtaccggttaaggggtaaacgttaaacgttaaccgtttaacggtttagggttaacggggtttacgggttttacggggaacggggtaacgggtacccgtaggggttaccggtaacccgggtacccggttaccggttacgggtaccgtaaccggaccccggtaaacgggtccccgttaccccggacccccggtttacggtaccctaaccgtttcccgttaaccccggtccccctaaccccg

SEQ ID NO: 166411 - DNA, 799 bp, Homo sapiens
  misc_feature: GYAE6OF01CKIEN.26.71.G05.1.454.CMB.1.raw
  modified_base (234)..(234): a, c, t, g, unknown or other
  misc_feature (234)..(234): n is a, c, g, or t
tcagagactatactcacgaccggtgctcgatttagtgtcgtcgcaagagagaggggctgggcctcaagaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaagtgganatagaatgctagcctggtattaccgagacggccacggccaacgttccccctagtttttcggctacgttcttaccaagtaataacgaagccggaccctagacgggactcccgtacgaccgtaacgtttcgtacggtcctacccgaaacttccgtagggaaccaccgacgtccccgtaactccgttacgaacctacgtaccgacgggaccccgggggacccccaacggaccccggaaacgggtaacgtagggaaccggggtaacgtaaccgttaaccgttaaggtttaccgggtaccgtaagggtaaggtaggggtaaacgttaaagttaaccggttagtttagggtttacggttagggtttttaggggaacccggggtacggggtacccgtaggggtacccgttaacgggtaaccccggttaccggttaacggggttacccctaaacgggtccccccggtaaaaacggggtcccccgtttacccccggggtaccccccccgttttcccggggttaaacccttacccccgttttccccgggttccccgttttaacccccccccccgg

SEQ ID NO: 166412 - DNA, 528 bp, Homo sapiens
  misc_feature: GYAE6OF01ENHRU.26.71.G05.1.454.CMB.1.raw
  modified_base (232)..(232): a, c, t, g, unknown or other
  misc_feature (232)..(232): n is a, c, g, or t
  modified_base (422)..(422): a, c, t, g, unknown or other
  misc_feature (422)..(422): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccacatcacctgctcggcagacaaattggganatagaaatgctgcctggtattaccagagccaggccagtcccctatttggtcatcttccaagataagaagcggcctcgagggatcccgtgaccgaatttctggctccaactctgggaacacagccactctgaccatccgagccgggcccagccgaacggatggaggagactactattgtcaggcgtagganaatactattgtagtgttgcggaggacgaggctgacccgtcgtaggtcgacgcccaaggcctcgtacccccgtcggtccaccgtcctacgttccccgacccttcccg

SEQ ID NO: 166413 - DNA, 573 bp, Homo sapiens
  misc_feature: GYAE6OF01B0668.26.71.G05.1.454.CMB.1.raw
  modified_base (236)..(236): a, c, t, g, unknown or other
  misc_feature (236)..(236): n is a, c, g, or t
  modified_base (553)..(553): a, c, t, g, unknown or other
  misc_feature (553)..(553): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccacctcagtgtccgtgtccccaggacagacagccaccatcacctgctcggcagacaaagtggganatagaaatgctgcctggtataccagaggccaggccagtcccctatttgcatctcaagataagaagcggccctcgaggactccctagaccgtaatttctggcctaccaactcgtaggaaccacacgccactctagaccatcacggccgggcccagacccgaacggagtgagggagaactacgtattgtacagggtcggtagggagaacgtaactagtttagtagttggtttagggcgggtagggacctagggcgtacggacccggttaccgtagggtccacggcccgaacggtctacccgtccccccgtcggtacccnccttccgtccgttccccccg

SEQ ID NO: 166414 - DNA, 694 bp, Homo sapiens
  misc_feature: GYAE6OF01CKG66.26.71.G05.1.454.CMB.1.raw
  modified_base (173)..(173): a, c, t, g, unknown or other
  misc_feature (173)..(173): n is a, c, g, or t
  modified_base (237)..(237): a, c, t, g, unknown or other
  misc_feature (237)..(237): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagcccaccctnagtcgtccgtgtccccaggacagacagccaccatccacctgcctcggcagactaagttgggaanatagaaatgactgcctggtaataccgagacggccaggccacgtccccttagttttcggactactcttaccgaaagtagtaaacgacggccggtacccctaggacgggtacctacccgtacggtaaccgttaactttccgtcgggtccttaacccgaacttccgtaacgggaaacctacgacgaccctacgtctacgacctagtccgacggcccggggacccacggacccgaaacggagtacggaacgggacgtactacgttaacgtgtaccgaggtcgtaggtaagtaataacgttagttacggtttaggtcggttagggacggtaacggtaccgacgggtccgtacggtacccgtaccggtacggtccgaccggacccggtacggtcccgtaccccggtacccccgttcggtaccctacccggttacccgttcccgttcccccgccccgtttaccg

SEQ ID NO: 166415 - DNA, 698 bp, Homo sapiens
  misc_feature: GYAE6OF01CYG4P.26.71.G05.1.454.CMB.1.raw
  modified_base (178)..(178): a, c, t, g, unknown or other
  misc_feature (178)..(178): n is a, c, g, or t
  modified_base (237)..(237): a, c, t, g, unknown or other
  misc_feature (237)..(237): n is a, c, g, or t
  modified_base (336)..(336): a, c, t, g, unknown or other
  misc_feature (336)..(336): n is a, c, g, or t
  modified_base (357)..(357): a, c, t, g, unknown or other
  misc_feature (357)..(357): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccttggccttcgatgagctgattcagcccaccctnagtgtccgtgtccccaggacagacagccaccatcacctgctcggcagacaaagtggganatagaatgctgcctggtacttaccagaggccaggccagttcccctattttggcatctaccaagataagaacgcgcctcgaggctcctagactaatttcnggtcctccaactcgaggaacncacgccactcacgacctatccgacggaccgggaaccccaaaccgaaacgggtactaggaaacgggtactaaccgttaacgttacgtttacggacgtacgggtacggtaggggtaaacgtaacgttaacttaggtttacggtttagggttgggttttacggggacggggtaacggggtacccggtaagggtcccgttaccgggtaaccccggttccggttaaccgggttacccgaaaccgggtacccccgtaaacggggtcccccgttaccccgggacccccccgtttacgggtacccctaacccgttccccgttcccgggtttacccccctaaccccccgg

SEQ ID NO: 166416 - DNA, 657 bp, Homo sapiens
  misc_feature: GYAE6OF01COWVC.26.71.G05.1.454.CMB.1.raw
  modified_base (232)..(232): a, c, t, g, unknown or other
  misc_feature (232)..(232): n is a, c, g, or t
  modified_base (239)..(239): a, c, t, g, unknown or other
  misc_feature (239)..(239): n is a, c, g, or t
  modified_base (307)..(307): a, c, t, g, unknown or other
  misc_feature (307)..(307): n is a, c, g, or t
  modified_base (312)..(312): a, c, t, g, unknown or other
  misc_feature (312)..(312): n is a, c, g, or t
  modified_base (317)..(317): a, c, t, g, unknown or other
  misc_feature (317)..(317): n is a, c, g, or t
  modified_base (327)..(327): a, c, t, g, unknown or other
  misc_feature (327)..(327): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacacgccaccatcacctgctcggcagacaaagtggganatagaangctgcctggtattaccgagaggccaggccagtcccctatttggtctatctacaagataagagcgcctnacggntccgngacgtattcncgactccaactcgtaggaacacgagccactcacgaccatcgacggccgggacccacgaccgaaacggagtacggaagggaacgtacgttaacgtacgttacggtacgacgggtacggtagggtaacgtaaagttaacgttagtttagggttaacggtttgggtttacggggaccggggtaacgggtaacccggtagggtacccgttaccggtacccggttaccggtaacggtaccggaaccggtacccgaacggggtcccgtcccgggtcccccccgttcggtaccctacccggttccctttcccggttcccccgtccccgttaccccgg

SEQ ID NO: 166417 - DNA, 680 bp, Homo sapiens
  misc_feature: GYAE6OF01EAUA5.26.71.G05.1.454.CMB.1.raw
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaagttggagatagaaatgctgcctggattaccagaggccaggccagtcccctattttggcatcttccaagataagaacgcggccctcgagggactccctgaccgtaatttctggctccaactctagggaacacagccactctagaccatcacggccggggacccaggacccgaaacgggtagtacgggaacggggtaacgaaccttaacgttagtttacggtacgtacgggaccgggttaggggaagtaaacgttacgttaacgtttaggtttaaggttacgggtttttggggaccggggttaaggggaccctaggggtccgttacggtaaccccggttccgtaacggggtaccgaccggtaccccgaaacgggtccccgtacccggtacccccccgttacgggtccctaacccgttcccgttacccggtttccccccaaccccgtttacccccg

SEQ ID NO: 166418 - DNA, 608 bp, Homo sapiens
  misc_feature: GYAE6OF01CA4QK.26.71.G05.1.454.CMB.1.raw
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtccccctattttcggtcatcttccaagataaagaagcggccctcagggactccctgaccgaatttctggctcactctcgggaacacagccactctacgaccatccgaggccgggcccacgcccgaacggagtaggacgggagactacgtattgtcaggcggtaggagaagtacgtagttaggtagttggtttgggcgggtaagggaccgagggtccgtacggtaccggttcccgtaagggtccgacggtaccccgaaagggtcccgtcccggtaccccccgttccgggtaccctacccggttccgttacccggttcccccgtcccccgttacccccg

SEQ ID NO: 166419 - DNA, 551 bp, Homo sapiens
  misc_feature: GYAE6OF01AH2N7.26.71.G05.1.454.CMB.1.raw
  modified_base (412)..(412): a, c, t, g, unknown or other
  misc_feature (412)..(412): n is a, c, g, or t
tcagagactatactcacgaccggtgctcgatttagtgtcgtcgcaagagagaggggggactcctgtgccccaccatggacacgctttgctccacgctcctgctgctgaccatcccttcatgggtcttgtcccagatcaccttgaaggagtctggtcctgcgctggtggagcccacgcagaccctcacgctgacctgctccgtctctggattctcactcaccacgactgaggtgaatgtggcctgggtccgtcaggcccccggaaaggccctggagtggcttgcactcatttactggagtgatctcaagcggtacaatccgtctctgaggaatcgactcacatcaccagggacacctccaaaggccggtgtccttacaatcgaccgacatgaactcctgtcggacacaggcanactattactgtgcacacacgtcctagccgctacggacgaagaaaagactagtagacctagttcggggacctaaggggtacttttcgggtacctacccggttccttacccccgagtcccctcccgaacccgtaacccggg

SEQ ID NO: 166420 - DNA, 620 bp, Homo sapiens
  misc_feature: GYAE6OF01A7LUJ.26.71.G05.1.454.CMB.1.raw
  modified_base (237)..(237): a, c, t, g, unknown or other
  misc_feature (237)..(237): n is a, c, g, or t
  modified_base (348)..(348): a, c, t, g, unknown or other
  misc_feature (348)..(348): n is a, c, g, or t
tcagagactatactcacgaccggtgctcgatttagtgtcgtcgcaagagagaggggcgtggcctcaggaagcagcatcggaggtgcctcagccatggcatggatccctctcttcctcggcgtccttgcttactgcacaggatccgtggccttcgatgagctgattcagcccaccctcagtgtccgtgtccccaggacagacagccaccatcacctgctcggcagacaaagttggganatagaatgctgcctggtactaccagacgccaggccacgtcccctattttggtctatcttaccaagataaggaagtccggccctgagggactcccgtagaccgtaatttcgnggcctaccgaactcgtaggaacacgacgccactctacgaccagtcgacggccggggaccccaggacccgaacggagtaggacgggaacgaaccttactagttcgacgtacgggcggtagggaataaagttacgttagttgggttaaggttcggtttagggaccgggaggtaccggtacggtcggtaccggtacccgttacggtacggtccaaccggtcccgaacgcccgtcccgtccccgtacgggtcctaccgttccgtccgtaccccccg

SEQ ID NO: 166421 - DNA, 691 bp, Homo sapiens
  misc_feature: GYAE6OF01CCYH8.26.71.G05.1.454.CMB.1.raw
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcgcagacaaattggagatagaaatgctgcctggtataccagagccagccagtcccctatttcggtcatcttccaagtactaagaacgcggccctgacgggactcccgtagaccgtaatttcgcggtctaccaacgtctcgggaaccacgacgcccaacttccgtagtaacccacgttaccgacggcccgggggaccccctaacggaccccgtaaaccgggacgttacgggaacggggacgtaaccttaacgtacgttttacggtacgaacgggtcgggttacggggaagtaaacgttacgttaagttagggtttaagttgggtttacgggacgggtacgggtaacccgtagggaccgtaccggtaacccggttcccgtaacgggttacccgaacggaccccggaacggtcccgttacccgggccccccttaccgggttaccacccgtttccggttcccgtttaaccccccccg

SEQ ID NO: 166422 - DNA, 802 bp, Homo sapiens
  misc_feature: GYAE6OF01BA6V2.26.71.G05.1.454.CMB.1.raw
  modified_base (179)..(179): a, c, t, g, unknown or other
  misc_feature (179)..(179): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccaccctgngtcgtccgtccgtcccgagacacgacacgaccaccactaccaccgtcgccgtccggacaacgaacgtaaaggttgggaataagtaagaaagtcgtactcggtaccgttaggtaacttaaccgaaggacggaccgacggtacccgtaccgttacccctttagtttcggtactacttccgttaaccaaagtaacgtaaaacggacgtccccggtacccctacggaaacgggtacccttccccggtaacggtaacccgtttagttttacccgtacgggtaccctaaccgtaaccgttcggtaaacggggaacccaacgtaccgtaccctaacgttccgtacgaaccctagtcccggaaccgggccccggggtaaccaacgggtaccccgaaagggacgtacggggaacggtaacgtaaccttagttacgtcgacggacggtcggtaagggtaagttaacgttagttagtttacggtaggtttacgggttacgggacgggaggtacccgtagggtaccgtacgggtaacccggttacggtaccgggactaacccggacccgggtaggttccccgtccccggtaccccgttcggtaacccttcccgttccgtaccccggttacccccc

SEQ ID NO: 166423 - DNA, 740 bp, Homo sapiens
  misc_feature: GYAE6OF01DTI3V.26.71.G05.1.454.CMB.1.raw
  modified_base (241)..(241): a, c, t, g, unknown or other
  misc_feature (241)..(241): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccaccctcagtcgtccgtgtccccaggacagacacgccaccatcacctgctcgacagaactaaagtggganatagaaatgctgcctaggtactaccgaggacggccacggcctacgttcccctttagttttcggtctacttccttaccaaagtaataacgaacggccggcccctacggacgggtacctcccgtacggtaaccgttaactttccgtacgggtaccctaccgtaactcgtaacgggaaaccaccgacgccctacttccgtacgaaccacgtaccggaccgggcccggggaccccaacgggtaaccccgaaacgggtacgtacggggaacgggacgtaaccgttacgttaacgttcggtaccggtacgggtacgggttaagggaattaacgttacgttaggttgggttaggttgggtttacgggaccgggacgggtacccggtacggtccgtaccgggtaccgttaccggtacgggtaccgaccggtcccggtaacggtcccgtaccccgggtcccccggttacggtaccccttacccgtcccggttccccggttaccccccg

SEQ ID NO: 166424 - DNA, 658 bp, Homo sapiens
  misc_feature: GYAE6OF01BMC29.26.71.G05.1.454.CMB.1.raw
  modified_base (230)..(230): a, c, t, g, unknown or other
  misc_feature (230)..(230): n is a, c, g, or t
  modified_base (309)..(309): a, c, t, g, unknown or other
  misc_feature (309)..(309): n is a, c, g, or t
  modified_base (323)..(323): a, c, t, g, unknown or other
  misc_feature (323)..(323): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaatgganatagaatgctgcctggtataccagagccaggccagtcccctatttgtctatctccaagataagagcgcctgaggatccngaccgtaatttcgngctccaactcgtacggaacacgagcccactctagaccatcgacggccggggccccagaccgaaccgggatacggaagggacgaactacgtaacgttcggtacgagggtccggttaggggaacgtaaacgtaacgttaagtttaggttaaggtttgggttttacggggaccggggtaaggggtacccgaggggtaccgttacgggtacccggttacccggttaacggggtacccgaccggtaccccgaaacgggtcccttacccgggtaccccccccgtttcgggtaccctaccgttccccgtttcccggtttccccccgtcccccgttacccccg

SEQ ID NO: 166425 - DNA, 642 bp, Homo sapiens
  misc_feature: GYAE6OF01CDE9T.26.71.G05.1.454.CMB.1.raw
  modified_base (233)..(233): a, c, t, g, unknown or other
  misc_feature (233)..(233): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaattggganatagaatgctgcctggtattaccagaggccaggccagtcccctattttcggtcatcttaccaagataagaacgcggccctcgagggactcccgtgaccgtaatttctggctaccaactcgtacgggaacacgacgccactctacgaccatcgacggccgggacccacgccgaacggagtaggacgggaacgtacctacgtacgttgtacgagggcggtagggaagtaacgttacgttagtttaggttaggttgggtttacgggacgggtaacggggacctagggtaccgtacgggacccggttaccgtacgggtaccgacgggtaccccgaacgggcccgtacccggtcccccccgttacgggtcccgtaccgttccgttaccccgttcccccctaccccgttaccccg

SEQ ID NO: 166426 - DNA, 742 bp, Homo sapiens
  misc_feature: GYAE6OF01E24JD.26.71.G05.1.454.CMB.1.raw
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtcccccaggacagacacgccaccatcacctgctcggcagacaaagttgggagatagaaatgctgcctggtattaccagaggccaggccagtcccctatttggtcatcttccaagataagaacgcgcccctcagggactcccctaggacccgtaattttcctcggtcctaccctaaaccttccgtacgggaaccaaccgacgcccaacctcctacgaaccctaacgtaccgacggcccgggggaccccaacgggaccccgaaacggggaagttacgggaacggggtaagaacccgttaaccttagtttcggtaccgtacggggtcggttaggggaacgtaaagttaacgttatttacgggttaaggtttcgggttttacggggacggggacggggtaacccgtaacggggtccgtacgggtaacccggttacccgtaacggggtacccgaaccggtacccccgaaaggggtccccttacccgggtccccccccggttacccgggtaccctaacccgttcccggtttcccgtttacccccccgcccccgtttaccccgg

SEQ ID NO: 166427 - DNA, 689 bp, Homo sapiens
  misc_feature: GYAE6OF01BJ2WR.26.71.G05.1.454.CMB.1.raw
  modified_base (236)..(236): a, c, t, g, unknown or other
  misc_feature (236)..(236): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaatgctgcctggtattaccagagccgaggccacgtcccctagttttcggtctatcttacaagactaagaacgcgccctcgagggactccgtgaaccgtatttctggcctccaactcgtaggaacacgacgccactctacgaccatccgacggtccggggaccccaacggaccccgaaacgggacgtacgggaacggggaacgtaaccgttaacgttaagtttacggtaccgacgggtacgggtaggggtaacgtaaacgttaaccgttaaggtttacgggttaaggtttcgggttttacgggaccggggtaacggggtaccgacgggtccgtacggtaaccccggttacccgtacgggtacccacgggtaccccgtaaacgggtcccgttaccgggtacccccccgttcggggttaccctacccgtttccgtcccggtttacccccccg

SEQ ID NO: 166428 - DNA, 593 bp, Homo sapiens
  misc_feature: GYAE6OF01E4TVW.26.71.G05.1.454.CMB.1.raw
  modified_base (232)..(232): a, c, t, g, unknown or other
  misc_feature (232)..(232): n is a, c, g, or t
  modified_base (311)..(311): a, c, t, g, unknown or other
  misc_feature (311)..(311): n is a, c, g, or t
  modified_base (321)..(321): a, c, t, g, unknown or other
  misc_feature (321)..(321): n is a, c, g, or t
  modified_base (340)..(340): a, c, t, g, unknown or other
  misc_feature (340)..(340): n is a, c, g, or t
  modified_base (350)..(350): a, c, t, g, unknown or other
  misc_feature (350)..(350): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaagttggganatagaatgctgcctggtataccagagccaggccagtcccctatttggcatctacaagataagagcgcctgaggactccngaccatttcngctcaactctaggaacacncgaccactcncgaccatcgacgccggggacccaggaccgaacggataggagggacgtaactacgtagttcgtacgagggtcggtagggaagtaacttacgttagttaggttaggttggtttagggcgggtaacgggaccgagggtcgtacggtacccgtaccgtaacgggtccgacggacccgaacgggtccctaccggccccccgttcggtaccctaccttccgttcccgttcccccgaccccgtttacccg

SEQ ID NO: 166429 - DNA, 605 bp, Homo sapiens
  misc_feature: GYAE6OF01BIIDA.26.71.G05.1.454.CMB.1.raw
  modified_base (235)..(235): a, c, t, g, unknown or other
  misc_feature (235)..(235): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgganatagaaatgctgcctggtattaccagaggccaggccagtcccctatttggtcatcttccaagataagaagcggccctcagggactcccgtagacccgtaatttccgtggcctacccgaactcgtacgggaaccaccgagcccactctagacccatccacggccggggacccccagaccccgaacggagtggaagggacgacttacgtagttgtccgagggtcgtagggaagtaagtactagttggttagttgggtttaggcgggtagggaccgaggcgttacggaacccggtccgtaacgggtccacggccccgaaggtcccgtaccggtccccccgttacggtccaccgttccgttccgttaccccccg

SEQ ID NO: 166430 - DNA, 596 bp, Homo sapiens
  misc_feature: GYAE6OF01A7CY3.26.71.G05.1.454.CMB.1.raw
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccgagaggccaggccagtccccctatttggcatcttccaagataagagcgccctcagggactccgtgaccgtaatttctggctccaactctgggaacacagcccactctagaccatcgacggccgggcccacgaccgaacggagtaggagggacgactacgttagttgtacgaggtcgtagggagaagtacttaagttgttaggttggtttgggacgggtacgggaccgtaggccgtacggacccggttccgtaaggtccgaacgaccccgaaggccctacggtccccccgttcggtacccgtaccgttcccgttcccggttcccccgtccccgttacccg

SEQ ID NO: 166431 - DNA, 727 bp, Homo sapiens
  misc_feature: GYAE6OF01D0FYO.26.71.G05.1.454.CMB.1.raw
  modified_base (210)..(210): a, c, t, g, unknown or other
  misc_feature (210)..(210): n is a, c, g, or t
tcagagactatactcacgaccggtgctcgatttagtgtcgtcgcaagagagaggggtccatgccatggcatggatccctctcttcctcggcgtccttgcttactgcacaggatccgtggccttcgatgagctgattcagccaccctcagtcgtccgtcgtccccaggacagacacgccaccatcacctgctcggacagacaagttggganatagaatgcgtgcctaggtactacgaggacgcacggccacgttcccttagtttcggtctacttccttacgaagtaagtaagaacgccggcccgtacgacgggacttcccgtacgtaccgtaactttcgtcgcctacctaacgtcgtacggaacacacgcctactcgtacacacgtaccgacggccgggaccctacgaccgaacggtacgtagggacggtacgtaacttagttagttacggacggtacgggacggttagggaaactaaacgttcgttaaggtttaggttagggttcgttacgggggaccggtaaacggggccgttaagggtctaaccgggtaccccggtttaacggtaccgggtcccgtaaccgggtaaccccaggggttccccgtacccccgtccccggttaaggttccccaacccgttttccgggtccccgttcccccgtacccttaccgtacgaacgtttacgtaccgttctacgggttacggaccggcccgggttgaacccggg

SEQ ID NO: 166432 - DNA, 691 bp, Homo sapiens
  misc_feature: GYAE6OF01D1JML.26.71.G05.1.454.CMB.1.raw
  modified_base (233)..(233): a, c, t, g, unknown or other
  misc_feature (233)..(233): n is a, c, g, or t
  modified_base (346)..(346): a, c, t, g, unknown or other
  misc_feature (346)..(346): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaagtggganatagaaatgctgcctaggtattaaccgagacggccaggccctacgttccccttagtttggctattccttacgaagtaataagacgccgcctagaggctccgagacctattcgngcctaccactcgtaggaaccacgacgccactctacgacctagtcgacgggtcccgggacccaacggacccgaaacgggagtacgggaaacggggtactaaccgttacgttacgtttacggacgacggggttccggtaaggggtaacttaaacgttacgttaaggtttacggtttaagggttgggtttacggggacgggtaccgggaaccgagggtccggtaccggtaacccggtccggttaacggtaccgaacccgggtacccgtaaccgggtccgtcccccgggtacccccgttacggttacctaccccgttcgtttaccccgtccccccgtaccgttaccccg

SEQ ID NO: 166433 - DNA, 652 bp, Homo sapiens
  misc_feature: GYAE6OF01E3CAO.26.71.G05.1.454.CMB.1.raw
  modified_base (319)..(319): a, c, t, g, unknown or other
  misc_feature (319)..(319): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccaccctcagtgtccgtgtccccaggacagacagccaccatcacctgcctcggcagacaaagttgggagatagaaatgctgcctggtattaccagaggccaggccacgtcccctatttggtcatcttccaagataagaacgcggccctnacgggactcccgtgaccgtaattctcggcctaccaactcgtacggaacaccgacgcccactcctacgacctactcgacggccggggaccccacggacccaacgggagtacggagggaacgtactaacgtagtttcgtcgagggtacggtagggaacgtaacgttaacttagtttacggttaggtttggtttacggggacgggtaacgggtaccgtacgggtccgttacgggaacccggttccgtaacgggtaccgaaccgggtccccgaaacgggtcccgtacccggtccccccgttacggtacccacccgttccgtcccggttcccccccgg

SEQ ID NO: 166434 - DNA, 600 bp, Homo sapiens
  misc_feature: GYAE6OF01AIFL2.26.71.G05.1.454.CMB.1.raw
  modified_base (236)..(236): a, c, t, g, unknown or other
  misc_feature (236)..(236): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccgagaggccaggccacgtccccttagttttggcatcttccaagataagaagcggccctcagggactcccgtgaccgtaatttctggcctccaacgtcgtacgggaacaccgacgcccacttcctcgaacccactccgacggccgggggccccacgacccgaacggagtcggagggacgacgttactagttgtacgaggtcggtagggagtaagtacgtagtttaggtagttggtttaggacgggtagggaccgagggtcctacggtacccggtccgtacgggtcgacggccccgaaggcccgtccgtcccccggttggccctaccgttccgtcgttccccc

SEQ ID NO: 166435 - DNA, 533 bp, Homo sapiens
  misc_feature: GYAE6OF01BBROQ.26.71.G05.1.454.CMB.1.raw
  modified_base (342)..(342): a, c, t, g, unknown or other
  misc_feature (342)..(342): n is a, c, g, or t
  modified_base (435)..(435): a, c, t, g, unknown or other
  misc_feature (435)..(435): n is a, c, g, or t
  modified_base (483)..(483): a, c, t, g, unknown or other
  misc_feature (483)..(483): n is a, c, g, or t
  modified_base (525)..(525): a, c, t, g, unknown or other
  misc_feature (525)..(525): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtcccccaggacagacagccaccatcacctgctcggcagacaaattgggagatagaaatgctgcctggtattaccagaggccaggcccagtccccctattttggtcatcttccaagataagaagccggccctcgagggactcccgtgaaccgtatttcnggctccaactcgtggaacacacgccactctcgaccatcgacgccgggcccagcccaacggatggaggacgactactagttgcgaggcgtgganaatactagtgtagtgttggcggaggacgaggcgtgaccgtcctaggcncgcccaggcctcgcccccgtcggtccacctcgtccttccccncccgtccc

SEQ ID NO: 166436 - DNA, 672 bp, Homo sapiens
  misc_feature: GYAE6OF01CBQY9.26.71.G05.1.454.CMB.1.raw
  modified_base (183)..(183): a, c, t, g, unknown or other
  misc_feature (183)..(183): n is a, c, g, or t
tcagagactatactcacgaccggtgctcgatttagtgtcgtcgcaagagagaggggggactcctgtgccccaccatggacacgctttgctccacgctcctgctgctgaccatcccttcatggtcttgtcccagatcaccttgaaggagtctggtcctgcgctggtggagcccagcagaccctnacgctgacctgctccgtctctgattctcactcaccacgactgagtgaatgtggccgtggtccgtcgaggcccccggaaaggcccttggagtggcttgctactctatttacgtggtagtgatctacgaagcggtacaacgtccgtctctgagaatcgactcacatcaccgtaggacacctacaaacgaccggtgtaccttaacaacgtcgaaccgacagtacgaaactccgtgtacggaactacgaggaccaactaattacttacgtgtacgaccacaaccgacgttcccgtacggtccggtaccttaaccggacggtaaacggaaaaacgtaacgttaacgtaccggtaaaccgtttacgggttaccgggggtacccgttaaagggggttttaacgtttttccggggtaacccgttaaccccggttaccccgttaccccccgttaacggaccccccgttaaccccggaaaccccgggtaaaccccgggg

SEQ ID NO: 166437 - DNA, 555 bp, Homo sapiens
  misc_feature: GYAE6OF01DLZ7I.26.71.G05.1.454.CMB.1.raw
  modified_base (234)..(234): a, c, t, g, unknown or other
  misc_feature (234)..(234): n is a, c, g, or t
  modified_base (304)..(304): a, c, t, g, unknown or other
  misc_feature (304)..(304): n is a, c, g, or t
  modified_base (308)..(308): a, c, t, g, unknown or other
  misc_feature (308)..(308): n is a, c, g, or t
  modified_base (324)..(324): a, c, t, g, unknown or other
  misc_feature (324)..(324): n is a, c, g, or t
  modified_base (332)..(332): a, c, t, g, unknown or other
  misc_feature (332)..(332): n is a, c, g, or t
  modified_base (347)..(347): a, c, t, g, unknown or other
  misc_feature (347)..(347): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctatttggcatctcagatagagcgcctnaggntccgtgaccgaattcngccctacnctggacacacgaccnctctcgaccactcgacgcgggccgacgaccgaacggagtggagggacgactacgtatgtcgaggcgtgggagaatactagttgtagttaggtttggtcgggagggaccgaggtcgtcggtaccgtcgtacggtacgacggacccgaggaccgtccgacccccgtccgtccgtaccttaccgttccgttccccgcccgttcccgtaccg

SEQ ID NO: 166438 - DNA, 632 bp, Homo sapiens
  misc_feature: GYAE6OF01D1CHZ.26.71.G05.1.454.CMB.1.raw
  modified_base (235)..(235): a, c, t, g, unknown or other
  misc_feature (235)..(235): n is a, c, g, or t
  modified_base (332)..(332): a, c, t, g, unknown or other
  misc_feature (332)..(332): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgganatagaaatgctgctggtattaccagagccaggccagtcccctatttggtcatcttccaagataagaagcggcctcgaggatccctgaccgaatttcnggctccaactctaggaacacacgccactctacgaccatcaggccggggcccagacccgaacggataggaagggagactacgtatttcgacgtagggcggtagggaacgtaagtaacgttagttacggttaggtttggtttacgggacgggtacggggtaaccgacggggtaccgttaccggtacccggttacccgttaacggggtccaaccgggtacccccgtaaagggtccccgttacccggtccccccccgttacgggttaccctacccggttcccgttacccggtttccccccccgg

SEQ ID NO: 166439 - DNA, 814 bp, Homo sapiens
  misc_feature: GYAE6OF01DLNSZ.26.71.G05.1.454.CMB.1.raw
tcagagactatactcacgaccggtgctcgatttagtgtcgtcgcaagagagaggggtccatgccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccacgtccctatttggtcatcttaccaagataagaacgccggcctacgacgggactccctaggaccgtaaattttcgtggtcctaccctaacgttcgtacggggaaaccacgacgtacccacttaccgtacgaaccctacgtaccgaacgggacccggggggaccccaacgggaccccgtaaaaacggggaacgtaggggaaacggggtaacgtaaccgttaaacgtttaacgttcgggttaacgtaacgggggtcgggttaacgggggtaaagttaaaacgttaacgtttaaggttttacggttaagggtttgggttttacggggacggggtaacggggtaacccgtaacgggtccgttacgggtaaccccggttaccggttaacggggtccgtaaccggaccccggtaaacgggtccccgttaccggtacccccccggttacccgggttccctaccccggtttaccgttcccgggtttaccccccgttccccttaccccgttacccggtaacgttaccgttaccgggttcccttacggttacgggaacgggtcccggggtcgtaaccggggg

SEQ ID NO: 166440 - DNA, 689 bp, Homo sapiens
  misc_feature: GYAE6OF01DPMEK.26.71.G05.1.454.CMB.1.raw
  modified_base (238)..(238): a, c, t, g, unknown or other
  misc_feature (238)..(238): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatccacctgctcggcagacaaagttggganatagaatgactgcctggtattaccagacgccaggccagtccccttatttcggtcatcgttaccaagataagaagcggaccctcgagggactcccgtgaccgtaatttcgtggcctaccaactcgtacgggaacacgacgccactctacgaccatccgacggcccgggggaccccaacggtacccgaaacgggagtagggaacggggtacgtaaccgttaacgttagtttcggtaccggaacgggtcggtaggggaagtaaacgttacgttaagtttacggttaggtttacgggttttacggggaccgggtacggggtaacccgtaacgggtaccgttacgggaccccgttaccggtaaccgggttaccgaccggtacccccgaaagggtcccgttacccggtccccccgttacgggtaccctaacccgttcccgttccggttacccccccg

SEQ ID NO: 166441 - DNA, 637 bp, Homo sapiens
  misc_feature: GYAE6OF01ASRSI.26.71.G05.1.454.CMB.1.raw
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaatgctgcctggtattaccagaggccaggccagtcccctatttggtcatcttccaagataagaagcgccctgacggactcccgtagaccgtaatttctggctaccaactcgtacggaacacacgccactctgaccatcgacggccgggacccaggacccgaacggagtacggacgggaacgaaccgtaacgtagttcggtacgagggtaccggtagggaagtaacgttaacgtagtttaggttaggttggtttaggggccgggtaacggggaccgagggtaccgtacggtacccggttccgtaacgggtaccgacggaccccgaaacgggcccgtcccggtaccccccgttcggtaccctaccgttcccgttcccggttccccccgtccccgttacccg

SEQ ID NO: 166442 - DNA, 630 bp, Homo sapiens
  misc_feature: GYAE6OF01CZQUK.26.71.G05.1.454.CMB.1.raw
  modified_base (172)..(172): a, c, t, g, unknown or other
  misc_feature (172)..(172): n is a, c, g, or t
  modified_base (214)..(214): a, c, t, g, unknown or other
  misc_feature (214)..(214): n is a, c, g, or t
  modified_base (227)..(227): a, c, t, g, unknown or other
  misc_feature (227)..(227): n is a, c, g, or t
  modified_base (293)..(293): a, c, t, g, unknown or other
  misc_feature (293)..(293): n is a, c, g, or t
  modified_base (327)..(327): a, c, t, g, unknown or other
  misc_feature (327)..(327): n is a, c, g, or t
  modified_base (346)..(346): a, c, t, g, unknown or other
  misc_feature (346)..(346): n is a, c, g, or t
  modified_base (499)..(499): a, c, t, g, unknown or other
  misc_feature (499)..(499): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctnagtcgtccgtgtccccagacagacagccacatcactgctcgnagacaagtggganatagaatgctgcgtgtactaccgagacgccagccacgtcccttagtttcgactattctacaagtanaagacgccgcctacgaggctccgtagactattcngctacacgtcgacggaacngacgtcactctacgactagtccgacggcccggaccacggaccgaacggagtaacgacggacgtaactacgttagttcggacgtacggtacggtaggtaatacgttaacgttagttggttaggtttacgggtagggtaccggaacggggtaccngggtaccgtaagggttaccccgtaccgttacgggtaccgtacccgggacccgtaccggttcccgccccgttacccccgggtaggttaccctacccgtttcccgtacccgttccccccgaccgtttacccgg

SEQ ID NO: 166443 - DNA, 808 bp, Homo sapiens
  misc_feature: GYAE6OF01EQA5O.26.71.G05.1.454.CMB.1.raw
  modified_base (232)..(232): a, c, t, g, unknown or other
  misc_feature (232)..(232): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccacatcacctgctcggcagacaagtggganatagaatgctgctgtattaccagacggccaggccacgtccccttagtttggtctattccttaccaaagtaactaaaggaacggtccggaccctacgaacggggtacttaccccgtagtaacccgtaatttccgtacggtaccttacccgtaaaccgttccggtaacggggaaaccaaccgtaaccggtacccctaaccgttaccctacggtaaacccctaacggtacccgaaccggggaccccgggggtacccccaacggaccccgtaaacggggtacgtaacggggaacggggaacgtaaccgttaaccgttaggtttacggtacggaacgggtaccgggtaggggtaacgtaaagtttaaccttaaggtttacgggttaaggtttcgggtttacgggacgggggtaacgggtaccggacgggtaccgttacggtaaccccggttaccggttaaccgggttacccggaaccgggtacccccgtaaacggggtccccgttaccccggccccccggttacccgggtacctaaccccgttccggtttaccccggtttcccccggtccccgttaccccg

SEQ ID NO: 166444 - DNA, 695 bp, Homo sapiens
  misc_feature: GYAE6OF01A3WVI.26.71.G05.1.454.CMB.1.raw
  modified_base (175)..(175): a, c, t, g, unknown or other
  misc_feature (175)..(175): n is a, c, g, or t
  modified_base (239)..(239): a, c, t, g, unknown or other
  misc_feature (239)..(239): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctnagtcgtccgtgtcccccaggacagacacgcccaccatccacctgctcggcagacaagttggganatagaatgctgcctggtacttaccgaggacggccaggccctacgttcccccttagttttcggctacttccttaccaagtaataaggacggccggccctacgacgggtactaccccgtaggaacccgttaatttcgcggtcctaccctaacgtcgtacgggaaccacgacgaccctactctacgaaccctacgtaccggacgggtcccggggacccacggaccccggaaacgggtaggtacgggaacgggaactaccgttaacgttgttacggtacggtagggtaccggtagggaacgtaacgttaacgtttagttagggtaacggtttgggtttacggggacgggtacggggacctagggcctacggtacccgttcgacggtaccgacgacccggtacggtcccgtcccggtcccccgtcggtcctaccgttcccgtccttccccgtaccctcccg

SEQ ID NO: 166445 - DNA, 677 bp, Homo sapiens
  misc_feature: GYAE6OF01DE73I.26.71.G05.1.454.CMB.1.raw
  modified_base (235)..(235): a, c, t, g, unknown or other
  misc_feature (235)..(235): n is a, c, g, or t
  modified_base (312)..(312): a, c, t, g, unknown or other
  misc_feature (312)..(312): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtcgtccgtgtccccaggacagacagccacatccacctgctcggcagacaattgganatagaatgctgcctggtataccagacgcaggccacgtcccctatttcggctatctaccaagataagacgtcgccctnacgggactcctgaccgtaatttcgtcggactaccaactcgtaggaacacacgccactctacgaccatccgacggccgggcccagacccgaacgggagtacggaagggactaacgtacgttacgttaggtccgaagggtcggtaggggtaacgtaaacgtttacgttaacgtttacgggttaggttagggttttacggggacggggtaacggacccggtacgggtccgttaccgggtacccggttaccggttaacggggtaccctaaccgggtacccccgtaacggggtccccttaccccggggtacccccccgtttacgggtaccccgttaacccgttcccgtttaccccggtttaccccccccg

SEQ ID NO: 166446 - DNA, 536 bp, Homo sapiens
  misc_feature: GYAE6OF01DPRRD.26.71.G05.1.454.CMB.1.raw
  modified_base (319)..(319): a, c, t, g, unknown or other
  misc_feature (319)..(319): n is a, c, g, or t
  modified_base (330)..(330): a, c, t, g, unknown or other
  misc_feature (330)..(330): n is a, c, g, or t
  modified_base (406)..(406): a, c, t, g, unknown or other
  misc_feature (406)..(406): n is a, c, g, or t
  modified_base (428)..(428): a, c, t, g, unknown or other
  misc_feature (428)..(428): n is a, c, g, or t
  modified_base (460)..(460): a, c, t, g, unknown or other
  misc_feature (460)..(460): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaagttgggagatagaaatgctgcctggtattaccagaggccaggccagtcccctatttggtcatcttccaagataagagcgcctgaggactccngaccaatttcnggctccaactcgtagggaacacacgccactctacgaccatcgacggccggggcccaagccaacggatggaaggganactatagttcgcaggcgtgganaatactattgtagttgttggacggaggaccgnggctcgaccgtccgtaggtcgacgcccgaggcctccgcccccgtcggtccacgtcctccgttccccgcccttcccg

SEQ ID NO: 166447 - DNA, 677 bp, Homo sapiens
  misc_feature: GYAE6OF01AN98S.26.71.G05.1.454.CMB.1.raw
  modified_base (235)..(235): a, c, t, g, unknown or other
  misc_feature (235)..(235): n is a, c, g, or t
tcagagactatactcacgaccggtgctcgatttagtgtcgtcgcaagagagaggggggactcctgtgccccaccatggacacgctttgctccacgctcctgctgctgaccatcccttcatgggtcttgtcccagatcaccttgaaggagtctggtcctgcgctggtggacgcccacgcacgaccctcacgctgacctgctccgtctctggattctcactcaccacgactgaggtnaatggtcggtccgtgggtcccgtcgaccgggacccccggaaaggcccgtggagtcggtcttcggctactctacgttttacgtggagtcgtactcgtacgaacggtaccggtaactaacgttcccgtctcgtaggtaacggtacgtaccgtacctaccgtaaccactaccgaaccggaacggaccaacccgtaaccgaaacgggtccgggttacggtacccttaacgaagtaccggaaccgaacatacgaacttccggtagtacgaactacgagaccaactaattacgttacgtcgtacaaccactactacggtaccgacgtccgaacgtacgacgaaagaaaagtatacgtacgtaacgtagggttcgggaacgtaagggttacgtttccggtaccgtacccgtccctacccgaccgtccctaacccgacccggtaacccgg

SEQ ID NO: 166448 - DNA, 674 bp, Homo sapiens
  misc_feature: GYAE6OF01B2FZA.26.71.G05.1.454.CMB.1.raw
  modified_base (236)..(236): a, c, t, g, unknown or other
  misc_feature (236)..(236): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccaccctcagtgtccgtgtccccaggacagacagccaccatcacctgctcggcagacaaatggganatagaaatgctgcctggtattaccagaggccaggccagtcccctagttttcggtctatcttccaagataagaagcggccctgaggactcccgtgaccgtaatttcgtggcctaccaactcgtaggaaccacacgcctaacctctacgacccacgtccgacggccggggaccccaacggacccgaaacgggagtacgggaacgggacgaaccgttaacgtagttacggtacgtaacgggtcggtaggggaagtaattaacgttaagtttgggttaaggttgggttttcgggacggggtacgggtaccggacgggtccgtacgggtaacccggttaccggtacgggttacccggaaccggaccccggtaacgggtcccgtcccgggtcccccccgttacgggtaccctaacccgttcccggttcccggtttcccccccgg

SEQ ID NO: 166449 - DNA, 809 bp, Homo sapiens
  misc_feature: GYAE6OF01DLPW2.26.71.G05.1.454.CMB.1.raw
  modified_base (237)..(237): a, c, t, g, unknown or other
  misc_feature (237)..(237): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagcccaccctcagtgtccgtcgtccccaggacagaccagccaccatccacctgctcggcagaacaagttgggaanatagaaatgctgcctggtactacgagacggccacggcctacgttccccttagttttcggtacctagttccttaccaaagtaagtaaacggaacggcccggccctacggaacggggtaccttccccgtacggtaaacccgttaagttttccgtacgggtaccctttaaccccgaaaccgtttccggtaaacggggtaaaacccaaccgtaaccggcccctaaccttaccgttaccgaaacccgtaacgttacccggaaccggggccccgggggaacccccaacgggaccccggaaaccggggtagttacgggaacgggtaacgtaaccgttaacgttagttaccggtacgtacgggtcgggtaacgggtaacgtaaacgttaacgttaagtttaggttaacgggtttgggtttacgggacggggtacgggtaaccgtacgggtaccgttaccggtaccccgttccggtacggtacccgaacgggtaccccctaacgggtccccgtacccggtccccccgttacgggtacccctaccgttcccgttacccggtttccccccgccccgttacccg

SEQ ID NO: 166450 - DNA, 612 bp, Homo sapiens
  misc_feature: GYAE6OF01DAHXR.26.71.G05.1.454.CMB.1.raw
tcagagactatactcacgaccggtgctcgatttagtgtcgtcgcaagagagaggggggactcctgtgccccaccatggacacgctttgctccacgctcctgctgctgaccatcccttcatgggtcttgtcccagatcaccttgaaggagtctggtcctgcgctggtggagcccacgcagaccctcacgctgacctgctccgtctctggattctcactcaccacgactgaggtgaatgtggctgggtccgtcacggccccggaaaggccctggagtggcttgcactcatttactggagtgatctcaagcggtacaatccgtctcgtgaggaatcgactcaccatcacgacggacacctcaaagccggtgtacctacagtcgaaccgacatgaactcctgacggacacgacggcactatatttactgtacgccaacgaacacgttacccgtagccggtacttaccggacgtaagaaaaagtaacgttaagtacgtaacgttagggttaccgggggaccgtaaaggggtttaactttttaccggggtacccttaaaccccggttcccgttaaccccccgagttccccctacccgaaaccccggtaaaccccgggg

SEQ ID NO: 166451 - DNA, 757 bp, Homo sapiens
  misc_feature: GYAE6OF01BYFG8.26.71.G05.1.454.CMB.1.raw
  modified_base (177)..(177): a, c, t, g, unknown or other
  misc_feature (177)..(177): n is a, c, g, or t
  modified_base (439)..(439): a, c, t, g, unknown or other
  misc_feature (439)..(439): n is a, c, g, or t
tcagagactatactcacgaccggtgctcgatttagtgtcgtcgcaagagagagggggctgggcctcaggaagcagcatcggaggtgcctcagccatggcatggatccctctcttcctcggctccttgcttactgcacaggatccgtggccttcgatgagctgattcagcccaccctnagtgtccgtcgcccaggacagacagccacatccacctgcgtcggacaagaacgtaagttggggaatagtaagaaatcgctcgcgttaggttactaaccgaggacggccaacgggcctaaccgttccccttagttttcggtacctaacttccgtttacaaagaataaacggaacgccggtaccttacggagggtaacctacccgtacggaaccgttaacgtttccgtcggtaccctaccaacggtttacggaacgggaaaccnccgacgtcccctaagtaccctaggaaccctgtaccgacgggtacccgggacccaacggaacccgaaacggtacgtaacggaaacggtaaccgtaacgtttaacgtacggttacggaccggaagggtacggaagggtaaccgtaaagttaacgttagtttagggttagttcggggtttacggaccgggtaagggaccgtacgggtaccgttaccgggtaacccggtaccggttagggacctacgggccccggtaaacggccccgttacccggtcccccggtcggtaccctcccgttccccggttcccgttaaccccccg

SEQ ID NO: 166452 - DNA, 642 bp, Homo sapiens
  misc_feature: GYAE6OF01BL68S.26.71.G05.1.454.CMB.1.raw
  modified_base (306)..(306): a, c, t, g, unknown or other
  misc_feature (306)..(306): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaattgggagatagaaatgctgcctggtattaccagaggccaggccagtcccctatttggctatcttccaagataagagcgccctnaggactcctgaccgtaattctggcctaccaactcgtagggaacacacgccactctacgaccatcgacggccgggcccacgaccgaacgggacgtacgggaagggacgtaaccgttacgttagttcggtacgacgggtacggtaggggtaagtaacgttacgttaagtttaggttaaggttgggttttacggggaccgggtaacggggaccgagggtcgtacggacccggttaccgtaacgggttccgaaccggtacccgaacgggtcctcccggtaccccccggttcggttaccctaccggttcccttcccggttcccccctaccccgttaccccg

SEQ ID NO: 166453 - DNA, 654 bp, Homo sapiens
  misc_feature: GYAE6OF01ADFI0.26.71.G05.1.454.CMB.1.raw
  modified_base (306)..(306): a, c, t, g, unknown or other
  misc_feature (306)..(306): n is a, c, g, or t
  modified_base (503)..(503): a, c, t, g, unknown or other
  misc_feature (503)..(503): n is a, c, g, or t
tcagagactatactcacgaccggtgctcgatttagtgtcgtcgcaagagagaggggggactcctgtgccccaccatggacacgctttgctccacgctcctgctgctgaccatcccttcatgggtcttgtcccagatcaccttgaaggagtctggtcctgcgctggtggagcccacgcagaccctcacgctgacctgctccgtctctggattctcactcaccacgactgaggtgatggtcggccgtgggtccgtcgacgggacccccggaaaggcccgtggagtcggtcttgctactctatttacgnggagtagactccgtacgaaggtccggtaactaacgttcccgttctccgtagaaggtaactcgacctacaccactaccaaccgtacggaacctacccgtacgaaacggtccgggtacgttaccttaacgaacgtcgaaccgactagtacgtaactccgtagtacgaccacgacggactactagttacttacgtgtacnccaactacgtaccgtaccgtacggccgtaccgtacgaacgaaagtaaacgtagtatacggtacgtaggttacggggaccgttaagggtacttttcggacccgtacccgttcccgtaccccgtacgtacccctacggacccgtaaccccggg

SEQ ID NO: 166454 - DNA, 721 bp, Homo sapiens
  misc_feature: GYAE6OF01BFKLM.26.71.G05.1.454.CMB.1.raw
  modified_base (243)..(243): a, c, t, g, unknown or other
  misc_feature (243)..(243): n is a, c, g, or t
  modified_base (698)..(698): a, c, t, g, unknown or other
  misc_feature (698)..(698): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcacgcccaccctcagtcgtccgtgtccccaggacagacacgccaaccatccacctgcctcggcagacaaagttgganatacgaatgactgccgtaggttactaaccgaggacggccgacggcctaaccgttccccttagttttcggctacttcccttaaccgaaagtaacgtaaaacgacggccggtaccccttacggaacgggtaccttaccccgaggtaacccgtaacgtttcgacggtcctacccgtaacgtacggtacggaactaccgacgacctaccgtctacgacctagtccgacgggccggggacccacggacccgaaacgggagtaacgggaacgggaactaccgttaacgtacgttacggtaccgaagggtccgtaaggggtaacgttaaattaacgtttaggttacggttagggtttacggtttacggggacgggtaacgggccgtaggaccggttacggtacccgttacgtacggtaccgacggacccgacggtccgtacccgtccccgtacggttacccnccgtttccgtccccgttcccccg

SEQ ID NO: 166455 - DNA, 738 bp, Homo sapiens
  misc_feature: GYAE6OF01BJRDX.26.71.G05.1.454.CMB.1.raw
  modified_base (178)..(178): a, c, t, g, unknown or other
  misc_feature (178)..(178): n is a, c, g, or t
  modified_base (242)..(242): a, c, t, g, unknown or other
  misc_feature (242)..(242): n is a, c, g, or t
  modified_base (249)..(249): a, c, t, g, unknown or other
  misc_feature (249)..(249): n is a, c, g, or t
tcagagactatactcacgaccggtgctcgatttagtgtcgtcgcaagagagaggggggggcctcaggaagcagcatcgggaggtgcctcagccatggcatggatccctctcttcctcggcgtccttgcttactgcacaggatccggtggccttcgatgagctgattcagcccaccctnagtgtccgtcgtccccaggaccagacacgcccaccatccacctgctcggcagaacaagtggganatagaangctgcgtggtactacgagacggccgaggcctacgtccccttagtttcggtctacttctacaaagataaacggaacggtccgaccctcgagggacctcccgtagaaccgttaatttcgtcggaccctaccctaaccgtcgtacgggaaccaacacgtaccctaacctcgtacgaaccctatacccgggacgggcccggggacccaacggaacccgaacgggtagtagggaaccggggtacgtaaccttaacgttacgttacggtacggacgggtcgggtaggggaacgtaacgtttaacgttagtttaggttaaggtttgggttacgggtacggggacgggtaacccggtagggtaccgttcggtacccgttcgtaacgggtaccgtacccggaccggtaaccgggcccggttaccccggtccccccggtttacgggtaccccgttacccgtttacccggttaccccgttccccccgtccccgttacccg

SEQ ID NO: 166456 - DNA, 738 bp, Homo sapiens
  misc_feature: GYAE6OF01DS3NL.26.71.G05.1.454.CMB.1.raw
  modified_base (510)..(510): a, c, t, g, unknown or other
  misc_feature (510)..(510): n is a, c, g, or t
  modified_base (697)..(697): a, c, t, g, unknown or other
  misc_feature (697)..(697): n is a, c, g, or t
  modified_base (722)..(722): a, c, t, g, unknown or other
  misc_feature (722)..(722): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagcccaccctcagtcgtccgtgtcccccaggacagacagccaccatccacctgctcgcagacaagttggagatagaatacgtcgtcgtcgtagttactaacgaggaccgacgaccgtaccgtacccgttaccgtttaggtttcgtacctactttaccgtaaccgaaagtaacgtaacgaccggcccgtaccgtacggacggtacctaccgtaccgtaacgtttacgtttcggtaccgtccttaaccccgtacgttacgggtaaccgaaaccgaaccgtaccgtaccctacctcgtaacccgactacgtaccggccggggtaccccggaccgaccgaacggtaaacggnggttaagggaaagaccttacgtagttacgtacgacgggtcggtacggttaagaacttaacgttagttagtttaggtaggtttggggtacgggaccgggaacgtaccggcgtcggttaaccgcccggttaacgtacgtaccggtaaccggaaccccggagttcccgtccccccggtaccggttacccncctttacccgtccggtttacccccnccccgttcccgttacg

SEQ ID NO: 166457 - DNA, 624 bp, Homo sapiens
  misc_feature: GYAE6OF01DD44U.26.71.G05.1.454.CMB.1.raw
  modified_base (117)..(117): a, c, t, g, unknown or other
  misc_feature (117)..(117): n is a, c, g, or t
  modified_base (254)..(254): a, c, t, g, unknown or other
  misc_feature (254)..(254): n is a, c, g, or t
  modified_base (588)..(588): a, c, t, g, unknown or other
  misc_feature (588)..(588): n is a, c, g, or t
tcagagactatactcacgaccggtgctcgatttagtgtcgtcgcaagagagagggggctgggcctcaggaagcagcatcggaggtgcctcagccatggcatggatccctctcttccncggcgtccttgcttactgcacaggatccgtggccttgatgacgctgacttcacgcccaccctcagttcgtccgtcgtccccaggacagacacgaccaccatccacgtcgccgtcggacagaacgtaaaggttggaanagtaagaaagtcgctcgtcgttaggttactacgaggacgccgacgccctaccgttaccccttagttcgtctacgttcctacgaagtaacaacggtacgcccgaccgtcgacggacctccgtaacgaccttagttcgtcgtacctacaacgtacgtaaggaaccacgaccgactactcacgtaccacgtcgacggccggactcggaccgaaggagacggagacctagtactagtcgagaggcggtaggaactagttattagttagggtagttggtcggagggtaccggagacggtgaccggtcgtaccgggtcgacgaccgggccacgggtcccnccgtacccgacgttaccgctccgttcccgtaccccg

SEQ ID NO: 166458 - DNA, 660 bp, Homo sapiens
  misc_feature: GYAE6OF01A1JTG.26.71.G05.1.454.CMB.1.raw
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaagttgggagatagaaatgactgcctggtacttaccagaggccaggccacgtcccctattttcggtcattcttacaaagataagaacgcggccctacgagggactcccgtgacccgtaatttcgtggcctccaactcgtagggaacacgacgccaactctacgaccatccgacggccggggccccacggaccccgaaacgggagtacggacggggaactaacgtaacttaagtttcgacgagggtccggtaaggggaactaaagttaccgttaagttacggttaaggtttggtttacgggacggggtacgggaccgtagggtccgtacggtaacccggttccggttacggtaccgtaacggccccggaaacggtcccgtaccggtaccccccggttacggtacccgttccgtcccgttaccgtttaacccccg

SEQ ID NO: 166459 - DNA, 728 bp, Homo sapiens
  misc_feature: GYAE6OF01DP74T.26.71.G05.1.454.CMB.1.raw
  modified_base (282)..(282): a, c, t, g, unknown or other
  misc_feature (282)..(282): n is a, c, g, or t
  modified_base (301)..(301): a, c, t, g, unknown or other
  misc_feature (301)..(301): n is a, c, g, or t
tcagagactatactcacgaccggtgctcgatttagtgtcgtcgcaagagagaggggtccatgccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagacggccaggccagtccctatttgcatctcaagataagacgcgcctgaggntcccgtgaccgtatttcgnggtctaccaactcgtacgggaaacacgacgccactcgtcgaaccagtccgaacggcccggggaccccaaggcccgaaacgggacgtacgggaagggtaacgtaaccttaacgttaagtttcgggacgtaacggggtccgggtaaggggtaaacgtaaatttaacgttaacgtttagggtttaacgggtttaggggttttacgggaccggggtaacggggtaacccgagggtaccgtacgggtaaccccggtttaccggtaaccgggttccgtaaccggaccccggtaaacgggtcccgtcccgggtccccccgttaccgggttccacccgttcgttaccccgttcccccaaccccgtttccctacggtaaccgtttaccttaccggttccttacccggtagggtaaccgggtccgggtcgtacgggg

SEQ ID NO: 166460 - DNA, 573 bp, Homo sapiens
  misc_feature: GYAE6OF01C2E6I.26.71.G05.1.454.CMB.1.raw
  modified_base (240)..(240): a, c, t, g, unknown or other
  misc_feature (240)..(240): n is a, c, g, or t
  modified_base (334)..(334): a, c, t, g, unknown or other
  misc_feature (334)..(334): n is a, c, g, or t
  modified_base (402)..(402): a, c, t, g, unknown or other
  misc_feature (402)..(402): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccaccctcagtcgtcccgtgtcccccaggaccagacagccaccatccacctgctcggcagacaaatgganatagaatgctgcctggtatacagagcagccagtcccctatttgcatctccaagataagaagcgccctcgagggactccctagaccgtaatttcnggctaccgaactcgtagggaaccacagccctactctcgaccatcacggccgggacccagcccaacggntacggaggacgactacgtattcggtacgagggcggtagggagtaagttaacgttagttaggttagtggtttgggacgggacgggtacgagggtctcggaccggtacgtacgggtcacggtacccgaaggccctacggtcccccctaggtccaccgtccttccgttaccccc

SEQ ID NO: 166461 - DNA, 645 bp, Homo sapiens
  misc_feature: GYAE6OF01EVTDD.26.71.G05.1.454.CMB.1.raw
  modified_base (231)..(231): a, c, t, g, unknown or other
  misc_feature (231)..(231): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtccccttatttggcatctccaagataagagcggcctcgagggatccgtgaccgtaatttcgtggctacctaactcgtacggaacacacgccactcgtcgaccatcgacggccggggaccccacggacccgaaacgggacgtagggaacggggaacgtaaccgttaacgttacgttcggtaccgagggtcggtaggggaacgtaagtaacgttaagtttaggtaggttgggtttagggacgggtacgggaccgtacgggtacgtcgggtacccgttacggtacgggttccgaacggtaccccgaacgggtccgtcccggtaccccccgtcggttaccctacgttcccgttcccggttcccccgtccccgttaccccg

SEQ ID NO: 166462 - DNA, 630 bp, Homo sapiens
  misc_feature: GYAE6OF01E5HHU.26.71.G05.1.454.CMB.1.raw
  modified_base (400)..(400): a, c, t, g, unknown or other
  misc_feature (400)..(400): n is a, c, g, or t
  modified_base (415)..(415): a, c, t, g, unknown or other
  misc_feature (415)..(415): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtcccccaggacagacacgccaccactccaccgtgcgtccgacaacgaactaaggttgggaagtaagtaagtaaagtgcgtcgtccgttaggttaactaccgaggtacggaccgaggccctacgttcccctttagtttcggactacttctaccgaagtataagacgccgtcctacgaggacctccgcgtaacgtattcgcgctaccactcgacggacancgaccactcgcacanacgacggcccggaccacgaccgacggagacggagggactaacgtacgtagttcgtacgaggtcggtaggagtaacgtacgttagttaggtaggtttgggttacgggacgggacggacgacggtacgtacgtaccgtacgacggtaccgaccgaccgaacggtccgtcccgtcccccgtcgtacctaccgttccgtccctccccgtcccttacccg

SEQ ID NO: 166463 - DNA, 695 bp, Homo sapiens
  misc_feature: GYAE6OF01CRBO8.26.71.G05.1.454.CMB.1.raw
tcagagactatactcacgaccggtgctcgatttagtgtcgtcgcaagagagagggggactcctgtgccccaccatggacacgctttgctccacgctcctgctgctgaccatcccttcatgggtcttgtcccagatcaccttgaaggagtctggtcctgcgctgggtggacgcccacgcacgaccctcacgctgacctgctccgtctctggacttctcactacaccacgactgaggtgaatggtcggccgtgggtcccgtcgaccgggaccccggaaaggcccgtaggacgtgggcttcggacctacttcctaagttttaccgtgggtacgtgtacgttacctacgaaaggtaccggttaaaccaacgttccccggtactccgtaggaaggtaactaccgactaccaaccactaccgaaccgacgggaccaacccgtacgaaacggtaccgggtgtacccttaacaactacgaaccgatactagaactccgtaggacgaacacgacgacaactattaagttctgtacgaccaactaaccgtacgttaccgtagccgaccgtaacgaacgaaacgtaaaagacttaacgtaggtaaccgttaagggtacggggtaacgtaagggtttacgttttaccgggacccttacccggtacccctaccccgtacgtaccccttacccgaacggtaaccccggg

SEQ ID NO: 166464 - DNA, 701 bp, Homo sapiens
  misc_feature: GYAE6OF01DWI8P.26.71.G05.1.454.CMB.1.raw
  modified_base (233)..(233): a, c, t, g, unknown or other
  misc_feature (233)..(233): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccacatcacctgctcggcagacaaagtggganatagaaatgctgcctggtacttaccgagacggccaggccacgttcccccttagttttcggctattccttaccaaagataaagaacggccggaccctacgagggactcccgtagaaccgtaatttccgtggcctacctaactcgtaggaaccacacgcctactctagaaccatcgaggcccgggcccaacggaccgaaacgggtagtacggaagggtaacgaaccgttacgttagttcggtaccgaagggtccgggttaaggggaactaaagtttacgttaagtttacggttaagggtttgggtttcggggaccggggtacgggtaccgtacgggtccggttaccggtacccggttaccgtaacgggtaccgaaccgggtaccccgaagggtcccgtacccggtccccccgtttcgggtaccctaacccggtttcccgtccccggtttccccccgtccccgttaccccg

SEQ ID NO: 166465 - DNA, 660 bp, Homo sapiens
  misc_feature: GYAE6OF01AP5DX.26.71.G05.1.454.CMB.1.raw
  modified_base (175)..(175): a, c, t, g, unknown or other
  misc_feature (175)..(175): n is a, c, g, or t
  modified_base (233)..(233): a, c, t, g, unknown or other
  misc_feature (233)..(233): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctnagtgtccgtgtccccaggacagacagccaccatcacctgctcggcagacaattggganagtagaatgctgcctggtattaccagaggccaggccacgtcccctattttggtcatccttccaagataagaagccggaccctcgaggactcccgtagacccgtaatttcgtcggacctccaacgtctacgggaaccacgacgcccactcctacgaccacgtcgacggccggggtaccccacggacccgaacggaagtggaacgggaacgtactacgtagttcggtacgacgggtcgagggataagtacgtagtttaggtaggttgttgggacggtacgggtaccgagggtcgtacggtacccgttaccggtacggtacccgtacggaccccggtaaacgggtccctaccccgggtccccccggttacccgggttcccgtacccgtttacccgttccccgtttaccccccgtacccccgtttaccccg

SEQ ID NO: 166466 - DNA, 534 bp, Homo sapiens
  misc_feature: GYAE6OF01EFRA6.26.71.G05.1.454.CMB.1.raw
  modified_base (519)..(519): a, c, t, g, unknown or other
  misc_feature (519)..(519): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccaccctcagtgtccgtgtccccaggacagacagccaccatcacctgctcggcagacaaatgggagatagaaatgctgcctggtattaccagaggccaggccagtcccctattttggtcatcttccaagataagacgcgcctcagggactccctagaccgaatttctggctccaacgtctggaacacacgccactctgaccatcaggccgggcccaggcccaacggatggagggacgacttaactattgtcgaggcggtagggagtaatactagttgtagttgtttagggcggtagggaccaggcgtcgaaccgtccgtaggcacggccgaggctccgcccctcggtcnctccgtcgttccccc

SEQ ID NO: 166467 - DNA, 623 bp, Homo sapiens
  misc_feature: GYAE6OF01ACGJ5.26.71.G05.1.454.CMB.1.raw
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaagttgggagatagaaatgctgcctggtacttaccgagaggccaggcccacgttcccctattttcggtcatcttaccaagataaggaagccggccctcgagggctccctgaccgtaatttcgtggcctccaactcgtaggaacacacgcccactctacgaccactcgacggccgggacccacggaccgaacggagtaggagggactacgtactagttgacgagggcggtagggagtaagttacttagttaggttaggttgggtttagggacgggacgggtaccgacggtcgtacggtacccgttcggtacggtcgaccggtacccgaacgggtcccgttacccggaccccccgttcggtaccctacccgttcccgtcccggtttccccctcccgttacccg

SEQ ID NO: 166468 - DNA, 749 bp, Homo sapiens
  misc_feature: GYAE6OF01ENEUD.26.71.G05.1.454.CMB.1.raw
  modified_base (176)..(176): a, c, t, g, unknown or other
  misc_feature (176)..(176): n is a, c, g, or t
  modified_base (233)..(233): a, c, t, g, unknown or other
  misc_feature (233)..(233): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccacctnagtgtccgtgtccccaggacagacagccacatcacctgctcggcagacaagtggganatagaatgctgcctggtactaccgagacggccaggccacgttcccctagttttcggactacttcttaccaaagtactaaggaacgccggtccctacgacgggtaccttcccgtacgtaccgtaactttcgcggtacctaccgtaacgtccgtacgggaaccaacgacgccctaactcctacgaccctacgtaccgacgggaccccgggggtacccaaccgggaacccggaacggtacggtaacggggaacggtaaccgtaacgttaacgttcggttacgtacgggtacgggtacgggtaagggtaacgtaacgtttaacggttacgtttaggggttagggtttcggggttaacggggaccgggtaaccgggtacggtacggttacgggttacccgggtaacccggttacggttaaccgggaccggtaacccggtacccgggaccgggttccccgtaccccgggtaccccgttacccggacccgtttaacccgttccggtaccccccgttccccccg

SEQ ID NO: 166469 - DNA, 716 bp, Homo sapiens
  misc_feature: GYAE6OF01DCVPU.26.71.G05.1.454.CMB.1.raw
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcacgccaccctcagtcgtccgtcgtccccaggacagacacgccacatccacctgcctcggcagaacaaagttgggaagatagaatgactgcctaggtaacttaccgagacggccaggccacgttccccttagtttcggtactattcctacaaagtaagtaacgaacgccggaccctcggaagggtacctcccgtagaccgtaacttttcgacggccttaccaacttcggtaaggaaccaacgacgacctactcgtacgaccagtcgacggtcccgggaccacggaccgaagggaactcgggaaaggacgtacgttaacgttagttacggtacgacggtaccgggtagggtaacgtaaacttacgttaagtttacggtaaggtttcgggtttacggggacggggtaacgggaaccggtacgggtaccgttacggtacccgtaccggttacggtaccgaaccgggtaccccgtaacgggtcccttaccccgggtcccccgttaccggtacccgtacccgtttcccgttaccccgggttcccccgtcccccttaccgg

SEQ ID NO: 166470 - DNA, 515 bp, Homo sapiens
  misc_feature: GYAE6OF01DHL5H.26.71.G05.1.454.CMB.1.raw
  modified_base (312)..(312): a, c, t, g, unknown or other
  misc_feature (312)..(312): n is a, c, g, or t
  modified_base (395)..(395): a, c, t, g, unknown or other
  misc_feature (395)..(395): n is a, c, g, or t
  modified_base (403)..(403): a, c, t, g, unknown or other
  misc_feature (403)..(403): n is a, c, g, or t
  modified_base (425)..(425): a, c, t, g, unknown or other
  misc_feature (425)..(425): n is a, c, g, or t
  modified_base (483)..(483): a, c, t, g, unknown or other
  misc_feature (483)..(483): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtctttgcttactgcacaggatccgtggccttcgatgagctgattcagccaccctcagtgtccgtgtccccaggacagacagccaccatcacctgctcggcagacaaagttgggagatagaaatgctgcctggtattaccagaggccaggccagtccccctatttggtcatcttccaagatagaagcggccctnagggatccctgaccgtaatttctggctacccaactcgtaggaacacacgccactctgaccatcagccgggcccagccaacggntggagganactactatgtcaggtcgtgganatactattgtagttgttggcggaggacaggctcgaccgtctaggcacgcccaaggccncgccccctggtccactctctcccctccctccg

SEQ ID NO: 166471 - DNA, 738 bp, Homo sapiens
  misc_feature: GYAE6OF01CFLDA.26.71.G05.1.454.CMB.1.raw
  modified_base (233)..(233): a, c, t, g, unknown or other
  misc_feature (233)..(233): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaagtgganatagaaatgctgcctggtatacagagccagccagtcccctatttggtcatctaccaagataagaagcgcctcgagggactcccgtagaccgtaatttcgacggtcctaccaactcgtacgggaaaccacgacgccctaactccgtacgaccatccgaacggccggggaccccacggacccgaaacgggagtcgggaaacggggtaacgtaaccttacgttaacgtttcggtaccgtaacgggtccgggttaggggaaacgtaaacgttaacgtttaagttttagggttaacgggtttgggttttacgggggacggggtaacgggggaacccgtacggggtaccgttaccgggaaccccggtttacccgtaacggggtacccgtaaccgggtacccccggtaaacgggggtccccttaccccgggtaccccccccgggtttaccgggttaccctaccccgtttcccgtttaccccgtttacccccccgtacccccgtttacccccg

SEQ ID NO: 166472 - DNA, 715 bp, Homo sapiens
  misc_feature: GYAE6OF01CMTS7.26.71.G05.1.454.CMB.1.raw
  modified_base (201)..(201): a, c, t, g, unknown or other
  misc_feature (201)..(201): n is a, c, g, or t
  modified_base (234)..(234): a, c, t, g, unknown or other
  misc_feature (234)..(234): n is a, c, g, or t
  modified_base (390)..(390): a, c, t, g, unknown or other
  misc_feature (390)..(390): n is a, c, g, or t
  modified_base (401)..(401): a, c, t, g, unknown or other
  misc_feature (401)..(401): n is a, c, g, or t
  modified_base (405)..(405): a, c, t, g, unknown or other
  misc_feature (405)..(405): n is a, c, g, or t
tcagagactatactcacgaccggtgctcgatttagtgtcgtcgcaagagagaggggctggcctcaggaagcagcatcggagtgcctcagccatggcatggatccctctcttcctcggcgtccttgcttactgcacaggatccgtggccttcgatgagctgagttcagccaccctcagtcgtccgtgtccccaggacagacngaccacatcacctgctcggcagacaagtggganatacgaatgctgcctgtactaccgagacggtccaggccctacgtcccccttaagttttcggtctacgttccttacccgaaggtactaacggaacgtccggccctagacgggtacctcccgtagaccgtaatttcgcgcctacaactcgtaggaacncacgccactcnaccntcgacggtcccgggaccacggacccgaacggtacgtacgggacgggtacgtaaaccgttacgttaagttacggtacccgaagggggtccggtaacggggtaagtaacgttaaccgttaggtttacggttaggttacgggttttacggggacccgggtacggggtaacccggtaggtaccggttccgggtaaccccggttccggttaaaccgggtcgtaacccgggtaccccgtaccgggtacccgttccccggtaccccccggtttccggtaacccgttaccccggtcccgtttccggttacccccccgg

SEQ ID NO: 166473 - DNA, 766 bp, Homo sapiens
  misc_feature: GYAE6OF01B2MA5.26.71.G05.1.454.CMB.1.raw
  modified_base (344)..(344): a, c, t, g, unknown or other
  misc_feature (344)..(344): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacacgccaccatccacctgctcggcagacaaagttgggagatagaatgctgcctggtattaccagacggccaggccagtcccctattttcggtcatcttcaagataaggagcggccctcgacgggactcccgtagaccgtaatttcnggtcctacactctagggaacacacgcctacgtctacgaacctatacgaggcccggggaccctacggacccaaacgggactagggaacggggaacgtaaccttaacggttacgtttacggtacgtacggggtaccggtaggggtaacggtaaattaacggttaacgttttagggttacgggttttacggggttttaggggtacggggtaaccgggggtacccggtaacggggtacccggttaccgggtaaccccgggtttacccgttaacggggttacccggaaccgggtacccccgggtaaaacggggtccccgttaccccggggtaccccccccggtttacccggggttaacccgttacccccggttaaccccggttttccccgggtttccccccccggtccccccgttttaccccccggg

SEQ ID NO: 166474 - DNA, 695 bp, Homo sapiens
  misc_feature: GYAE6OF01BPTZL.26.71.G05.1.454.CMB.1.raw
  modified_base (235)..(235): a, c, t, g, unknown or other
  misc_feature (235)..(235): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccaccctcagtgtccgtgtccccaggacagacagccacatcacctgctcggcagacaagtggganataagaatgactgcctaggtataccgagacggccaggccacgtccccttagttttcggtacacgttccttaccaaagtaactaacggaacgcccggtacccctagaacggggtacctaccccgtaggtaacccgtaaatttccgacggtacctacccgaacttccggtaagggaaacctacgaccgcccgtaacttcgacgaaccctacgtaccgagggcccgggacccgacgacccgaaacggacgtacggaaggacgtactaacgtacgttgtaccgaggtacggtagggaagtaacgtaacgttagtaggttaaggttgggttacgggacgggtacgggtaaccggagggacccgtacggtaccggtaccggtacggtaccggaccggtacccggtaccggcccttacccgggtacccccgttcggtacctacccggttccgttcccgggttccccg

SEQ ID NO: 166475 - DNA, 628 bp, Homo sapiens
  misc_feature: GYAE6OF01DADTG.26.71.G05.1.454.CMB.1.raw
  modified_base (269)..(269): a, c, t, g, unknown or other
  misc_feature (269)..(269): n is a, c, g, or t
  modified_base (278)..(278): a, c, t, g, unknown or other
  misc_feature (278)..(278): n is a, c, g, or t
  modified_base (292)..(292): a, c, t, g, unknown or other
  misc_feature (292)..(292): n is a, c, g, or t
  modified_base (305)..(305): a, c, t, g, unknown or other
  misc_feature (305)..(305): n is a, c, g, or t
  modified_base (311)..(311): a, c, t, g, unknown or other
  misc_feature (311)..(311): n is a, c, g, or t
  modified_base (343)..(343): a, c, t, g, unknown or other
  misc_feature (343)..(343): n is a, c, g, or t
  modified_base (346)..(346): a, c, t, g, unknown or other
  misc_feature (346)..(346): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagcctaccctcagttcgtccgtcgtccccaggacagacacgccaccatccacctcgctcggacagaacaagttggatatagaatgctgctgtatacagacgcagccngtccccttnttgtcatctacaanataagacgccgcnaggacncctgactattctgctcactctaggaacacacnccnctacgtacgtacacgtcgacggtccgggcccaacgtacccgaaggacgtaggaacgggactaactacgttaacgtcggtacggacggaccggtaagggaacgtaagttaaccgttaggtttggttaacggttcggggtttacgggaccgggtacgggtaaccggacggtacggtcggtacccggttaccggtacggtaccgtaccgggtacccgaaggcccgttaccccggccccgttccgggtacctaccgttccgtacccgttcccccgtccgttacccg

SEQ ID NO: 166476 - DNA, 838 bp, Homo sapiens
  misc_feature: GYAE6OF01B91G9.26.71.G05.1.454.CMB.1.raw
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacacgacacgccacactcacctgcctcgcagaacaagttggaacataagaatgacgtgccgtggtacttaaccaggtacggaccaggaccacgttcccccttaagttttggtctacgttccgtttaccgaaagtaacttaaacggaacgaccggacccttacggaacgggtactaccccgtacgaacccggtaaacttttcggacgtccgttaacccgtaaccgttcggtaacgggtaaccaaccgtaccggaccctaacgttcctacgaacctacgttaccgacgggcccggggtaccccgacgaaccccgtaacggggtagtacgggaaacggggtaactaacgttaaccgttacgtttacggtaaccgtaggggtaccggttaaggggaacgttaaacgttaacggtttaacgtttacgggttaggttttaacggggttttcgggggtaccggggtaaacgggttaaccgggtacggggttacccgttaacgggttaaccccgggttaccggtttaacgggacccgtaaccggggtaccccgaaacgggttcccggttcccccggtaacccccgggtttacgggtaccctaaccccgggttttccggttaccccggtttcccccgggttacccttacccccgggg

SEQ ID NO: 166477 - DNA, 793 bp, Homo sapiens
  misc_feature: GYAE6OF01DYBRK.26.71.G05.1.454.CMB.1.raw
  modified_base (220)..(220): a, c, t, g, unknown or other
  misc_feature (220)..(220): n is a, c, g, or t
  modified_base (235)..(235): a, c, t, g, unknown or other
  misc_feature (235)..(235): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgttccttgcttactgcacaggatccgtggccttcgatgagctgattcacgcccaccctcagtcgtccgtcgtccccaggacagcagccacatcactgcncgcagacaagtgganatagaatgctgactggtactaccgagacggccgaggtcctaccgttcccttagttttcggtacacgttccttaccgaaagtataaacggacgccggacctaggacgggtactccctaggtaacccgttattccgcggtaccttaccgaaacttccggaaggaaaccacgaccgaccctaacgtcccgtaacgacccgttacgacccggaaccgggccccgggggaccccctaacggaaccccggaaaacggggtacgtacgggggaaacggtaccggtaaacctttacgttacgttcggtacgtacgggtacggggtaaggaaacgttacttaacggttacgtttaacgggttaagggtttacgggttaggggaccggggtaacgggtacccgtaacggggttaccgttcccgggtaaaccggtttacccggtagggtaaccccggtaacccggtaccccggggtaaaccgggttcccccgtcccccgggtaaccccccgggtttacgggttaccccctaccgggtttttccccggacccccgggttttacccccccc

SEQ ID NO: 166478 - DNA, 856 bp, Homo sapiens
  misc_feature: GYAE6OF01B3KW2.26.71.G05.1.454.CMB.1.raw
  modified_base (234)..(234): a, c, t, g, unknown or other
  misc_feature (234)..(234): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaagttggganatagaatgctgcctggtactaccgagacggccaggcctacgtcccccttagttttcggtcctacttccttaccaaaggtaacgttaaacggaacggtcccggtacccctacgaacggggtaccttaccccgttacggtaacccgtaaacgttttccgtacgggacccttacccgaaacccgttaccggttaacggggaaaccaaccgtaacggccctaaccgttcctaccggaaccctaacgtaccgacgggaccccggggtaccccaaccggacccggaaacgggagttaacgggaacggggtaacgtaaacccgttaacgttaacgtttacgggaccgtaacggggtacggttaacgggggaaacgttaaagtttaaccgttaaggttttacgggtttacgggtttacggggttttacggggaccggggtaacggggaaccccgtaaggggtcccgttaacccgggtaccccgggttacccggtaacgggttacccgtaaaccggggtacccccgtaaaccggggttccccgtacccgggttccccccccggttacgggttacccttaaccccgttccccggtttaccccgggtttccccccgtcccccgtttaccccgg

SEQ ID NO: 166479 - DNA, 770 bp, Homo sapiens
  misc_feature: GYAE6OF01AWVVY.26.71.G05.1.454.CMB.1.raw
  modified_base (246)..(246): a, c, t, g, unknown or other
  misc_feature (246)..(246): n is a, c, g, or t
  modified_base (248)..(248): a, c, t, g, unknown or other
  misc_feature (248)..(248): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcacgcccaccctcaggtcgtcccgtcgtccccaggaccagacagcccaccatccacctgctcggcagacaaagttgggananagaatgctgcctaggtactaccgagacggccaggccctacgtccccttagttttcggtactacttccgttaaccaaagtaacgtaaacggtaacggcccggtaccccttacggaacgggtaaccttcccccggttaaggtaaccccgttaacgtttcccgtacgggtacccttaccgaaaccgttcgtacggggaaccaacgacgtccctaaccgtctaccgaacgtactcggaacccgggtccgggacccctaacgggacccgaaaccgggtcggtaacgggaacggggtaaccgttacgttaaccgtttacgttacgggtacgtacggggtacggttaagggtaaagtaacgtttaaccgttaggttacggttaagggttccgggtttaggggacgggtaccgggaccgtagggtcccgttacggacccggttccgtaacgggtacaccgggtcccgtaacggcccgttacccgggcccccgttacggtccctaccgttcccggttcccgttccccccgg

SEQ ID NO: 166480 - DNA, 552 bp, Homo sapiens
  misc_feature: GYAE6OF01ASMO0.26.71.G05.1.454.CMB.1.raw
  modified_base (314)..(314): a, c, t, g, unknown or other
  misc_feature (314)..(314): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggagatagaaatgctgcctggtattaccagaggccaggccacgtcccctattttggcatcttccaagataagaagcggccctnagggactccctgaccgtaatttctggctccaactctggaacacagccactctgaccatcacggccggggccccacggcccaaacgggatacggaagggacgaccttaacgtagttggtcgacgggcgtgggagaatactagttggttagtggtttggcgggagggaccgaggctggaccgttccgtacggtcacggcccgaaggcctcgccccctcggtccacctcgtcgttcccccg

SEQ ID NO: 166481 - DNA, 645 bp, Homo sapiens
  misc_feature: GYAE6OF01BU0J2.26.71.G05.1.454.CMB.1.raw
  modified_base (235)..(235): a, c, t, g, unknown or other
  misc_feature (235)..(235): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtcgtccgtgtccccaggacagacacgccacatcacctgctcgcagacaagtggganataagaatgctgctagtacttacgagacggccaggccacgttccccttagttttcggctactcttaccgaaagataaagacgaccggccctacgacgggtactacccgtacgaccgttaatttcgtcggtacctaccgaactcgtacggaacacgacgcctactctacgaccagtcgacgggccgggacccagacccgaaggcgtacgggacggactaccgttatacgttcgacgacgggtcgtacggtaagtaacttacgttagttacggttaggttacgggtttagggaccggggtagggtacccgtagggccttacgggtaacccgttacgtacggtaccggaccgtacccggacggtcccgtaccggacccccgtttggaccctacccgttcgtcccgttaccccc

SEQ ID NO: 166482 - DNA, 827 bp, Homo sapiens
  misc_feature: GYAE6OF01EHPSZ.26.71.G05.1.454.CMB.1.raw
  modified_base (229)..(229): a, c, t, g, unknown or other
  misc_feature (229)..(229): n is a, c, g, or t
  modified_base (237)..(237): a, c, t, g, unknown or other
  misc_feature (237)..(237): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaagtgganatagaatnctgcctggtataccgagacggccacggcccacgttaccccttagttttcggctacgttaccttaccgaaagtaagttaaaggaacggacccgggtaccccgtacgacgggtacttccccgtaggtaacccgttaatttccgcggtaccttacccgtaaaccgttccgtaacgggaaacctaccaacggtaccctacgttacccgtacgaaacccgtacgtacggtaaccgggacccgggggacccccaacgggaaccccgtaaaaccggggtacgtaacgggtaacggggtaacgtaaccggttaacgttaagtttaccggtaccgtaacggggtccggtaaggggtaaacgtaaccgtttaacgtttaacggttttgggttaacgggttttcgggtttacggggaacggggaaacgggtaacccggtaacgggtacccggttaaccgggtaccccggtttaccgtaaccgggtacccgtaaaccgggaaccccggttaacggtcccccggttacccggtaccccccgttccgggttaccctacccggtacccgtttccccgggtttaacccccgtcccccgttacccgg

SEQ ID NO: 166483 - DNA, 697 bp, Homo sapiens
  misc_feature: GYAE6OF01AZS5Y.26.71.G05.1.454.CMB.1.raw
  modified_base (234)..(234): a, c, t, g, unknown or other
  misc_feature (234)..(234): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtcccccaggacagacagccaccatcacctgctcggcagacaattggganatagaatgctgctggtattaccgagacggccaggccacgtccccctagttttggtactattctaccaagataagaagccggcctcgaggactccctgaccgtaattctgcctccaactcgaggaactacacgccactctcgacctatacgacgcccggggcccacggtacccgaaacgggacgtacgggaacggggacgtaaccgtaccgttaagtttcggtaccgacgggtccggtaaggggtaacgtaaacgttacgttaagtttacgggttaaggtttgggtttacggggacgggtaacggggaccgtacgggtaccgtcgggtaccccgttccggttaaccgggtaccgaaccggtaccccggaaacgggttccccgttcccgggtacccccccgttacggttacccctaaccggttccccgtttccccgggtttaccccccgtccccgtttaccccgg

SEQ ID NO: 166484 - DNA, 800 bp, Homo sapiens
  misc_feature: GYAE6OF01BNELJ.26.71.G05.1.454.CMB.1.raw
  modified_base (242)..(242): a, c, t, g, unknown or other
  misc_feature (242)..(242): n is a, c, g, or t
tcagagactatactcacgaccggtgctcgatttagtgtcgtcgcaagagagagggggctgggcctcaggaagcagcatcggaggtgcctcagccatggcatggatccctctcttcctcggctccttgcttactgcacaggatccgtggccttcgatgagctgattcagcccaccctcagtgtccgtcgtccccaggacagacagcccaccatccacctgctcggcagaactaaagttggganataagaatgctgcctggtactaccgagacggccacggcctacgtccccttagttttcggtactacttccttaccgaaagtaagtaaacggaacggcccggtaccccgtacggtaacgggtaccttccccgtacggtaacccgttaacgtttaccgtcggacccttaacccgtaaacgttccgtaacggggaaacctacgacgtaccctacctctacggaccctacgtaccgaccgggcccgggtaccccgaacggaccccgaaacgggtagtacgggaaacgggtacgtaaccgttaacgttaacggttcgacggtaacgggtacgggttagggaacgttaaacgttaacgtttaacggtttagggttaagtttcggggtttacgggtaccgggggtaacgggtaacccggtacggggtcccgttaccgggtaacccggtttacccggtaacgggtaccgaacccggtcccggtaaacccgggtcccgttaccccgggtaccccccggttaccgggttaccccgtacccgtttccccggtttccccgttacccccccg

SEQ ID NO: 166485 - DNA, 581 bp, Homo sapiens
  misc_feature: GYAE6OF01B1L5F.26.71.G05.1.454.CMB.1.raw
  modified_base (238)..(238): a, c, t, g, unknown or other
  misc_feature (238)..(238): n is a, c, g, or t
  modified_base (336)..(336): a, c, t, g, unknown or other
  misc_feature (336)..(336): n is a, c, g, or t
  modified_base (369)..(369): a, c, t, g, unknown or other
  misc_feature (369)..(369): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtcgtccgtgtccccaggacagacacgccaccatcacctgctcggcagacaaagtggganatagaatgctgcctggtactaccagacgccagccacgtccctatttcggcatctacaagataagacgcgcctgacggactcccagaccgtaatttcgngtcctaccactcgtaggaacacacgccactcanaccatcgacggccgggacccaaggacccgaaaggagtacggacgggtagtaaccttaacgtagttcgacgaggtcggtaagggactaagttacgttagttgtaggttcggttagggacggagggtaccagggtctcggtaacccgtcgtacggtccaacggcccaagggtccctccggccccgttcggtactaccgttccgtccgtcccccg

SEQ ID NO: 166486 - DNA, 680 bp, Homo sapiens
  misc_feature: GYAE6OF01B519W.26.71.G05.1.454.CMB.1.raw
tcagagactatactcacgaccggtgctcgatttagtgtcgtcgcaagagagaggggtccatgccatggcatggatccctctcttcctcggcgtccttgcttactgcacaggatccgtggccttcgatgagctgattcacgcccaccctcagtcgtccgtcgtccccaggacagacacgccaccatcacctgctcggcagacaaagtgggaagataagaatgctgcctggtactaccgagacggccaggcctacgtcccttagtttcggactatccttaccaaagtataaacggacggtccggaccctacggaggaccttcccgtaacggaaccgttaacgtttccgtccgggaccttaccgaaccttcggtaacgggaaaccacacgaccctaacgtcaacgactacgaccgacgggacccgggaccaacgacccgaaagggacgtagggaacgggtaactaaccgtacttagttcggtaccgagggtcgggtaagggtaacgtaattaacgttggttagtacggtttgggttagggaccgggtaggacgaggtacctcggtaaccggtacttacgggacgacccgtaccggaaggtccctcccgaccccgtggtaccctacttccgtccctacccctccgactctacgtgtaccgtctacggagcgggccgtcggacgg

SEQ ID NO: 166487 - DNA, 606 bp, Homo sapiens
  misc_feature: GYAE6OF01DDRAD.26.71.G05.1.454.CMB.1.raw
  modified_base (236)..(236): a, c, t, g, unknown or other
  misc_feature (236)..(236): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccaccctcagtcgtccgtgtccccaggacagacagccaccatcacctgctcgcagacaaagtgganatagaatgctgcctgtatacagacgcaggccagtccctatttcggcatctaccaagtataagaacgccgcctcgagggactccgtagaccgtaattcgtacggcctaccaacttcgtaggaactacgacgcctactctacgaccatccgacggccgggcccacggacccgaacggagtacggagggactactacgttagtcgtacgacggtcggtagggaataacgtacgttagttggtaggttggtttagggacggacgggtaccgaggtacgtacggtacccggtccgtaacgggtaccgaccggcccggaacggtccgtcccgtaccccccgtaggtacccaccgttccgttccccggttacccccg

SEQ ID NO: 166488 - DNA, 766 bp, Homo sapiens
  misc_feature: GYAE6OF01A0Z6L.26.71.G05.1.454.CMB.1.raw
  modified_base (243)..(243): a, c, t, g, unknown or other
  misc_feature (243)..(243): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagcccaccctcagtcgtccgtcgtcccccaggaccagaccagcccaccatccacctgctcggcagacaaagttggganatagaatgctgcctaggtactaccgagacggccgagccacgttccccttatttcggctatccgttaccaagtataacggaacgccggccctacgacgggtactcccgtagtaaccgtaatttccgacggccttacccgaacgttccggtaacgggtaaccacgacgaccctacgtcctacgacctacgtcgacggcccgggtacccacggacccgaacgggacgtacgggaacgggtaacgtaaccgttaacgtaggttcggtaccggtacgggtcgggtaacggggaataaaccggttacgtttaaggtttacgggttacgggtttagggtttaccgggggaccgggtaacggggtaacccggacgggttacccggttaaccgggtaacccggttacccggtaacgggtacccggaaccgggtaaccccggaacgggttccccgttaccccgggtacccccccggttcggtaacccttcccgttaccccgtttccccggttacccccgtaaccccgttcccg

SEQ ID NO: 166489 - DNA, 850 bp, Homo sapiens
  misc_feature: GYAE6OF01AWADL.26.71.G05.1.454.CMB.1.raw
  modified_base (179)..(179): a, c, t, g, unknown or other
  misc_feature (179)..(179): n is a, c, g, or t
  modified_base (246)..(246): a, c, t, g, unknown or other
  misc_feature (246)..(246): n is a, c, g, or t
  modified_base (252)..(252): a, c, t, g, unknown or other
  misc_feature (252)..(252): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggactccgtggccttgatgagctgattcagcccaccctcngtcgtccgtcgtccccaggacacgacacgccaccatcacctgcgtcggcagaactaagttgggatanaagaangacgtgactagtacttaccgagacgccgacggaccctacgttaccccgttagttttcgcgtacttaccgttaccgaaaggtaacgttaacggaaacgggtcccggtaccccgttacggaacggggtaccttccccggtacggtaacccggttaagttttcccgacggggtaccctaacccgtaacgttaccgggtaacgggtaaacccaaccgaccggtaccccgtaccgttacccggtacgaacccctaacgtaccggaacccggggtcccgggacccccgacgggtaaccccgaaacgggtaggtaccgggaagggtaacccgtaacgttaaccgttacggtttaccggtaccggtacggggttaccgggtaacggggaacgtaacggtttaacgttaagggttttacgggtttaacggggtttgggttttaaccggggccgggggttaacgggacccggtaagggtcccgtaaccgggttaccccggtaccggtttaaccggacccggtaccggaacccgaccgggttcccccgtaccccggttacccccgggttcggtacccgttccccggttccgttccccgttaccccccgg

SEQ ID NO: 166490 - DNA, 820 bp, Homo sapiens
  misc_feature: GYAE6OF01DP71X.26.71.G05.1.454.CMB.1.raw
  modified_base (244)..(244): a, c, t, g, unknown or other
  misc_feature (244)..(244): n is a, c, g, or t
tcagagactatactcacgaccggtgctcgatttagtgtcgtcgcaagagagagggggcgtgggcctcaggaagcagcatcggaggtgcctcagccatggcatggatccctctcttcctcggcgtccttgcttactgcacaggatccgtggccttcgatgagctgattcagcccaccctcagtcgtccgtcgtccccaggacagacagcccaccatccacctgcctcggcagacaaagttggganatagaatgctgcctggtataccgagacgccaggcctacgtccccttagtttcggcctattcctaccgaagtactaacggaaacgcccggaccctacggaacgggtacctccccgaggtacccgttaagttttccgtacggtaccctacccgtaaaccgtccgtaacgggaaaccctaccgacggtacccctaaccgttcgtaaccgaacccgtaacgtaccggaccggggaccccgggggacccccaacgggaacccccgtaaacggggaacgttacggggaaccgggtaaccgtaaccgttaaacgttaccggtttacgtaccgggtaaggggtaccggttaaggggtaacgtaaacgtttaaccggtttaaggttttacgggtttaaggggtttccgggttttaacgggggacggggtaaccgggtaaccggtacgggtaccggttaccgggtacccgttacccgggtaagggtaccccgaaccgggtcccccggtaaacgggtccccgttaccccgggtccccccgttacgggtaccccttaacccgttcccgtttccccggttaaccccccc

SEQ ID NO: 166491 - DNA, 611 bp, Homo sapiens
  misc_feature: GYAE6OF01B5FNE.26.71.G05.1.454.CMB.1.raw
  modified_base (404)..(404): a, c, t, g, unknown or other
  misc_feature (404)..(404): n is a, c, g, or t
tcagagactatactcacgaccggtgctcgatttagtgtcgtcgcaagagagaggggggactcctgtgccccaccatggacacgctttgctccacgctcctgctgctgaccatcccttcatgggtcttgtcccagatcaccttgaaggagtctggtcctgcgctgggtggagccccacgcagacccctcacgctgacctgctccgtctctgattctcactcaccacgactgaggtgatgtcggccgtgggtccgtcgacgggacccccggaaaggcccgtggaggtggcttcgctactctatttacgtggagtgatctacgaaggtcgtaccaatccgtctcgtgaggactcgactccacatccacgaggaccaccacgaacggcggtcgtacctacatcgacanatgactccgtgtacgacacgacggacaactattaattcgtgtcgacctacacgtacgtccgtacggccggacttaacgacggtaaagaaaagtaagttacgtagtaaccggtttagggtcgggtaacggtaagggtttacgttttaccgggacctaccccggtcccttccccaaccgtcccctaacccgacccgggtaaaccccggg

SEQ ID NO: 166492 - DNA, 803 bp, Homo sapiens
  misc_feature: GYAE6OF01ETEN6.26.71.G05.1.454.CMB.1.raw
  modified_base (179)..(179): a, c, t, g, unknown or other
  misc_feature (179)..(179): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcacgcccaccctnagtcgtccgtcgtccccagggacagacagcccaaccactcacctgcctccggacaacgactaaagttgggaataataagaaatcgcttcgccgttaggttaacttaaccgaggaccggaccacggaccgtaccgtttcccctttaagttttccggtacttacgttaccctttaaccgaaggtaacgtaacggaacggtaccggtacccccttaggaccgggtaaccttaccccgtacggtaacccttaacgtttccgtacggtacccttaacccgtaaccgttaccggtaacgggaaacctaccgaaccgtacccctacgtactaccggaacctaacgtaccggaaccggtaccgggaccccgaaccggacccgaacggaacgtacggaacgggtaacgtaacttaaccgttagttacggtacgtagggtacggttagggaacgtaacgttaagtacgtttaggttagggtttacgggttcgggtacggggtacgggtaaccggtacggaccggttaccggtacccggttaccggtaacgggtaccgaaccggtaacccggaccggtaccgtccccgtacccgggggttacctacccgttcccgttccgttcccgttacccccg

SEQ ID NO: 166493 - DNA, 600 bp, Homo sapiens
  misc_feature: GYAE6OF01E1PUZ.26.71.G05.1.454.CMB.1.raw
  modified_base (319)..(319): a, c, t, g, unknown or other
  misc_feature (319)..(319): n is a, c, g, or t
tcagagactatactcacgaccggtgctcgatttagtgtcgtcgcaagagagaggggggactcctgtgccccaccatggacacgctttgctccacgctcctgctgctgaccatcccttcatgggtcttgtcccagatcaccttgaaggagtctggtcctgcgctggtggagcccacgcagaccctcacgctgacctgctccgtctctggattctcactcaccacgactgaggtgaatgtgcctggccgtcaggcccccgaaggccctggagtggcttgcactcatttacgtggagtgatctcaagcggtacaactccgtntctgagaactcgactcaccatcaccaggaccacctaccaaacggaccggtgtaccttacaattcgaacccgtacatcgaactccctgtacggacacgaggacacgattaattaccgtgtcgaccaacacctagtaccctaggccggtacctacggacgaaacgaaaagaaacgttagtacgaacgtttaggttacgggggaaccctaagggggttaaatttttcgggacctaccccggttcctacccccgaagtccccttaccccgacggtaaaccccggg

SEQ ID NO: 166494 - DNA, 778 bp, Homo sapiens
  misc_feature: GYAE6OF01C5SP2.26.71.G05.1.454.CMB.1.raw
  modified_base (133)..(133): a, c, t, g, unknown or other
  misc_feature (133)..(133): n is a, c, g, or t
  modified_base (178)..(178): a, c, t, g, unknown or other
  misc_feature (178)..(178): n is a, c, g, or t
  modified_base (224)..(224): a, c, t, g, unknown or other
  misc_feature (224)..(224): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtcttgcttacngcacaggactccgtggccttgatgagctgattcacgcccaccctnagtcgtccgtcgtaccccaggacagacacgaccaccatccactgcncggcaagactaagtggaagataagaagtgacgtgccgttagtaacgtaccgagacgccacggcctaccgtcctttagtttcgctacgtcttacgaagactaacgacgccggaccctagacgggtacctccgtacgaaccgtagttacgtcggtaccctacaaccgttcggtaacggaaccaacgaccgtaccctacgtaccgtacggaccctaagtccggaccgggtccggggaccccaaggtaccccgaaagggtcgacgggtaacgggtactaacggttaccgttaacgttacggacccggtaacgggtacggggtaagggaaacgttaaacgttaaccgtttagtttaacgggtaagggttttaccgggttagggggaaccgggtaacgggtacccgaacgggtcccgttaacccggggtaccggtttaacccggtaacgggtacccgtaaacccgggtcccggtaaccggggttccccgttacccccggtaccccccgtttacggggtaccctttaaccccgttcccgttaacccccggttttacccccc

SEQ ID NO: 166495 - DNA, 758 bp, Homo sapiens
  misc_feature: GYAE6OF01D5ZNA.26.71.G05.1.454.CMB.1.raw
  modified_base (225)..(225): a, c, t, g, unknown or other
  misc_feature (225)..(225): n is a, c, g, or t
tcagagactatactcacgaccggtgctcgatttagtgtcgtcgcaagagagagggggcctcaggaagcagcatcggaggtgcctcagccatggcatggactccctctcttcctcggcgtccttgcttactgcacgaggactccggtggtccttcgatgagctgattcacgccaccctcagtcgtccgtcgtcccaggacagacacgccacatcacctgcctcggnacgaactaaagttggaagatagaaatgcgtgccgtaggtaacttaaccgagacggaccgacggccctacgttccccttagttttcggacctacttcttaccgaaaggtaactaacggaacgccggtacctacggacgggtactacccgtacgtaaccgtaactttcggtacggtccttaccgaaccttacggtaacgggaaacctccgaacggaccccctacttaccgtacggtaaccctaacggttacccgggaaccgggcccggggaaccccaacgggtaccccggaaacgggtacggtaacggggaaccgggtaataacccgttaaccgtttaggttaccggtacgggtacgggtaccgggagggttaactaaggttacgtttagtttacggtaggggtttggttacgggacgggaacgggtaccggtacgggacgttccggtaccgttaccggtaacggtcgaccggacccgtaaggcccctccgtcccccgtacggtcctaccgtccgttccctcccgtcccgttacg

SEQ ID NO: 166496 - DNA, 655 bp, Homo sapiens
  misc_feature: GYAE6OF01DKCKN.26.71.G05.1.454.CMB.1.raw
tcagagactatactcacgaccggtgctcgatttagtgtcgtcgcaagagagaggggggactcctgtgccccaccatggacacgctttgctccacgctcctgctgctgaccatcccttcatgggtcttgtcccagatcaccttgaaggagtctggtcctgcgctggtggagcccacgcacgaccctcacgctgacctgctccgtctctggattctcactcaccacgactgaggtgaatgtggcctgggtccgtcgaccggaccccggaaacggccctggagtggtcctttcactctagtttacgtggagtgtactcgtacgaacggcggtaacaacgttcccgtctcgtaggaagtaacgtccgacctaccacctactaccaaccgacggaaccaccctaaccgaaacgggtccgggtacgtaccttaacagtacgaaccgacagtacgtaactccgtggtacgaacacgacgacactattacttacgtcgtcacctaacacgtacgtaccgtacggccggtacgtaaccgaagaaacgaaagaactagtagtacgttaggtcggggtaacgtaagggtttaacgttttccggaacccgtacccgttaccccgtacccgtaccgtcccttaaccccgaccggtacccggtaccccg

SEQ ID NO: 166497 - DNA, 691 bp, Homo sapiens
  misc_feature: GYAE6OF01ETZRU.26.71.G05.1.454.CMB.1.raw
  modified_base (237)..(237): a, c, t, g, unknown or other
  misc_feature (237)..(237): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtcccgtgtccccaggacagacagccaccatcacctgctcggcagacaaattggganatagaaatgctgcctggtattaccagaggccaggccagtcccctattttcggtcatcttccaagataagaacgcggccctacgacggtactcccgtgaaccgtaatttcgtggtcctacctaactcgtacggaacacgacgacctacgtctacgacctacgtaccgacgggtcccggggacccacggacccgaaacgggacgtagggaacgggacgtaaccgttaacgttacgttacggtacgaacgggtcgggtaaggggaacgtaaacgttaaccgttagtttacgggttaaggtttcgggttttacggggaccggggtaacgggtaccggaacgggtccgttaccggaaccccggttaccgtacgggttaccgaccggacccgtaacggcccgttaccccgggtcccccgttaccggtacctacccgtttccgtcccgtttaacccccccg

SEQ ID NO: 166498 - DNA, 700 bp, Homo sapiens
  misc_feature: GYAE6OF01D0G6D.26.71.G05.1.454.CMB.1.raw
  modified_base (183)..(183): a, c, t, g, unknown or other
  misc_feature (183)..(183): n is a, c, g, or t
tcagagactatactcacgaccggtgctcgatttagtgtcgtcgcaagagagagggggactcctgtgccccaccatggacacgctttgctccacgctcctgctgctgaccatcccttcatgggtcttgtcccagatcaccttgaagagtctggtcctgcgctggtggagcccacgcagaccctnacgctgacctgctccgtctctggacttctcactcaccacgactgaggtgaagtgtcggccgttgggtcccgtcgacgggacccccggaaggcccgtggagtggcttgcactctatttacgtggagtcgtatcgtacgaaggcggtacaacttccgtctcgtgaagtaactcgactacacactcaaccgtacgggaaccaccgtaaccgaaacgggtacccggttacggtaccttaaccgtaagtaccgaaccgtacgtaagtacgtaacctccgttaggtacggaaccgaacgacgggtaccaacgttaacttaacgtttaaccgtggtacgaacccgtaacgaaccttaaccggtaccgtaccgggtaccggttactaaccggaaccgaaagtaaaaacgtaagtagttaacgtacgttaacgggttacggggacgttaaagggttaagttttaccggtaccgtaccccgttccgtacccccgtagtcccccgtaaccgtaacccggtaacccggg

SEQ ID NO: 166499 - DNA, 752 bp, Homo sapiens
  misc_feature: GYAE6OF01AI0N0.26.71.G05.1.454.CMB.1.raw
  modified_base (147)..(147): a, c, t, g, unknown or other
  misc_feature (147)..(147): n is a, c, g, or t
tcagagactatactcacgaccggtgctcgatttagtgtcgtcgcaagagagaggggtccatgccatggcatggatccctctcttcctcggcgtccttgcttactgcacaggatccgtggccttcgatgagctgattcagccaccctnagtgtccgtgtccccaggacagacagccacatcacctgctcggcagacaaagtggagatagaatgctgctaggtatacgagagccaggccacgtcccttagtttcggcattcgttacaagtataacggaacggccggccctagacgggtacttcccgtacgtaaccgtaattttcgacggtcctaccgtaacgtcgtacgggaacacgacgccctaacgtcgtacgacctagtaccgacgggccgggtacccaacggaccgtaaacgggagtagggaagggtacctaacttacgtattacggtacgagggtcggtagggaaacttacgtaacgtttagttacgggtaggtttcggtacgggacgggtaacggtaccggtaggtaccgttacggtacccgttaccggtacgggaccgtaaccggtaccccgtaagggtccccgttacccgggtaacccccccgttcggggttaacccttaccccgttacccggtttacccccggtttaccccccctaccccggtttaccgttacccgttaaccggttaacctttacgggtttcccgttaccggtagggccccgggtaccggtcggtaaacccgggg

SEQ ID NO: 166500 - DNA, 745 bp, Homo sapiens
  misc_feature: GYAE6OF01CCI37.26.71.G05.1.454.CMB.1.raw
  modified_base (239)..(239): a, c, t, g, unknown or other
  misc_feature (239)..(239): n is a, c, g, or t
tcagagactatactcacgaccggtgctcgatttagtgtcgtcgcaagagagagggggctgggcctcaggaagcagcatcggaggtgcctcagccatggcatggactccctctcttcctcggcgtccttgcttactgcacaggatccgtgccttcgatgagctgattcacgccacctcagtcgtccgtcgcccaggacagacacgccaccatccacctgctcggcagactaagtgggaanatagaatgctcgctagtactacagcggaccgacggcctacgttccccttagtttcggtactactcttaccaagtaataacggacgccggacctacgacggtacctccgtacgaccgttaacttcgtacggtaccttaccaacgttccgtaacgggaaaccacgaccgtaccctaccgttaccgtaccgtaacctacgtaccggaccggggaccccgggaccccaacgggtaaccccggaacggaacggtacgggaacggggtaacctaaccgttaacgttaacgtcgggtaccggtaacggggtacggtaacgggtaagttaacgttaacgtttacgtttaggggttagggtttacgggttacggggtaccgggacgggtaacggtacgggtacccgttaccgggaacccggttacggtaccgggtaccgaacccggtccggaacggttccccgtaccccggtccccgtaccgtacccgtcccgttcccgtccccggttacccccg

SEQ ID NO: 166501 - DNA, 793 bp, Homo sapiens
  misc_feature: GYAE6OF01CGMAH.26.71.G05.1.454.CMB.1.raw
tcagagactatactcacgaccggtgctcgatttagtgtcgtcgcaagagagaggggggactcctgtgccccaccatggacacgctttgctccacgctcctgctgctgaccatcccttcatgggtcttgtcccagatcaccttgaaggagtctggtcctgcgcgtggtggacgcccacgcacgaccctcacgctgacctgctccgtctactgacttctcactcaccacgactgagtgaatggtcggccgtcgggtccgtcgaccgggaccccggaaacggcccgtgggagtcggtcgttgccacttcagtttacgtaggtagtgtactctacgaacgacggtaactacgtccgtactcgtaggaaggtactcgactcaacctactaccgacgacggacctaaccgtaccgaaacggtcgggtacgtacctacgtaagtacgtaaccgactagtacgtaacgttccgtacgggtacgaaccgtaacggacgtaccgtaactaacgtttaacgttaaccgttcgtaccgtacaaccgaaccgtaaccgttaccccggtaacggtacccgggtaaccttaacccgggaaaccggtaaaaggtaaaaaacggtaacttaacgggttaaacggttaaccggttaacggggttttacccgggggtaaaccggttaaacggggggtttttaaacccgttttaaccggggttaaccccgttaacccccgttcccccggttaaacccccgtacccggttaaaccccccctacccgggaaacccccgggttaaaacccccgggg

SEQ ID NO: 166502 - DNA, 761 bp, Homo sapiens
  misc_feature: GYAE6OF01BTA8T.26.71.G05.1.454.CMB.1.raw
  modified_base (201)..(201): a, c, t, g, unknown or other
  misc_feature (201)..(201): n is a, c, g, or t
  modified_base (228)..(228): a, c, t, g, unknown or other
  misc_feature (228)..(228): n is a, c, g, or t
tcagagactatactcacgaccggtgctcgatttagtgtcgtcgcaagagagaggggcctcaggaagcagcatcggaggtgcctcagccatggcatggatccctctcttcctcggcgtccttgcttactgcacaggatccgtggccttcgatgagctgattcagccaccctcagtgtccgtgtcccaggacagacagccacntcacctgctcggcagacaaagttgganataagaaatgactcgccgtaggtaacttaccgaggacggccagggccctacggttacccccttatttttacgggtcctaactttccgttacccgaaaggtaacttaaacggaacgtacccgggtccccttacgaacggggtaaccttcccccgtaggaaccccggttaaattttccgtcggacccttaccctaaacgttcgtaacgggaacaccgacgtacccaaccgttctaccggaaccctagtaccggaacggcccggggaccccaacgggaccccgaaacgggtacgtacgggaacgggtacgaaccgttacgttaacgttcgtaccggacgggtacgggtagggaactaacgttaacgttaagttaggttaacggtttgggtttaggggacggttaaccgggaccggtacggaccgtcggtaacccggttccgtacgggtaccgaacggtaccccgaaggtcccgtacccggtcccccctacgggttccctacgttcccgttaccggttcccccgtccccgttacccg

SEQ ID NO: 166503 - DNA, 695 bp, Homo sapiens
  misc_feature: GYAE6OF01C7M6V.26.71.G05.1.454.CMB.1.raw
  modified_base (217)..(217): a, c, t, g, unknown or other
  misc_feature (217)..(217): n is a, c, g, or t
  modified_base (235)..(235): a, c, t, g, unknown or other
  misc_feature (235)..(235): n is a, c, g, or t
  modified_base (578)..(578): a, c, t, g, unknown or other
  misc_feature (578)..(578): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcacgccaccctcagtcgtccgtcgtccccaggacagacagccacatcactnctcggcagacaagtgganatagaatgctgcctgtactaccgagacgccaggccacgtccctagtttcgactatccttaccaaagtataaacggaacgccggtacccctaggacgggtactcccgttacggaacccgttaatttcgtcggtaccctaccgaaacgttccggacggaacctaacgacggacccctacgtcctacggaaccctacgtaccgacgggcccgggacccacggacccgaaacggagtacgggaaggacgtaccttaagtacgttcgtacgtagggcggtagggaagtaacgtaacgttagtttagggttacggttggggtttacggaaccgggggtacggtaaccgnggttaccggtaccggtacccggttaccgtacgggttaccgaaccggtccccggaacggtcccgttaccccggccccggttaccgtacccgttacccgttcgtccccgtttacccccg

SEQ ID NO: 166504 - DNA, 633 bp, Homo sapiens
  misc_feature: GYAE6OF01BD8W5.26.71.G05.1.454.CMB.1.raw
  modified_base (512)..(512): a, c, t, g, unknown or other
  misc_feature (512)..(512): n is a, c, g, or t
tcagagactatactcacgaccggtgctcgatttagtgtcgtcgcaagagagaggggggactcctgtgccccaccatggacacgctttgctccacgctcctgctgctgaccatcccttcatgggtcttgtcccagatcaccttgaaggagtctggtcctgcgctgggtggacgccccacgcacgacccctcacgctgacctgctccgtctctggattctcactcaccacgactgaggtgaatgtggccgtgggtccgtcgacggccccggaaaggcccgtggagtcggcttgccacttctattttacgtggagtgatcgtacagcggtacaatccgtctctgagatcgactcaccataccacgacgggacaccctaccgaaacggtaccgggtacgtcccttaacaagtcgaaccgacagtagtaacttccgtaggtacgaacgacacggacataacttatactcgtacgcaacacgtacgtaccgaggcccgacgttacgacgaaagaaaanaattaacgtagtaacgttacgggttacgggtaccgtaaggggttaacgttttacgggaccctaacccggttaccctaccccgtaacccgtccccgtacccgtaaccccggtaaaccccggg

SEQ ID NO: 166505 - DNA, 702 bp, Homo sapiens
  misc_feature: GYAE6OF01ASHO4.26.71.G05.1.454.CMB.1.raw
  modified_base (175)..(175): a, c, t, g, unknown or other
  misc_feature (175)..(175): n is a, c, g, or t
  modified_base (233)..(233): a, c, t, g, unknown or other
  misc_feature (233)..(233): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagcccaccctnagtgtccgtcgtccccaggacagacagccacatcacctgctcggcagacaagttgganatagaatgctgctgtatacgagacggccaggccacgtccctattttcggctatccttccaagataagacgccgtaccctacgacgggtactcccgtagtaaccgtaagtttccgtacggtcctaccgtaacgttcgtacgggaaccacgacgaccctactccgtacggaacccagtaccgacgggacccgggacccaacggacccgaaacgggagtacgggaagggacgtaaccgttacgttagttcgacgtacggcggtagggaactaagttacgtagtttaggttacggttaggtttaggggaccgggtaacgggaccgtagggtccgttaccggtacccggttaccggtacgggtaccgtacccggacccggtaaccgggtcccgttaccccggtaccccccgttaccgggtacccttacccggtttacccgttcccccggtttccccccgtccccgtttaccccg

SEQ ID NO: 166506 - DNA, 790 bp, Homo sapiens
  misc_feature: GYAE6OF01DAYKH.26.71.G05.1.454.CMB.1.raw
  modified_base (242)..(242): a, c, t, g, unknown or other
  misc_feature (242)..(242): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagcccaccctcagtcgtccgtcgtccccaggacagacacgccaccatccacctgcctcggcagaacaaagttggganatagaatgctgcctggtattaccaggacggccacggccacgtccccttagtttggtctagtccttaccaagaatagaaggcgccctagacggactccctcgaaccgtaatttctcggctaccgtaactcgtagggaaccacacgcccactactacggaacccacgtaccgaacgggtcccgggaccccgaacggtacccgaaacgggtaacgtacggggaaacgggtaacgtaaccccgttaacggttaaacgtttccgggttaaccggtacggggtaccggggttaacggggaaacggtttaaacggttaaaccgtttaacgggttttacggtttaaggggttttacgggtttcggggggtaaccggggtaacgggggtacccgggtagggtaaccggttacccggtaaccccgggttacccggttacgggtacccgtaaccggaccccggtaaaccggggtcccttacccccgggtcccccggttacccgggtcccttaaccccgtttccggttccccggttcccccccgtcccgttaacccccgg

SEQ ID NO: 166507 - DNA, 662 bp, Homo sapiens
  misc_feature: GYAE6OF01C9LNT.26.71.G05.1.454.CMB.1.raw
  modified_base (241)..(241): a, c, t, g, unknown or other
  misc_feature (241)..(241): n is a, c, g, or t
  modified_base (301)..(301): a, c, t, g, unknown or other
  misc_feature (301)..(301): n is a, c, g, or t
  modified_base (367)..(367): a, c, t, g, unknown or other
  misc_feature (367)..(367): n is a, c, g, or t
tcagagactatactcacgaccggtgctcgatttagtgtcgtcgcaagagagagggggctgggcctcaggaagcagcatcggaggtgcctcagccatggcatggactccctctcttcctcggctccttgcttactgcacaggatcccgtggcccttgatgacgctagattcagcccacctcagtcgtccgtgccccaggaccagacacgccaccatcacctgctcggcaagacaagtggganaataagaatgctgcctagtactacagacgccaggccacgtccctatttgcatctaccaanataagaacgccgccagacggatcccgtagacctaattcacggccttacaaactcgtacggaaaccncgtacgaccactacgtaccgaccaagtaccgacggaccggggacccaacggacccgaaaggacgtaagggacggggaacgtacctaacgttacgttaggtaccggtacgggaacggttagggaacggtaaacttaacgttaaggttacggttaggttacgggtttacgggaccggggtaacgggtaccgacgggtcgttaccgggaccggttaacccggtagggtaccgaccggacccgaaacggtcccgaccggtcccccgtacggttcctaactcccgttccgttaacccccg

SEQ ID NO: 166508 - DNA, 701 bp, Homo sapiens
  misc_feature: GYAE6OF01CXH8A.26.71.G05.1.454.CMB.1.raw
  modified_base (241)..(241): a, c, t, g, unknown or other
  misc_feature (241)..(241): n is a, c, g, or t
  modified_base (365)..(365): a, c, t, g, unknown or other
  misc_feature (365)..(365): n is a, c, g, or t
  modified_base (396)..(396): a, c, t, g, unknown or other
  misc_feature (396)..(396): n is a, c, g, or t
  modified_base (407)..(407): a, c, t, g, unknown or other
  misc_feature (407)..(407): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccaccctcagtcgtccgtgtccccaggaccagacagccaccatccacctgctcggacagacaaagtggganatagaatgactgacctggtaataccgagacggccaggaccctagttccccttaagttttcggctattcctaccaagataagaagccggacctcgaagggtactcccgtagaccgtaatttccgnggacctaccaacgtcgtacgggaacacgacnccctactaccncgaccctagtacccgacgggaccggggtccccaaggacccgtaaacgggtagtaacgggaacgggactaaccgttacttaacgttcgtaccgtaggggcggtaaggggtaacgtaaacgttacgttaagtttacggttaggtttggtttacggggacgggtacgggtaaccgacgggtcgtaccgggtacccgtaccggtaacggtccgaaccggtaccccggaacggggtccctcccggtaccccccggttagggttccccgtaacccgtttccgttccgggttacccccccg

SEQ ID NO: 166509 - DNA, 684 bp, Homo sapiens
  misc_feature: GYAE6OF01CWM47.26.71.G05.1.454.CMB.1.raw
  modified_base (248)..(248): a, c, t, g, unknown or other
  misc_feature (248)..(248): n is a, c, g, or t
  modified_base (410)..(410): a, c, t, g, unknown or other
  misc_feature (410)..(410): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggactccgtgccttcgatgagctagacttcacgcccaccctcacgtcgtcccgtcgtccccaggacagacacgccaaccatccacctgctcggacagacaaagtggaanataagaatgctgcctagtactacgagacgcacggcctacgttccccgtttagtttcgctacttactaccgaagtaagtaacgacgtccgacctacggaacggtactcccgtacgtaaccgttaatttccgcggtaccctaccgtaacttcggaacggaaccncacgccctaactccgtacgacctacgaccggacggtcccgggaacccacggacccgtaaggagaacgggacgggaactaccttaagtagttaccgacggacggtacggtaaggtaagttaacttagttacgtttagggtacggtttgggttacgggacgggtacgggacgacgggtccgtaccggtaccggttacggacggtacccgacggtacccggagtaccccgttccggacccccgttaggtccctacccgtccgttacccggtaccccc

SEQ ID NO: 166510 - DNA, 697 bp, Homo sapiens
  misc_feature: GYAE6OF01C3UT9.26.71.G05.1.454.CMB.1.raw
tcagagactatactcacgaccggtgctcgatttagtgtcgtcgcaagagagaggggtccatagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtccctatttggtcatctcaagataagagcggcctcgaggatccctgaccgaatttctggctccaacgtctaggaacacgacgccactctgaccatccgaaggccggggcccacggacccgaaacgggataggacgggacgtaaccgttaacttaacgttcggttaccgaagggtccggttaggggaacgtaaagttaaccgttaagttttggttacggtttaggtttagggaccgggtaacggggaaccgtagggtaccgttcggtaacccggttcccgttaagggtcccgtaacggaccccgtaaacgggcccgttaccggtccccccgttaccgggtcctaccgtttcccgttccggtttccccccggaccccctttccccgttaccgtacggtttaacgttacggtttccttacgttacgggaaccgggtcccggggtcgttaccgggg

SEQ ID NO: 166511 - DNA, 662 bp, Homo sapiens
  misc_feature: GYAE6OF01EUQZP.26.71.G05.1.454.CMB.1.raw
  modified_base (292)..(292): a, c, t, g, unknown or other
  misc_feature (292)..(292): n is a, c, g, or t
tcagagactatactcacgaccggtgctcgatttagtgtcgtcgcaagagagagggggctgggcctcagggaagcagcatcggaggtgcctcagccatggcatggatccctctcttcctcggcgtccttgcttactgcacaggactccgtggccttcgatgagctgattcacgcccaccctcagtcgtccgtcgtccccgaggacagacacgccaccactccacctgcctaccggcagaactaaagtgggaatataagaatgctgtcctaggtactacgagacggccaggccncgttcccttagtttcgctatctacaagataagacgccggcctgacggactcccgtagaccgtaatttcgcgcctaccgtacgtccgtaggaacacgacgacctactcgtaccgactagtccgaccgggcccgggtacccacgggaccggaaacggcgtagggaacggactacgttacgtacgttcggacgtacgggtacggtaggaacgtaattacgttagttaggtaggtttggtacgggacgggtacgggccgtacggtcggttaccgacccggttcggtacgggtacgacccggacccggtaacgggtccctaccccggtcccccggttacgaaccccgttccgttccgttccccggtaccccccgg

SEQ ID NO: 166512 - DNA, 639 bp, Homo sapiens
  misc_feature: GYAE6OF01CD9OO.26.71.G05.1.454.CMB.1.raw
  modified_base (385)..(385): a, c, t, g, unknown or other
  misc_feature (385)..(385): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtcgtccccaggacagacacgccaccatccacctgcctcggcagacaaagtggagatagaatgctgcctggtacttaccagacggccaggcctacgtcccctattttcggctatcttaccaagtataagaacgcggccctgaggactccgtagaccgtaattcgcggtctaccaacgtcgtacggaacacgacgccactcncgaaccactcgacggccggggacccacggacccgaacggagtacgggaacgggtacgtaacgtaacgttacgttcggtacgagggtcggtagggaagtaaacgttaaccgttagttacgggttaggttggttacgggcgggtacgggaccgtagggccgtacggacccggttacgtacgggtaccacggtaccccgaaggtcccgtaccggtcccccgttacggacctcccggttccgttcccgttaccccccg

SEQ ID NO: 166513 - DNA, 754 bp, Homo sapiens
  misc_feature: GYAE6OF01BON6O.26.71.G05.1.454.CMB.1.raw
  modified_base (172)..(172): a, c, t, g, unknown or other
  misc_feature (172)..(172): n is a, c, g, or t
  modified_base (237)..(237): a, c, t, g, unknown or other
  misc_feature (237)..(237): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctnagtgtccgtgtccccaggacagacagccaccatcaccgtgcctcggacagacaaagttggggaanagtaagaatcggctcggtccgttaggttacttaaccgaggtaccggcccgaacggcccctaccggttaccccctttagttttacgggtccttacttacccgtaacgaacgtaaagtaaaccggacggccccgtacccgtagggaacggttacctacccgtaacggtaaccttacgtttcggtaccgtaccctaaccgtaccgtacggtacgaaccacgaccgtaccctctaccgaccgaaccgttacgacgggaccggggtccccggaccaaccggaacccggtaagggtaggaacgggaaggaacctaaccgttacttacggtaccggtacgggacgggtacgggtaaggaacgtttaaagttcgttaagggtttagtaggtttcgggtacggggaccggtacggacggtcgtacgtcccggtaccgttgaccggtaccgacccggtagaccggtcccgtacccccggtacgtacccgtccttccgtacccgttccccgaaccccttccgtacccg

SEQ ID NO: 166514 - DNA, 680 bp, Homo sapiens
  misc_feature: GYAE6OF01C1TIU.26.71.G05.1.454.CMB.1.raw
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccacctcagtgtccgtgtccccaggacagaccagccaccatcacctgctcggcagacaaagttggagatagaaatgctgcctggtattaccagaggccacggccagtccccttagttttcggtctatactttccaaagtaataaggtaacgccggaccccttacgaacgggactccccgtaggaccgtaattttcgtcggacctaccgtaactcgttaacgggaacacgaacgcctactctacgacctactcgacggccgggacccacgtacccgaacgggaagtacggaacgggaacgtactaacgttagttcgacgtaggcgggtaggaaggtaattacgttaagtttacggttaaggtttgggtttacggggacgggtaacgggaccgtacgggcgtacgggtacccgtacggttacggacgtacggtacccggaacggtcccgttacccgggtacccccctcgggtacccctaaccgttccgttcccggttcccccgtccccgttaaccccg

SEQ ID NO: 166515 - DNA, 675 bp, Homo sapiens
  misc_feature: GYAE6OF01ARDMN.26.71.G05.1.454.CMB.1.raw
  modified_base (175)..(175): a, c, t, g, unknown or other
  misc_feature (175)..(175): n is a, c, g, or t
  modified_base (236)..(236): a, c, t, g, unknown or other
  misc_feature (236)..(236): n is a, c, g, or t
  modified_base (244)..(244): a, c, t, g, unknown or other
  misc_feature (244)..(244): n is a, c, g, or t
  modified_base (349)..(349): a, c, t, g, unknown or other
  misc_feature (349)..(349): n is a, c, g, or t
  modified_base (429)..(429): a, c, t, g, unknown or other
  misc_feature (429)..(429): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttgatgagctgattcagcccaccctnagtgtcccgtcgtccccaggacagacacgccaccatcacctgctcggcagacaagtggganatagaatnctgcctggtacttaccgagacggccaggccctacgtccccttatttggtcattcttccaagataaggacgccggaccctgaggtctccgtagaccgtaatttcgnggtacctccgaactcgtacgggaaccacgacgcccactcctgaacccagtcgacggccgggacccacggtccgaaacggngtagggagggaacgtacgtactaggttacgacgtacggtcgggtacgggagtaaacgttacgttaagttaggttaaggttcgggttttcgggacgggtacgggaaccgtgggtaccgtacggtacccggttccgtaacgggttccgaaccggtacccggtaaagggtccccgtcccggaccccccgtttaccgggtcccgtaacccgtttccccacccggttttcccccgaccccgttttaccccg

SEQ ID NO: 166516 - DNA, 661 bp, Homo sapiens
  misc_feature: GYAE6OF01D1CJI.26.71.G05.1.454.CMB.1.raw
tcagagactatactcacgaccggtgctcgatttagtgtcgtcgcaagagagaggggggactcctgtgccccaccatggacacgctttgctccacgctcctgctgctgaccatcccttcatgggtcttgtcccagatcaccttgaaggagtctggtcctgcgctggtggagcccacgcacgaccctcaccgctgacctgcctccgtctctggtattctcactccaccacgactggaggtgaagtggtcggtccgtcgggtccgtccgaccgggacccccggaaacggcccgtggaggtggtcttcgcaccttctattttacgtggtagtgattcctacgaaggtccggtaactaacttccgtctcgtagaaggtactccgactccaccactacaccgaggaccaccctaacgaaacggaccggttacgtaccttaactaacgtacgaaccactatacgaacttccgtagacggacacgagacaactattacttcgtgcaccacaacctacgtcccgtaggacggtaccgtacggaacgtaagaaaacgtaataagttaccgaagttaggggttaccgggacggttaagggtttaacgttttaccggccctacccggttccctaccccaacccgtcccttaacccggaacccggtaacccggg

SEQ ID NO: 166517 - DNA, 506 bp, Homo sapiens
  misc_feature: GYAE6OF01BJ582.26.71.G05.1.454.CMB.1.raw
  modified_base (231)..(231): a, c, t, g, unknown or other
  misc_feature (231)..(231): n is a, c, g, or t
  modified_base (320)..(320): a, c, t, g, unknown or other
  misc_feature (320)..(320): n is a, c, g, or t
  modified_base (332)..(332): a, c, t, g, unknown or other
  misc_feature (332)..(332): n is a, c, g, or t
  modified_base (393)..(393): a, c, t, g, unknown or other
  misc_feature (393)..(393): n is a, c, g, or t
  modified_base (443)..(443): a, c, t, g, unknown or other
  misc_feature (443)..(443): n is a, c, g, or t
  modified_base (478)..(478): a, c, t, g, unknown or other
  misc_feature (478)..(478): n is a, c, g, or t
  modified_base (485)..(485): a, c, t, g, unknown or other
  misc_feature (485)..(485): n is a, c, g, or t
  modified_base (493)..(493): a, c, t, g, unknown or other
  misc_feature (493)..(493): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagacggccaggccagtcccctatttggtcatcttaccaagataagaagcggccctcagggatccngaccgaatttcnggctccaactctagggaaacacacgccactctgaccatcgagcgggacccagccaacgganggaggagactactatgtcgaggcgtaggagaatactattgtagtgttggnggaggcaggctgaccgtctaggtcagtccaaggcncgccccncgtcactntcgtcccgcctcc

SEQ ID NO: 166518 - DNA, 669 bp, Homo sapiens
  misc_feature: GYAE6OF01EPOYP.26.71.G05.1.454.CMB.1.raw
tcagagactatactcacgaccggtgctcgatttagtgtcgtcgcaagagagaggggtccatgccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaatgctgcctggtattaccagacgccaggccagtccccttattttgtctatcttccaagataagaagccggccctacgaggggactcccgtcgtaacccgtaattttccgtcggtacctacccgtaaccttcgtacgggaaaccacgacgcccaactcgtacgacctacgtcgacggcccggggacccacggtacccgaaaccgggtagtacgggaacgggaacgtaaccttaacgttagtttacggtacgtacgggtacggggtagggtaaacgtaaacttacgttaagtttacggttaggtttgggtttacgggacgggtacgggaccgagggtccgtacggtccgtaccgtacggtcgaccgtacccgagtccgcccgtacccgtcgcctaccgtcttccgttcccctacccttcctcgacttacgtacgttcgtactggccggcgggtcgtcggg

SEQ ID NO: 166519 - DNA, 562 bp, Homo sapiens
  misc_feature: GYAE6OF01C594Z.26.71.G05.1.454.CMB.1.raw
  modified_base (196)..(196): a, c, t, g, unknown or other
  misc_feature (196)..(196): n is a, c, g, or t
  modified_base (228)..(228): a, c, t, g, unknown or other
  misc_feature (228)..(228): n is a, c, g, or t
  modified_base (251)..(251): a, c, t, g, unknown or other
  misc_feature (251)..(251): n is a, c, g, or t
  modified_base (304)..(304): a, c, t, g, unknown or other
  misc_feature (304)..(304): n is a, c, g, or t
  modified_base (314)..(314): a, c, t, g, unknown or other
  misc_feature (314)..(314): n is a, c, g, or t
  modified_base (337)..(337): a, c, t, g, unknown or other
  misc_feature (337)..(337): n is a, c, g, or t
  modified_base (342)..(342): a, c, t, g, unknown or other
  misc_feature (342)..(342): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttgatgagctgattcagcccacctcagtgtccgtcgtcccaggacagacngccacatcactgctcgcagactaagtgggaanatagaatgctgcctggtataccngacgcagccatccctatttgcatctacagatagagccgacctgaggctccganacgtattcgngctacgactcgtaaggactcacncactnacacactcgacggacccgggccaacggccgaacggagtacgggaaggtacgaacgttacctagtttcgcgtagggcgtagggaataattacgtaattcggtagtttcgggttggaccgggtagaaccgtggtactacggaccgtacgtagtacgaccgacggtaccgtcgcccgtacccgtccggttaccacgttccgtcccgtccccgtcccttaaccg

SEQ ID NO: 166520 - DNA, 724 bp, Homo sapiens
  misc_feature: GYAE6OF01BFRZ9.26.71.G05.1.454.CMB.1.raw
  modified_base (232)..(232): a, c, t, g, unknown or other
  misc_feature (232)..(232): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaagtgganatagaatgctgcctggtattaccagaggccaggccacgtcccctattttggtcattccttaccaagtataagaacgccggaccctcgaagggactccccgtagaacccgtaatttcgtggtcctaccaactcgtacgggaacacacgcccactctacgaccagtccgacggcccggggaccccacggaccccgaaacgggagtacggaacggggtaacgtaccttaacgttagtttcggtaccgtaacgggcggtacgggtaagtaaacgttacgttaagtttaggttacggtttcggggtttacggggaacggggtacgggtaccgtagggtaccgtacgggtaccccggtttaccggtaacgggttacccgaaccgggtaaccccggaaacgggtcccccgttaccccgggtccccccccgttacggggttacccctacccggtttacccgttcccccggtttaaccccccgcccccgttttacccccgg

SEQ ID NO: 166521 - DNA, 743 bp, Homo sapiens
  misc_feature: GYAE6OF01EX9TQ.26.71.G05.1.454.CMB.1.raw
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcacgcccaccctcagtcgtcccgtcgtccccagggacagacagccaccatcacctgctcgcagacaaagttggagatagaatgctgccttggtacttaaccaggacggccacggcctacgttccccttaagttttcggtctagtcttaccaagataacgaacgccggccctacgaacggggtacttcccgtacgtaaccgtaactttcgcggtacctccgtaaactccggtacggaaaccaccgacgtacccgacttccgacgacctacgtccggaaccggcccggggtaccccacggaccccgtaaacgggtacggtacgggaaacgggacgtaaccgttacgttacggtttacggacgtacggggtacggtacgggtaagtaaacgttacgttagttagggttacggtttagggtttcgggacgggaacggggaccgtaacggggtccttacccgggtacccggttaccgggttaacgggtcccgtaaacggtcccccggtaacgggtcccgttcccccggtacccccgttcgggtaccccttaccggtttccccgtcccggtttacccccccgg

SEQ ID NO: 166522 - DNA, 668 bp, Homo sapiens
  misc_feature: GYAE6OF01BL6VM.26.71.G05.1.454.CMB.1.raw
  modified_base (233)..(233): a, c, t, g, unknown or other
  misc_feature (233)..(233): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtcgtccgtgtccccaggacagacagccacatcacctgctcggcagacaagttggganatagaatgactgctgtattaccgagagccgaggccacgtcccctatttcggtctacttctaccgaagaataagaacggccggccctacgacgggtactcccgtagtaccgtaatttcgtcggtactacccaactcgtacgggaacacgacgccactcgtacgacctagtccgtacggcccgggacccacggacccgaaacgggtacgtacggaagggaacgacgttaactagttcgtacgtacgggtcggtagggaacgtaagtacgttagttaggttaggttggttacggggacgggtaggggaacctacgggtaccgttcgggaacccgttcgtaacgggtccgaccggtacccgaaggtccccgtcccggtaccccccgttacggtaccctacccgttacccgttcccggttacccccctcccgttaccccg

SEQ ID NO: 166523 - DNA, 720 bp, Homo sapiens
  misc_feature: GYAE6OF01DE5HP.26.71.G05.1.454.CMB.1.raw
  modified_base (233)..(233): a, c, t, g, unknown or other
  misc_feature (233)..(233): n is a, c, g, or t
  modified_base (373)..(373): a, c, t, g, unknown or other
  misc_feature (373)..(373): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccacctcagtcgtccgtgtccccaggacagacagccaccatcacctgcctcggcagacaaagttggganatagaaatgctgcctggtacttaccgagacggccacggccacggttcccccttagttttcggtacctatccgtttaccaaagtaactaaggaacgccggtaccctacgaagggtactccccgtagtaccgtaatttccgnggtcctaccaactcgtaggaaccacgtacgcctactctacgtaccgatcgacggccgggaccccaagaccgaaacggagtacggaacgggtaactacccgttaactagttcggtacgtagggtccgttagggaacgttaaacgttaacggttaatttagggttaacggtttcggggtttacggggaccggggtaacggggtaccgtaacgggtccgttaccgggtacccggttaccggttacgggtaccggaaccggtaccccgtaaacgggtcccgtaaccccggtccccccggttacggtccctacccgttccgtttaccccgtcccccgtacccgttaaccccg

SEQ ID NO: 166524 - DNA, 703 bp, Homo sapiens
  misc_feature: GYAE6OF01CIM64.26.71.G05.1.454.CMB.1.raw
  modified_base (228)..(228): a, c, t, g, unknown or other
  misc_feature (228)..(228): n is a, c, g, or t
  modified_base (320)..(320): a, c, t, g, unknown or other
  misc_feature (320)..(320): n is a, c, g, or t
  modified_base (331)..(331): a, c, t, g, unknown or other
  misc_feature (331)..(331): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtgccttcgatgagctgattcagccaccctcagtgtccgtgtccccaggacagacagccaccatcacctgctcggcagacaatggganatagaatgctgcctggtataccagacggcagccacgttccctattttcggctatctaccaagataagaacgccgccctgacggctcccgtanaccgtatttcncgtcctaccaactcgtaggaaccactacgaccctactctacgacctatccgacggcccgggacccaacggtaacccgaaagggtacgtacggaacggggtaactaaccgttaacgttaacgtttacggtaccgaagggtccgggttaagggaaacgttaaagtacctttaagggtttaggttttaacgggttcggggtttacggggaccgggtaacggggtaccggtaacgggtccgttaacccggtaccggttacccgtacgggtacccgtaaccgggtaccccgaacgggtccccgtaccccggtaccccccgttccgggtaccctaccccggttcctttaccccggtttcccccgtccccttaccccgg

SEQ ID NO: 166525 - DNA, 723 bp, Homo sapiens
  misc_feature: GYAE6OF01CMZEK.26.71.G05.1.454.CMB.1.raw
  modified_base (238)..(238): a, c, t, g, unknown or other
  misc_feature (238)..(238): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggactccgtggccttcgatgagctgattcagcccaccctcagttcgtccgtcgtccccaggacagacagccaccatcacctgctcggcagacaagtggganatagaatgctgcctggtactaccgagacgcaggcctacgtcccctagttttcgactacttctaccaagactaaggacgccggccctagacgggactcccgtagaccgtatttcgcggccttacaacgtcgacggtaacacgacgcctacctctacgacctagtccgacgggcccgggacccaacggacccgaaacggggtacgtacgggaacggggtaacgtaccctttaagtacggtttacgaccggtagggtaccgggtaagggataaacgttacgtttaaggttaggttagggtttacgggttacggggtaacgggaacggggtaccgacgggttaccgtaccgggtaacccgttacggtaaccgggtacccgtacggaccccgtaaacggggtcccccgtacccgggttacccccccgtcggttaaacccgtacccgttcccggtttaacccccgttcccccgtacccccggtttaacccg

SEQ ID NO: 166526 - DNA, 690 bp, Homo sapiens
  misc_feature: GYAE6OF01CK0FS.26.71.G05.1.454.CMB.1.raw
  modified_base (231)..(231): a, c, t, g, unknown or other
  misc_feature (231)..(231): n is a, c, g, or t
  modified_base (322)..(322): a, c, t, g, unknown or other
  misc_feature (322)..(322): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtcgtccccaggacagacagccacatcacctgctcgcagacaagtgganatagaatgctgcctgtatacagagccaggccagtccctatttgcatctacaagataagacgcgcctcgaggactcctagacgtaatttcgngactaccaacgtcgtaggaacacacgccctactctacgaccagtccgacggccgggacccacggacccgaaacgggagtacggaagggtaacgacttacgtagttcggtaccgagggtaccggtagggtaacgtaaacgttacgttaagtttacgggttaggtttacgggtttacggggacggggtaacggggtaacccgtaggggtcccgttacgggtaccccggttaccgggttcggggttaacccgaacccgggtaccccggaacggggtcccgttacccccgggtcccccccgggttaccgggtaccccgttaacccgtttccccggtttaaccccgtttcccccccgtaccccgtttaccccg

SEQ ID NO: 166527 - DNA, 871 bp, Homo sapiens
  misc_feature: GYAE6OF01AM465.26.71.G05.1.454.CMB.1.raw
  modified_base (243)..(243): a, c, t, g, unknown or other
  misc_feature (243)..(243): n is a, c, g, or t
  modified_base (390)..(390): a, c, t, g, unknown or other
  misc_feature (390)..(390): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcacgcccacctcagtcgtccgtcgtccccgagacagacacgccaccatccacctgctcggacagactaaagtggganataagaatgctgcctagtacttaccgagacggccacggccctacgtccccttattttcggcctacttccgttaccaaagtacgtaaacgacggtcccggtaccctacgacgggtaccttcccgtacggaacccgttaagtttcccgnggtaccctacccgtaaaccgttcggtaacgggaaccaaccgaccgtacccgtaccttacgtaccgaacccacgttacccgacggggaccccggggaccctaacgggaaccccggtaaacgggaggtaaccggggaacggggtaaccgtaaacccgtttaacggttaaccggtttcggggtaacccggttacggggggtacccgggtttaacgggggtaaacgtttaaaccgttaaccggttttaacgggtttacgggttttaacgggtttacggggtttacgggggaacccggggttaagggggtaaccccgtagggggtacccgtttacccggggtaaccccggggtttcccgttaacggggtaccccgtaaccggggtacccccgggtaaaccggttccccgggttacccccggtccccccgggtttaccgggtaacccttaccccggtttcccggttcccccggtttacccccccggg

SEQ ID NO: 166528 - DNA, 741 bp, Homo sapiens
  misc_feature: GYAE6OF01DGW09.26.71.G05.1.454.CMB.1.raw
  modified_base (177)..(177): a, c, t, g, unknown or other
  misc_feature (177)..(177): n is a, c, g, or t
  modified_base (237)..(237): a, c, t, g, unknown or other
  misc_feature (237)..(237): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctnagtcgtccgtcgtccccaggacagacagcccacatcacctgctcggcagacaaagtgganatagaatgctgcctaggtaacttaccgagacggtccagggcccctacggttccccctttaagtttttcgggtacctaattcccgtttaacccaaaggtaaacttaaaacggaaacggtcccggtaccccgtacgaacggggtacctaccccgttagaaccccgttaaagttttccgtacgggtacctaccctaaacgttccgtaacgggaaaccctacgaacggcccctaacgttcgtacgacctaacgtccggaacggcccggggtacccaacggaccccgtaaggaacgtagggaacgggactacgtactagtcgtacgacggcgtagggaataactacgttagttagtagttcgggttaggacgggaggtaccgtagggtcctacggtacccggttacgtaaccgggttcaaccggtaccccgaaacgggtccttacccccgggtacccccgttaccggtacccgttaacccgttcccgttaccccggtttaccccccccg

SEQ ID NO: 166529 - DNA, 926 bp, Homo sapiens
  misc_feature: GYAE6OF01DWG0B.26.71.G05.1.454.CMB.1.raw
  modified_base (175)..(175): a, c, t, g, unknown or other
  misc_feature (175)..(175): n is a, c, g, or t
  modified_base (247)..(247): a, c, t, g, unknown or other
  misc_feature (247)..(247): n is a, c, g, or t
tcagagactatactcacgaccggtgctcgatttagtgtcgtcgcaagagagagggggcctcaggaagcagcatcggaggtgcctcagccatggcatggatccctctccttcctcggcgtccttgcttactgcacaggactccgtggccttcgatgagctgattcagcccaccctnagtgtccgtcgtccccaaggacagacacgaccaaccactccaccctgccgtcggacagaacaaagtgggaanaataagaaatcgctacgccgttaggttaacttaaccgaagacggaccgacggacccgtacgttacccccgtttagtttttacggtacctactttaccgttaacccgtaaaagtaacgttaaaaccggaaccggtacccgggtaccccgttaaccgggtaacggggtaccctaaccccggtttacggaaaacccggttaaaccttttcgtacgggtacctaaccccgtaaacgtcccggtaacgggaaacctaccgaaccgtcccgtaaccttcgtaaccgtaaacccgtagttaccgggaaccgggaccccggggaaccccaaccgggaacccccgtaaaacgggggagttaacggggaacggggttaaaaccgtacccgtttaaacgttacggttaacccggtacgacgggttaccggggttaaggggtaaaccgtttaaacggtttaaccttaaggttttggggttaaaccgggttttaggggtttagggggaaacccgggggttacgggtaacccgaacggggtcccggtttaacccgggtacccggttccggtaacgggttccgaaacccggtaaccgggtaccggtaacccggttcccccgggtcccccgttaacgggttcccctaaaccgttccccggttaaaccctttcccccggtaccccttaaccccggg

SEQ ID NO: 166530 - DNA, 684 bp, Homo sapiens
  misc_feature: GYAE6OF01A0CK7.26.71.G05.1.454.CMB.1.raw
  modified_base (233)..(233): a, c, t, g, unknown or other
  misc_feature (233)..(233): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtcccccagacagacagccaccatcacctgctcggcagacaattggganatagaatgctgcctggtacttaccgagaggccaggtccagttcccctattttcggctattcctccaagtataaggaacgccggccctcgagggactcccgtagaccgtaatttcgtcggtctacccgaactcgtacgggaaaccacgacggcccactccgttacgaccctagtccgagggtcccggggacccaggaccccgaaacgggagtacgggaacggggtacgtaaccttaacgtacgtttacgtaccggagggtccggtaggggaacaagtttaacgttaacgtttacggttagggtttggtttacggggacgggtaacgggtacccgagggtccgtacggtacccgttaccggtacgggtaccgacggtaccccgaaggtcccgtaccgtccccccgttacgggtaccctacggttcccttccggttccccctaacccgttcccg

SEQ ID NO: 166531 - DNA, 819 bp, Homo sapiens
  misc_feature: GYAE6OF01EU43E.26.71.G05.1.454.CMB.1.raw
  modified_base (231)..(231): a, c, t, g, unknown or other
  misc_feature (231)..(231): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcactaggatccgtggccttcgatgagctgattcagccaccctcagtgtccgtgtccccaggacagacagccacatcacctgctcggcagacaatgganatagaatgctgctggtattaccgagacggccaggccctacgtccccttattttcggctacttccttaccaaagtaataaacggaggccggccctacgagggtacctccccgtagaacccgtaagttttcgtcggccctacccgaaacgtcccgttagggaaaccaccgaacgtacccctaacgttccgtacgaaccctacgtaccgaaccgggccccgggggtaaccccaacgggaccccggaaaacggggtacgttaacggggaaccggggtaacgtaaaccccgtttaaccgttaacgttttccgggtaaccgtaacgggggtaccgggttaaggggggtaacgttaaaacgtttaaccgtttaaggttttaacgggtaacgggttttggggttttaccgggggaaccggggtaacggggaacccggtaacggggtccggtaacgggtaacccccgttaccgggttaaagggtcccggtaaaccggaccccgtaaacgggtccccgttacccggtacccccccgtttacgggtacccctaacccggttccgtttcccccgggttaccccccaaccctttaccccgg

SEQ ID NO: 166532 - DNA, 770 bp, Homo sapiens
  misc_feature: GYAE6OF01A835S.26.71.G05.1.454.CMB.1.raw
  modified_base (179)..(179): a, c, t, g, unknown or other
  misc_feature (179)..(179): n is a, c, g, or t
  modified_base (238)..(238): a, c, t, g, unknown or other
  misc_feature (238)..(238): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgtattcagcccaccctnagtcgtccgtgtccccaggacagacagccaccatcacctgctcggcagacaagttgganatagaatgctcgcctggtactaccgagacgccgacggcctacgttccccttagttttcggtactatccttaccaagtataaggaacgccggacccctagacggtacctcccgtaggaaccgtaactttcgcggtaccttacccaaacgttcgtaacggaacctacgacgccacttctaccgaacctacgtccgacggccgggaccccacggacccgaaggacgtacgggaacggtactaaccgttaacttacgtttacggaccgtaacggggtaccggtaaggggtaacgtaaacgttaacgtttaacggtttagggttaacgggttttacgggtttcggggaaccggggtacgggggtaaccctaaggggttccccgttaacgggtacccccgggtttacccggttaacgggttaaccccgaccggggtaacccccgtaaacggggtcccccgttaccccgggtcccccccgggtttacgggttacccccgttaccccgtttccccggttccccgggtttaaccccccccg

SEQ ID NO: 166533 - DNA, 889 bp, Homo sapiens
  misc_feature: GYAE6OF01ERXLB.26.71.G05.1.454.CMB.1.raw
  modified_base (180)..(180): a, c, t, g, unknown or other
  misc_feature (180)..(180): n is a, c, g, or t
  modified_base (246)..(246): a, c, t, g, unknown or other
  misc_feature (246)..(246): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgacttcacgcccaccctnagtcgtccgtcgtccccaggacagacagccaccatccacctcgctacggcagactaaagttggaanatagaatgctcgctggtactacaggacggccgacggcctacgttcccctttagttttcggtactacttccgtttaccaaggtaagtaaacggaaccgccggtaccccgtacggaacggggtaccttaccccgtacggtaacccgtacgttttaccgacgggtacccttacccgtaaaccgttaccggttaacggggaaacccctaccgaaccggtacccctaacgttaccctacggtaaacccctaggtaccccgaaccggggtccccggggaacccccgtaacgggaaaccccggtaaaccgggtaacggtacgggtaaacggggtaaccgtaaacccgtttaacggttttaacggttacggtaccgggtaacggggttaccggggttaaggggaaaacttaacggtttaaccggtttaaagttttccggggtttaaacggtttagggggtttttacgggggaaccgggggttaccgggtaaccgggtccggggtaacccgggttacgggtaaccccgttaccgggtttaccggaaccggtacccggaaccccggttaacccgggtcccgttacccccgggtaccccccggttaccgtaccccgttacccggtttccccgttccccgggtttaacccccccc

SEQ ID NO: 166534 - DNA, 650 bp, Homo sapiens
  misc_feature: GYAE6OF01BRC2G.26.71.G05.1.454.CMB.1.raw
  modified_base (176)..(176): a, c, t, g, unknown or other
  misc_feature (176)..(176): n is a, c, g, or t
  modified_base (233)..(233): a, c, t, g, unknown or other
  misc_feature (233)..(233): n is a, c, g, or t
  modified_base (393)..(393): a, c, t, g, unknown or other
  misc_feature (393)..(393): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccacctnagtgtccgtgtccccaggacagacagccacatcacctgctcggcagacaagttgganatagaaatgctgcctggtattaccagaggccaggccacgttcccctagttttggtctatcttaccaagataagaacgccggccctacgagggactcccgtgaaccgtaattccgtaggtcctaccaacttcgtacgggaaccacgacgaccactccgtanaccgtactccgacggcccggggtacccgacgacccgaaacgggagtacgggaagggagaccgttaacgtacgtttcgtacggacgggtcggtagggaagtaacgtacgttaacgtttgggttagttagggtttacgggcgggtaagggtacccgaagggtccgtacgggacccgttccggtacggtaccaacggtccccgaaaggtcccgtacccgtcccccgtacggttccaacccttcgttcccgttaccccccg

SEQ ID NO: 166535 - DNA, 695 bp, Homo sapiens
  misc_feature: GYAE6OF01DCB5N.26.71.G05.1.454.CMB.1.raw
  modified_base (237)..(237): a, c, t, g, unknown or other
  misc_feature (237)..(237): n is a, c, g, or t
  modified_base (259)..(259): a, c, t, g, unknown or other
  misc_feature (259)..(259): n is a, c, g, or t
  modified_base (313)..(313): a, c, t, g, unknown or other
  misc_feature (313)..(313): n is a, c, g, or t
  modified_base (325)..(325): a, c, t, g, unknown or other
  misc_feature (325)..(325): n is a, c, g, or t
  modified_base (344)..(344): a, c, t, g, unknown or other
  misc_feature (344)..(344): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccaccctcagtcgtccgtgtccccaggacagacagccaccatccacctgctcggcagacaatggganatagaatgctgcctgtataccngagccagccagtccctatttgctatctcagataagagcggcctgaggactccgngaccgtattcgnggctccaatcgtaggaacncagtcccactctacgaccatcgacggtccggggaccccaaggacccgaaacggtataacgggacgggaacgtaacgttaacttaaggttcgttaaccggacggggtaccggttaggggtaagtaaaaccgtttaacgttaaggtttttaagggttaggtttaggggttttgggaaccggggttaacggggaccgtaaccggggtcccggttaaccggggtaaccccgtacccggggttaacgggttacccaaccggggttcccccaaaacgggggttccccttaaccccgggtcccccccgttacggggttacccccgtaccgttcccggtttccccggttacccccccgg

SEQ ID NO: 166536 - DNA, 642 bp, Homo sapiens
  misc_feature: GYAE6OF01DP0XO.26.71.G05.1.454.CMB.1.raw
tcagagactatactcacgaccggtgctcgatttagtgtcgtcgcaagagagaggggggactcctgtgccccaccatggacacgctttgctccacgctcctgctgctgaccatcccttcatgggtcttgtcccagatcaccttgaaggatctggtcctgcgctgggtggagccccacgcacgacccctcacgctgacctgcctccgtctctggtacttcctacacctacaccacgacgtagaggtagaagtggtcggccgttcgggtcccgtacgacccgggaccccggaaacggcccgtaggacggtggtcttgctactctaatttacgtggagtcgatcgtacaacggtacgtaactaacgttccgtctcgtagaacgtacgtccgactaccgaacactaccaaccggaacggacctaacccgaccgaaacgggtccggtacgttacctaacacgtaccgaaccgactactagtactcgtacgacgaacacgacgacaactatacttacgacgtacacacgacctacgttaccgacggtacgacctaacggaacgtaagaaacgtaactagtacgtagtacggtacgggacgttaggttacgtttcgactaccgtccaccctagccctacgaccgtaccgg

SEQ ID NO: 166537 - DNA, 630 bp, Homo sapiens
  misc_feature: GYAE6OF01AJWOG.26.71.G05.1.454.CMB.1.raw
  modified_base (243)..(243): a, c, t, g, unknown or other
  misc_feature (243)..(243): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccaccctcagtgtcccgtgtccccaggacagaccagccaccatccacctcgcctcggcagacaaagttggganatagaaatgactgcctggtacttaccgagagccagccagtcccctatttgtcatcttacaagataagagccgccctacgacgggtactcccgtacgtaccgaatttcgtcggcctaccaactcgtacgggaacacacgacctacctctacgaccactcgacggccggggaccacggacccgaacgggactagggacggacgacttacgtagtacggacgaggtacggtaggaggtaacttactagttacgttaggttggttagggtcgggacgggaccgagggtccgtacggacccggttaccgtagggtacccgacggtccccgaacgggccctacccggtcccccggtaccggtacctacccgttcccgttccccgttacccccg

SEQ ID NO: 166538 - DNA, 700 bp, Homo sapiens
  misc_feature: GYAE6OF01BMNHX.26.71.G05.1.454.CMB.1.raw
tcagagactatactcacgaccggtgctcgatttagtgtcgtcgcaagagagaggggggactcctgtgccccaccatggacacgctttgctccacgctcctgctgctgaccatcccttcatgggtcttgtcccagatcaccttgaaggagtctggtcctgcgctggtggagcccacgcagaccctcacgctgacctgctccgtctctggattctcactcaccacgactgaggtgaatgtggccgtgggtccgtcgacggcccccggaaaggccctggagtggcttgcactcatttacgtggagtgatctacgaagccggtacaactcccgtcttcgtagaaggaactcgtacctccacctactccaacccgacgggacctaccctaccgaaacggtacccgggtaggtacccttaacaactcggaacccgacatacgaacttccgttaggtacggaacacgacgggacctaacgtaattacgtttacgtgttcgaccgtaccaccgaacggttacccgtaggcccggtaaccttaacccggacgtaaacggaaaaacgtagttaacttaaggaacctttaagggttccgggggtacccgttaaaggggtttaagttttttaccgggacccgttaccccggttaccccgttaccccccgtaaccgtacccccttaccccggaaacccggtaaacccccgggg

SEQ ID NO: 166539 - DNA, 837 bp, Homo sapiens
  misc_feature: GYAE6OF01BT66N.26.71.G05.1.454.CMB.1.raw
  modified_base (242)..(242): a, c, t, g, unknown or other
  misc_feature (242)..(242): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccaccctcagtcgtccgtcgtcccccaggaccagacagccaccatccacctgccgtcgcagacaagtggganatagaatgctgcctggtatacagaggccaggccagtccccttagttttcggtcacttccttaccgaagtagtaacggaacgccggacccctacgaacggggacttccccggacggtaaacccgttaactttccgtacgggtcccttacccgtaaaccttccggttaacgggggaacccctaaaccgtacccggtaccctaacccgttacccggttacgaaccccgttaccgttaccggaaccgggacccccggggggtacccccaacgggaacccccggtaaaccgggacggttaacggggaaaccggggaacggtaacccgtttaaacgttaccggtttaaccggtacccggtaacgggggtaccgggttaacgggggtaaacggttaaacgttaaccgtttaagtttcggggttaaacgggtttgggttttaccgggggacggggtacggggtaaccgtacgggaccggttaccccgggtaacccggtttacccggtacgggtaccgtacccggaccccggtaacggtcccgttacccggtcccccccggttacggttcccgtaccgttcccgttcccggtttaacccccccg

SEQ ID NO: 166540 - DNA, 848 bp, Homo sapiens
  misc_feature: GYAE6OF01B53U1.26.71.G05.1.454.CMB.1.raw
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggactccgtggccttcgatgagctgattcagcccaccctcagtcgtccgtcgtccccaggacagacacgccaccatccacctgcctcggacagacaaagtgggaagatagaatgctcgctaggtactaccgagacggccacggccacgttaccccttagttttcggtacctattccgttacaaagtagtaaacgacggtccggaccctacgacggtacctccgtacgaaccgttaactttccgcgtacctaccctaagtccgtaacggaacctacgaacgccctacgttccgtacgtaaccacgtaccggacccggggtacccggggaccccgtaacgggaaccccgaaacgggtacggtaaaccgggaacggggtaaccgtaacctttaaacgttacggttacgggttaaccggtaacggggtacgggttaaggggtaaacggttaaacgtttaacgtttaacgggtttagggtttaacgggtttacggggttttaaccgggggccggggttaaaccggggaccgggttaaaccgggtaccggttaacccgggttaaaccccgggttaccgggttaaaccggggtaccgaaacccgggtaacccccggtaaacggggttccccccgtttaccccggggtaacccccccgtttacgggttaccccccgtttaacggtttccccccgtttacccgggtttaacccccccc

SEQ ID NO: 166541 - DNA, 635 bp, Homo sapiens
  misc_feature: GYAE6OF01AXI8G.26.71.G05.1.454.CMB.1.raw
  modified_base (236)..(236): a, c, t, g, unknown or other
  misc_feature (236)..(236): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaagttgganatagaaatgctgcctggtattaccagaggccaggccagtccccttatttggcatctccaagataagaagcggccctgagggctccctgaccgtaatttcgtggcctaccaactcgtacgggaaccacgacgccctactctacgaccatccgacggtccggggaccccacggacccgaaacgggagtacggagggacgtaactactagttcgtcgaggtcggagggtaagtaacgtaacgttacgttaggtagttgggttttacgggacgggtagggacccgtaggtccgtaggtacccggttccgtaacgggttccaaccggtccccgaaacgggtcccttccccgggtacccccgttccggtacccgtaacccgtttccgttcccgtttacccccccg

SEQ ID NO: 166542 - DNA, 781 bp, Homo sapiens
  misc_feature: GYAE6OF01A11V3.26.71.G05.1.454.CMB.1.raw
tcagagactatactcacgaccggtgctcgatttagtgtcgtcgcaagagagaggggggactcctgtgccccaccatggacacgctttgctccacgctcctgctgctgaccatcccttcatgggtcttgtcccagatcaccttgaaggagtctggtcctgcgcgtggtggagcccacgcacgaccctcacgctcgacctgcctccgtctcgtggacttctcactccaccacgactagaggtagagtggcggccgtcgggtccgtcgaccggaccccggaaggcccgtggcgtgcttcgctacgtctagtttacgtggagtgatcgacgaacggcgtaactaacgttccgtctacgtaggaacggtaactccgtaccgtaccacctaactcccgaaaccggtaacggaccgtaaccccgtaaacccggaaacggtaccggggttaccggttacccttaaacgaaccttacggaacccgtaacgtaacgttacggtaacctttccgtagggaacgaaaccgtaccggacgtacctaacgttaacgtttacgttacgtacggtaccgtaacaccgtaacgtaccggttaccgtacgtccgggtacctaaaccgggaccgaaaaaggtaaaaccgaaagtttacggtaacgttaacccgggttaagggtttaccgggggtaaccgttaaggggtttaaccggtttttacccgggaccccgttaccccgggtttaccccaaccccggtaccccttaccccgtaacccgtaaccccgggtaacccggg

SEQ ID NO: 166543 - DNA, 729 bp, Homo sapiens
  misc_feature: GYAE6OF01BCA2Z.26.71.G05.1.454.CMB.1.raw
  modified_base (537)..(537): a, c, t, g, unknown or other
  misc_feature (537)..(537): n is a, c, g, or t
  modified_base (620)..(620): a, c, t, g, unknown or other
  misc_feature (620)..(620): n is a, c, g, or t
tcagagactatactcacgaccggtgctcgatttagtgtcgtcgcaagagagagggggctgggcctcaggaagcagcatcggaggtgcctcagccatggcatggactccctctctcctcggcgtccttgcttactgcacaggactccgtggccttcgatgacgctgacttcacgcccaccctcgagtcgtccgtcgtaccccaggacagacacgaccaccactccacctcgccgtccggacaagaactaaggttgggaagtaacgtaagtaaagtcgcgtgtaccgtaggttaactacgacggacggccgacggaccgtaccgttaccccgtttagtttcggtactaccgttacctaccgaaagtaacgtaaacggacgacccggtacctacggaacgggtaccctcccgtaacgtaccgtacttcgacgtacctacctacgtcgtaacggaacaccgacgtccacttccgacgacccaagtcggaccggtcccgggaccaacgacccgtaacggacgaaggtacggactaaccgttntacgttacgtcgacgggtacggtaaggtaacttagtaacgttgtacggttaggttcgggttacgggaacggtacgggaaccgngggttaccgtaccggtacgtaccggtacggtacccgacggtaacccggacggtcccgtaccccggtcccggtcgtaccccttccgttccccggttcccgttaccccccg

SEQ ID NO: 166544 - DNA, 744 bp, Homo sapiens
  misc_feature: GYAE6OF01CGV8C.26.71.G05.1.454.CMB.1.raw
  modified_base (255)..(255): a, c, t, g, unknown or other
  misc_feature (255)..(255): n is a, c, g, or t
tcagagactatactcacgaccggtgctcgatttagtgtcgtcgcaagagagagggggctgggcctcaggaagcagcatcggaggtgcctcagccatggcatggatcccctctcttcctcggcgtccttgcttactgcacaggatccgtggccttcgatgagctgattcagcccaccctcagtcgtcccgtcgtccccgaggacagaccacgcccaccatccaccgtgccgtcggacaagaacgtaaagttggganaataagaatgctgcctaggttaactaccgagacggccgacgccgtacgttcccttagttttgactacttcctacaagtagtaacgacgccggtacctacgacgggtacctacccgtacgtaaccgttactttcgtacgtaccctaccgtaacgttccgtaacgggaacctaccgaacgtccctaaccttcgtaccgaacctacgtaccggaaccggggccccgggaccccgtacggaacccggtaacgggagtacgggaacggtaacgtaacttaacgtacgttacggtacggtaacggggcgggttaaagggaacgttaacgtttaacgttaggtttagggttacgggtttacggttacggggacgggtacgggaaccggtacggtccggtaccggtacccgtaccggtacggtaccgacccggtacccggacgtcccgtaccccggtccccgttacgtaccctacccgttccgtcccgttacccccg

SEQ ID NO: 166545 - DNA, 827 bp, Homo sapiens
  misc_feature: GYAE6OF01BX8FF.26.71.G05.1.454.CMB.1.raw
  modified_base (246)..(246): a, c, t, g, unknown or other
  misc_feature (246)..(246): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcacgcccaccctcagtcgtccgtcgtaccccaggacacgacacgccaaccatccacctgcctcggcagactaaagtgganatagaatgctgcctaggtacttaccgaggacggaccgacggcctacgttcccctttagttttcggctacttcctaccgaagtaagtaaggacgtccggaccccttagaacgggtacctccccgtaggtaacccgttaatttccggtacggacccttacccgtaaaccgttccggtaacgggaaacctaccgacgtacccctaccgttaccgtacgaaccctaacgtccggtaccgggaccccgggggaccccgaaccggtaccccggaaacgggtacggtaacggggaacgggtaacgtaacccgtttaaacgttaacgtttccgggaaccggtacggggttaccgggtaaggggtaaacgtaaacgtttaacggtttaaggtttacggggtttaaggttttcggggtttaccggggaccggggtaacgggtaacccgggaagggttcccggttaaaccgggttaccccggttacggttaccgggtaccgaacccggtaccccggtaacggtcccggtaccccggtaccccccgttagggttaacccctcccggttaccccggttcccggttacccccccg

SEQ ID NO: 166546 - DNA, 605 bp, Homo sapiens
  misc_feature: GYAE6OF01CMXDA.26.71.G05.1.454.CMB.1.raw
  modified_base (147)..(147): a, c, t, g, unknown or other
  misc_feature (147)..(147): n is a, c, g, or t
  modified_base (214)..(214): a, c, t, g, unknown or other
  misc_feature (214)..(214): n is a, c, g, or t
  modified_base (308)..(308): a, c, t, g, unknown or other
  misc_feature (308)..(308): n is a, c, g, or t
tcagagactatactcacgaccggtgctcgatttagtgtcgtcgcaagagagagggggactcctgtgccccaccatggacacgctttgctccacgctcctgctgctgaccatcccttcatgggtcttgtcccagatcaccttgaaggngtctggtcctgcgctgggtggacgcccacgcagaccctcacgctgacctgctccgtctctggattcncactcaccacgactggaggtgaatggtcggccgttgggtcccgtcgaccggaccccggaaaggcccgtggagtcggcttgcactctaatttcgnggtagtgatctacgaagccggtaacacgtccgttctcgtacgaaggaactcgactcaccatccaaccgacggacaacccgtacgaaacggtcccggtgtaccctacgaatcgaaccgtacagtacgaacttccgtagtacgaacacgacggacaactagtaacttacgtcgtgacctacgactacgtccgagtccggactaacgacgaaagaaaagtatagtgtacttaggtcgggacgtaaggttacgttttcgaccgtacccgtcctacccgacgccctcgaacccgtacccggg

SEQ ID NO: 166547 - DNA, 691 bp, Homo sapiens
  misc_feature: GYAE6OF01E3I9L.26.71.G05.1.454.CMB.1.raw
tcagagactatactcacgaccggtgctcgatttagtgtcgtcgcaagagagaggggggactcctgtgccccaccatggacacgctttgctccacgctcctgctgctgaccatcccttcatgggtcttgtcccagatcaccttgaaggagtctggtcctgcgctggtggagcccacgcagaccctcacgctgacctgcctccgtctctggattctcactcaccacgactgaggtgaatgtggccgtgggtccgtccgacgggccccggaaaggcccgtggagtggcttgcactctatttacgtggagtgatctacgaagcgtacaactccgtctctaggagtactcgacctcaccataccaccgacgggaccaccgtaccgaaacggtaccgggtcgttaccttaacaacgttacgacccgtaacaatacgtaacttcccgtaggtacggaaccaacgacgggacctaacgtaatttaacgtttaccgtcgtacgacccaacgtaaccgtacggtacccgtacgggcccggttaaccgtaaccggaacggtaaaacggtaaaaaggtaattacggtacgtaaacgttacggggttacggggaaccgttaaggggtttaacttttcgggaacccttaccccggttccccacccccgtaccgtccccttaaccccgaaccggtaaaccccgggg

SEQ ID NO: 166548 - DNA, 670 bp, Homo sapiens
  misc_feature: GYAE6OF01C1PYU.26.71.G05.1.454.CMB.1.raw
  modified_base (231)..(231): a, c, t, g, unknown or other
  misc_feature (231)..(231): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccacctcagtgtccgtcgtccccaggacagacagccaccatcacctgctcggcagacaagttggganatagaatgctgctgtactaccagacgccagccacgtccctagtttcggctatctacaagataagacgcgacctgacggtctccgtagacgtaatttcgaggtcctaccaacgtcgtaacggaaccacgaacgcctactctacgacctagtcgacgggaccggacccaacggtacccgaaacgggtagtacgggaacggtaacgtactacgttagtcggtacgagggtccggtaagggtaacgtaaacgtttacgttagtttaggttaacggtttgggtttaccgggaacgggtacgggtaaccgacgggtaccgtaccgggtacccggttccgtaagggtaccgtaaccggtaccccggtaacgggtcccttaccccgggacccccgttagggtaccctaccgttcccgttacccggttcccccggtccccttacccgg

SEQ ID NO: 166549 - DNA, 669 bp, Homo sapiens
  misc_feature: GYAE6OF01D0HD3.26.71.G05.1.454.CMB.1.raw
  modified_base (177)..(177): a, c, t, g, unknown or other
  misc_feature (177)..(177): n is a, c, g, or t
  modified_base (236)..(236): a, c, t, g, unknown or other
  misc_feature (236)..(236): n is a, c, g, or t
  modified_base (300)..(300): a, c, t, g, unknown or other
  misc_feature (300)..(300): n is a, c, g, or t
  modified_base (323)..(323): a, c, t, g, unknown or other
  misc_feature (323)..(323): n is a, c, g, or t
  modified_base (345)..(345): a, c, t, g, unknown or other
  misc_feature (345)..(345): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctnagtgtccgtgtccccaggacagacagccaccatcacctgctcggcagacaaagttgganatagaatgctgcctggtataccagagcagccagtccctatttgcatctacagatagagcgcctnaggactccgtgaccgtaattcgngcctacgaactcgtcggaaacncacgcccatctacgaccatcgacggccggggacccaacgcccgaaacggagtacggaagggtacgtaacttaaccgtagttacgtaccggtaacgggacggtaggggtaacgtaagttaacttaacgtttaggttaacggtttacgggtttacgggacgggtacggggaacccgttacgggtaccggtacggtacccggttacccggttaacgggtcccgtaaccggtaccccggaaacgggtccccgttaaccccgggtacccccccggttaccggttaccccgtaacccgttccccggttaccccggtttaccccccccggg

SEQ ID NO: 166550 - DNA, 874 bp, Homo sapiens
  misc_feature: GYAE6OF01BNSLN.26.71.G05.1.454.CMB.1.raw
  modified_base (178)..(178): a, c, t, g, unknown or other
  misc_feature (178)..(178): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcgacgtcccaccctnagtcgtccgtcgtccccaggacagacacgccaccatccacctgccgtcggacaacggtaaacctaaaggttggggaagtaacgttaaaggaaaacgttggtacccgttacggtacccgtttagggttaacctttaaccggaacgggaaccgggtaccccgtaacgggtacccccgttaacccggttttacccccccgttttaaggttttttaccggggtacccttaaccgtttacccgttttaacccgaaaaggttaaccgttaaaccgggtaaccggcccccgggttaccccgttaacggtaaccggggtacccttacccccggttaacggtaaccccgttaacgtttccggtaccggtcccttaacccgtaacgttccggtaaccgggaaacctccgaacccgtaccctaacgttccgtaaccgaccctaacgtccggaaccgggtcccgggacccctaacgggtaaccccgaacggggtacgtaacgggacggtaacgtaaccgtttacgtcgttacggtacgacgggtacggtaggtaactacgttagttacgtttaggtacggtttcgggttacgggacggggtaaccggcgtacggtcgtaccggtaccgtcgtacgaccgtacggacccggtacggtccgtaccccgtcccgtcgtcctaccgtacccgttccgtccccgtccttaccg

SEQ ID NO: 166551 - DNA, 747 bp, Homo sapiens
  misc_feature: GYAE6OF01CYGEG.26.71.G05.1.454.CMB.1.raw
  modified_base (172)..(172): a, c, t, g, unknown or other
  misc_feature (172)..(172): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagcccacctnagtgtccgtcgtccccaggacagacacgccaccatccacctgctcggacagacaaagttgggaagataagaaatgctgcctaggtactaccgagacggccgacggccctacgttccccgttaattttcgggtacctacgttacctttacccgaaaagtaaacgttaaacgggaaacggtcccgggtaccccgttacggaacggggtaccttacccccgtaacggtaaccccggttaaacttttccgtacggtacccttaaccctaaccgttaccgtaacgggaaacctacgtaccgacctaacctccgtacgaacccacgtaccgaccgggtccccgggacccaacggaccccgaaaggacgtacgggaacgggtaccgtaacgttaacgtagttacggtacggacgggtgggttaacgggaagtaaacgttacgttaagttggttaaggtttgggttacgggacgggtacggaccggtacggccgtacgtaccggtccggtacgtcgaccgtaccgacggtcccgacccgtcccgtcggtccctacgtcccttaccgtccccgtccgttacccg

SEQ ID NO: 166552 - DNA, 659 bp, Homo sapiens
  misc_feature: GYAE6OF01DERB5.26.71.G05.1.454.CMB.1.raw
  modified_base (454)..(454): a, c, t, g, unknown or other
  misc_feature (454)..(454): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggactccgtggccttcgatgagctgattcagcccacctcagtcgtcccgtcgtccccaggacagacacgccacatccacctgcctcggacacgaacaaagttgggaatataagaatcgctgccgttaggtactaccgaggacggccacggacctacgttccccttagtttcgtctacttcctacgaagtataaggacgccggcctagacgggactccgtagaaccgttattcgtacggacctacctaacgtcgtacggaacacgacgcctactcgtacgaccagtacgacggcccgggaccacggaccgaacggngtacggaaggtacacttaacgtacgttcggacggacggtcggtagggaactaagttacgtagttaggtaggttcggttagggacgggacggacgtagggtacctccgggtacgttaccgtacggtccgaaccggcccgtaacggtccccgttacccggtcccccggttacggacccgttaccgttcccgttcccgttaccccccg

SEQ ID NO: 166553 - DNA, 768 bp, Homo sapiens
  misc_feature: GYAE6OF01DYZ2B.26.71.G05.1.454.CMB.1.raw
  modified_base (177)..(177): a, c, t, g, unknown or other
  misc_feature (177)..(177): n is a, c, g, or t
  modified_base (232)..(232): a, c, t, g, unknown or other
  misc_feature (232)..(232): n is a, c, g, or t
  modified_base (239)..(240): a, c, t, g, unknown or other
  misc_feature (239)..(240): n is a, c, g, or t
  modified_base (243)..(243): a, c, t, g, unknown or other
  misc_feature (243)..(243): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctnagtcgtccgtgtccccaggacagtacagccacatcactgctcgcagacaatgganatagaannctncctggtataccgagacgcaggcctacgtccccttatttggtctacttcttaccaagaacgtaagaacgccggtaccctacgacgggtactacccgtacgtacccgtaatttccgtacggtacctaccctaaacgttcgtacgggtaaccaaccgacgtacccctactaccgttaccggaaccctaactaccgacgggacccggggacccccgaacgacccgaaacggtaacgtaacgggtacgggaaccggtaactttaaccgttaagtttaccggtaccggtacgggtacgggttacggggtaaacgtaaccgtttaacgttaagttttacggtaaggttttcgggtttacggggtaaccgggtacgggtaacccggtaacggggttaccgtaccgggtaacccggttccggttaaccggggttaacccaccggttaacccccgggaaacggttcccgtacccgggtaccccccccgttaccggttacccgttcccgttaccgtttcccggtttaccccccccg

SEQ ID NO: 166554 - DNA, 648 bp, Homo sapiens
  misc_feature: GYAE6OF01CXGYD.26.71.G05.1.454.CMB.1.raw
  modified_base (219)..(219): a, c, t, g, unknown or other
  misc_feature (219)..(219): n is a, c, g, or t
  modified_base (229)..(229): a, c, t, g, unknown or other
  misc_feature (229)..(229): n is a, c, g, or t
  modified_base (244)..(244): a, c, t, g, unknown or other
  misc_feature (244)..(244): n is a, c, g, or t
  modified_base (254)..(254): a, c, t, g, unknown or other
  misc_feature (254)..(254): n is a, c, g, or t
  modified_base (303)..(303): a, c, t, g, unknown or other
  misc_feature (303)..(303): n is a, c, g, or t
tcagagactatactcacgaccggtgctcgatttagtgtcgtcgcaagagagagggggctgggcctcaggaagcagcatcggaggtgcctcagccatggcagtggatccctctcttcctcggcgtccttgcttactgcacaggactccggtggccttcgatgagctgattcacgcccaccctctagttcgtcccgttcgcccgaggacagacacgccacntccacctgcncgcagacaagtgganatagaatgcngtcgtagtataccgagacgaccgaggcctacggttccccttagtttacnctactacgttaccttacgaagaagtaagaacgccggaccgttacggacgtacctacccgtcgtaaccgttacgttacgtcgaccttaccaccgttcgaaggtaaccacgaacgtacctaccgtctaaccgaccaacgtaccggaccgggaccgggacccacgaaccggaacggacgtaggacggtacgtaaccgttagtacgtgtaccggaggttacgggtagggaacttagttaacgttgttacggtaggttcggtagggacggtacggaggtcgaccgtcggtaccgtcgttaggccgtaccgaccgacggcctaccgcccgttcgacctccctcgtaccccg

SEQ ID NO: 166555 - DNA, 812 bp, Homo sapiens
  misc_feature: GYAE6OF01B0AUZ.26.71.G05.1.454.CMB.1.raw
  modified_base (186)..(186): a, c, t, g, unknown or other
  misc_feature (186)..(186): n is a, c, g, or t
  modified_base (268)..(268): a, c, t, g, unknown or other
  misc_feature (268)..(268): n is a, c, g, or t
tcagagactatactcacgaccggtgctcgatttagtgtcgtcgcaagagagagggggctgggcctcaggaagcagcatcggaggtgcctcagccatggcatggactccctctcttcctcggcgtccttgcttactgcacaggacttccggtggtccttcgatgagtctgacttcacgcccaccctnacgtcgtcccgtcgtccccgaggacagaccacgacccaaccactccaccgtgcctacggactaagaacgtaaagttgggaanaatagaaatgctcgtccttaggtactacgagacggccacggcctaccgttccttagtttcgtcacttccttacgaaagtaagtaacggaacggtcccggtacccgtagaacgggtacccttacccgtacgtaacccggttaagttttccgaccggtacccttaacccgaacttccgggtaacggaaacctcgacccgtacctacccgttactaacgaaccctacgtaccggaaccgggtcccgggaacccgtaaccggaacccggtaacggtacggtaacgggtacggtaaccgtaacgttaacgttaacgttcggtaacggtacgggtacgggttaaacgggtaacgttaacgttaacgttacggttttacgggttagggttacgggtttacggggaacgggttaacgggaccggtacgggtaccggtaccggtacccggttaccggtacggtaccggaccgggaccccgtaaccgggtccccgtacccggttccccgtacccgggttacccttcccgttcccggttccccgttaaccccccg

SEQ ID NO: 166556 - DNA, 689 bp, Homo sapiens
  misc_feature: GYAE6OF01B9DPY.26.71.G05.1.454.CMB.1.raw
  modified_base (290)..(290): a, c, t, g, unknown or other
  misc_feature (290)..(290): n is a, c, g, or t
  modified_base (311)..(311): a, c, t, g, unknown or other
  misc_feature (311)..(311): n is a, c, g, or t
tcagagactatactcacgaccggtgctcgatttagtgtcgtcgcaagagagaggggggactcctgtgccccacatggacacgctttgctccacgctcctgctgctgaccactcccttcatgggtcttgtcccagactcaccttgaaggagtctggtcctgcgctggtggacgcccacgcacgaccctcacgctgacctgcctccgtctcgtgtattcctcactcaccacgactggacggtgaatggtcggccgtcgggtccgtacgaccgggaccccggaagcccgtggngtcgtctgcactctatttcgnggtatcatctacgacgtacggtactacgttccgtctacgtagacgactccgtactaccacacgtacaaccgaggacccacctaccggaaacggtaccgggtctacctaacgtaacgtccggaaccgactacgtaacgtactcgttaggaacggtacctacggaacgtctaaacgtacgtttaaacgttcgtacgttaccgaacctaaccgtaaccgaccggttacccgaacgggtacccgtaaccgttacggaaaaccggaaagtaaaaacgtattaaccgtagtaaccggtttaaggtccgggtaaggttaagggtttactttcggaccccttaccgtccctaccccgacgtacccccgtacgaacccggtacccgg

SEQ ID NO: 166557 - DNA, 752 bp, Homo sapiens
  misc_feature: GYAE6OF01DB6H3.26.71.G05.1.454.CMB.1.raw
  modified_base (176)..(176): a, c, t, g, unknown or other
  misc_feature (176)..(176): n is a, c, g, or t
  modified_base (238)..(238): a, c, t, g, unknown or other
  misc_feature (238)..(238): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtcttgcttactgcacaggatccgtggccttcgatgagctgattcagccaccctnagtcgtccgtcgtccccaggacagacacgccaccatcacctgctcggcagacaaagtggganataagaatgctgcctaggttactaccgagacggaccgacggacctacgtttccccttagttttcggactacttccttaccgaaagtaagtaaacggaacggtcccggtaccctacggacgggtaccttacccgtacgtaacccgttaaacgtttccgtacggacccttaccgtaacgttccgtaacggggtaaaccacgtaaccgaccctaactcccgtacggtaaccctaacgtacccggaccgggacccggggaaccccaaccgggaacccgaacgggtaagtaacgggaacgggtaacaacgttaacgttacgttacgggtacggtaacgggcggtaagggaactaacgtttaacgttacggtttaggttaggtttcgggttacgggtacggggacggtacggtacgggtcgtaccggtaccggtacgtacgggacgtacccggcccgtaaacggtccgaccccggtaccccgtacggttaccctaccgttcccggttcccgttacccccg

SEQ ID NO: 166558 - DNA, 801 bp, Homo sapiens
  misc_feature: GYAE6OF01DXN3S.26.71.G05.1.454.CMB.1.raw
tcagagactatactcacgaccggtgctcgatttagtgtcgtcgcaagagagaggggctgggcctcaggaagcagcatcggaggtgacctcagccatggcatggatccctctcttcctcggccgttccttgccttactcgcacaggatccgtggcctttcgagtgagctgattcgacgtcccaccttcagtcgtaccgtcgtaccccgaggacacgacgacgcccaacctactcgacctgcctcggacaaggtaactaaagtgggaagtaacgttaagaacgtcggacttcggaccttaggttaacttacccgaggtaacggcccgaacggtacccctaacgttccccgtttaattttccgggtacctacgttaccgttacccgaaagtagtaaacggaacggtcccggacccgtacggaacgggtaccttcccgtaacggtacccgttaacgtttccgtacggtaccccttaccgtaaacgtccggtaacgggaaccctacgaccgtaccccgtaaccgttcgtaacccggacctaacgttacccggacgggacccgggaacccccgtaaaccggtaaccggtagtaacggaacgggtaaccgtaccgtaacgttacgtcggtaacgacgggtacggtaacgggtaaggtaactaccgttaaggttacgttaagggttcggtttacggggaaccgtacgggtaccgtacgggtaccgtcggtacccgtacggttacggtaccgacgacccgtaccgtccgtcccgtacccgtcgacctaccttcgtcccgtcccgtacccg

SEQ ID NO: 166559 - DNA, 744 bp, Homo sapiens
  misc_feature: GYAE6OF01EPE2Z.26.71.G05.1.454.CMB.1.raw
  modified_base (236)..(236): a, c, t, g, unknown or other
  misc_feature (236)..(236): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagcccaccctcagtgtccgtgtccccaggacagacagccaccatcacctgctcggcagacaaagttggganatagaatgctgcctggtattaccgagaggccacggcctacgtccccttagttttcggtcctacttccttaccaaagtactaaagaacgccggaccctacgacgggacttaccccgtacggaacccgttaacgtttccgtcggtacctacccgaacgttcgtacgggaaaccacgaacgcccaccgtctacgtaccctacgtcgacggcccggggtaccccaacggaccccgaaacgggtagtaggggaacgggtaacgtaaccgttaacgttaagtttcggtacgtagggtaccggtaggggtaactaacgttacgttaagtttacggttaaggttcgggtttaggggaccgggtaacgggtaccgacgggtccgtacggtacccggttaccggtacgggttaaccggaccgtaccccggtaacgggtcccgtcccgggtccccccgttaccgggttacccctaccgttaccccgtttcccggttaccccccgtccccgtttaacccg

SEQ ID NO: 166560 - DNA, 623 bp, Homo sapiens
  misc_feature: GYAE6OF01C872Y.26.71.G05.1.454.CMB.1.raw
  modified_base (559)..(559): a, c, t, g, unknown or other
  misc_feature (559)..(559): n is a, c, g, or t
  modified_base (589)..(589): a, c, t, g, unknown or other
  misc_feature (589)..(589): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcggatgagctagattcacgccaccctcagtcgtccgtcgtcccaggacagacagccacatccactgctcggacagaacaagttgggatatagaatcgactcgcctaggtactaccgacgtacggccaggcctacggtccccttaagttttcggtctacgttcctttaccaaagtaactaaacggaacgaccggtacccgtacggacgggtacctcccgttacgaaccggttaactttacgtcggaccttacccgtaaacgttcgtaacgggaacctacgacgaccactcgtacgacctacgtaccgacggccgggaccctacgaacccgaacggtagtacggaaggacgtactaactagtacgtcgaggtcgaaggacaagtactagtcgtagtcggtgtacggaggacgngcgtgtaccgcgtagcgcgtaccgacgtcnccgtcccacggtcactcctctccccgcgttcccg

SEQ ID NO: 166561 - DNA, 752 bp, Homo sapiens
  misc_feature: GYAE6OF01BCO8H.26.71.G05.1.454.CMB.1.raw
  modified_base (239)..(239): a, c, t, g, unknown or other
  misc_feature (239)..(239): n is a, c, g, or t
  modified_base (264)..(264): a, c, t, g, unknown or other
  misc_feature (264)..(264): n is a, c, g, or t
  modified_base (336)..(336): a, c, t, g, unknown or other
  misc_feature (336)..(336): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccaccctcagtgtccgtcgtccccaggacagacagccaccatcacctgctcggcagacaaattgggganatagaaatgctgcctggtacttacngaggccaggccagtccccttagtttggtctattcttaccaagataaacggagccgcctcgacgggctacccngaaccgtaatttcgtggacctaccaacgtcgtacgggaacacgtacgacctactcctacgtaccctaactccgaacgggcccggggaccccgaacgggaccccgtaacggggacgtacggaaacggggtacgtaacccgttacgttacgttacggtcgaaggggtcccgggtaaggggtaagtaaacgttaacggtttaagtttgggtttaacgggtttgggttttaacggggacggggtaaccggggtaccgtaacgggggtaccgggtacccggttaaccccgggttaccggtttaacccggggccgtaacccgggtaacccccgggaaaccgggtcccggttaccccgggtcccccggttacccgggttaccccttacccgtttccccggttaccccgggtttaccccccccg

SEQ ID NO: 166562 - DNA, 586 bp, Homo sapiens
  misc_feature: GYAE6OF01AC2J6.26.71.G05.1.454.CMB.1.raw
  modified_base (308)..(308): a, c, t, g, unknown or other
  misc_feature (308)..(308): n is a, c, g, or t
  modified_base (356)..(356): a, c, t, g, unknown or other
  misc_feature (356)..(356): n is a, c, g, or t
  modified_base (408)..(408): a, c, t, g, unknown or other
  misc_feature (408)..(408): n is a, c, g, or t
  modified_base (502)..(502): a, c, t, g, unknown or other
  misc_feature (502)..(502): n is a, c, g, or t
  modified_base (565)..(565): a, c, t, g, unknown or other
  misc_feature (565)..(565): n is a, c, g, or t
tcagagactatactcacgaccggtgctcgatttagtgtcgtcgcaagagagaggggggactcctgtgccccaccatggacacgctttgctccacgctcctgctgctgaccaccccttcatgggtcttgtcccagatcaccttgaaggagtctggtcctgcgctggtggagcccacgcagaccctcacgctgacctgctccgtctctggacttctcactccaccacgactgaggtgaagtggtggcctgggtcccgtcgacggcccccggaaaggcccctggagtggcttgcactcatttacgtggagngatctacgaacgcggtacaactccgtctctagaggaatcgactcaccntacacaggaccacctaccaaacggaccggtcggtcctacaacgtcgaccganatacgaatccgtagtaggacacgaggcaactatagttactgtcgacaccaactacgtccgacggcggtacctacggacgaaagaaagaataagngtaacttaggtcgggacggtaaggttacgtttcggaccgtccgtacccgaccctaccgacccncccgaaccgacggtacccccg

SEQ ID NO: 166563 - DNA, 709 bp, Homo sapiens
  misc_feature: GYAE6OF01B1AXW.26.71.G05.1.454.CMB.1.raw
  modified_base (233)..(233): a, c, t, g, unknown or other
  misc_feature (233)..(233): n is a, c, g, or t
  modified_base (306)..(306): a, c, t, g, unknown or other
  misc_feature (306)..(306): n is a, c, g, or t
  modified_base (326)..(326): a, c, t, g, unknown or other
  misc_feature (326)..(326): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtcccccaggacagacagccaccatcacctgctcggcagacaatggganatagaaatgctgcctggtataccagaggccaggccagtcccctatttggcatcttccaagataagagcgcctnaggatccctgaccgaattcnggctccaactctggaacacacgccactctcgaccatcgacggccgggacccacggacccgaaacgggacgtacgggaacggggaacgtaaccgttaacgttaacgtttcggtaccgacggggtccggtagggggtaacgtaaacgtttaaccgttaaggttttacggttaagggtttacgggttttacggggacggggtaacggggtaacccggtagggtacccgttaccgggtaacccggttcccgttaacggggtcccgtaaccgggtacccccgtaaaggggtcccgttaccccgggtcccccccgtttacccggggtaccccttaacccggttccccggtttccccgggtttcccccccgtccccccgtttacccccgg

SEQ ID NO: 166564 - DNA, 693 bp, Homo sapiens
  misc_feature: GYAE6OF01C3BUH.26.71.G05.1.454.CMB.1.raw
  modified_base (242)..(242): a, c, t, g, unknown or other
  misc_feature (242)..(242): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacagactccgtggccttcgatgagctgtacttcacgcccaccctcagtcgtccgtcgtccccaggacagacacgccacactccacctgctcggacacgaactaagttgganataagaatgctgcgtggtactaccgagacgccacggcctacgttcccctttagtttcggtactacttccttaacgaagtaacgtaacggaacggtcccggtaccctacggacgggtaccttacccgtacgtaaccgtacgtttccgacgtcctacctaacgtcgtaacggaaccacgaccgtaccctactcctacgaccgtacgtaccgggaccgggtccccgggaccccgaacggaacccggtaaacgggtacggtaacgggaacgggtaactaaccgttacgttaacgttcgggtaccgtagggacgggttaaggaacttaagtacgtttaaggttggttaggttgggttcgggacgggtacggtacgaggtccgtacgtaccggtcgtagtccgacgcccgtacggccctcccgcccgttcgtcctcgtaccgtcccgtcccgctccg

SEQ ID NO: 166565 - DNA, 699 bp, Homo sapiens
  misc_feature: GYAE6OF01DDZGM.26.71.G05.1.454.CMB.1.raw
  modified_base (135)..(135): a, c, t, g, unknown or other
  misc_feature (135)..(135): n is a, c, g, or t
  modified_base (177)..(177): a, c, t, g, unknown or other
  misc_feature (177)..(177): n is a, c, g, or t
  modified_base (687)..(687): a, c, t, g, unknown or other
  misc_feature (687)..(687): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcncaggatccgtggcccttgatgagctgattcacgcccaccctnagtcgtccgtcgtccccaggacagacacgccacatccactgcgtcgacagaactaaggtggagtatagaatgactgccgttagtactaccgagcgaccgacgccgtacgtccccttagtttcgtactacttccgttaccaagtataacggaaccgccggacccctcgtaacgggacctcccgtcgtaactaagtttccgtacgcctaccaacgttcgtaacggaaccacacgccctacgtcacgacccagtaccgaccgggcccggtacccaagacccgaaggagtcgggaacggtactcgttaacgtacgttggtacggtagggtaccggttaagggaactaaactttagtaagtttacgggttacggtttagggtaccgggacggggtacggtaaccggtacgggtacccgtaccggtacccgttccggtaacgggtacctaccggtaacccggacgtcccgtaccccgtccccgtacggttcccgacccttccggtcccttcccccncccgtttacccg

SEQ ID NO: 166566 - DNA, 706 bp, Homo sapiens
  misc_feature: GYAE6OF01CU4WU.26.71.G05.1.454.CMB.1.raw
  modified_base (89)..(89): a, c, t, g, unknown or other
  misc_feature (89)..(89): n is a, c, g, or t
  modified_base (247)..(247): a, c, t, g, unknown or other
  misc_feature (247)..(247): n is a, c, g, or t
tcagagactatactcacgaccggtgctcgatttagtgtcgtcgcaagagagaggggcgtggcctcaggaagcagcatcggaggtgcctnagccatggcatggatccctctcttcctcggcgtccttgcttactgcacaggatccgtggccttcgatgagctgattcagcccaccctcagttcgtccgtcgtaccccgaggacacgacacgcccaccactcacctgctcggacagactaaagtggganaataagaatgctcgcctgttatacaggacggccgagccgacgtccctttagttttcgctatccttaccaagtataacgaacggcccgtccctacgaacgggtcctacccgtacgtaacccgttaatttccgtcggtacccttacctaacgttcggacgggaaccaccgacgacccttacgtccgtacaccgtactccgacgggcccgggacccacggacccgtaacggacgtagggacggactaacgttacgttacgttcgtaggtacgggcggtaagggaagtaaacgttattacgttagggttaggttaggtttggggacgggtgggaacccgtgggtaccgtacggtcccgttaaccggtacgggtcccgaacgggccccgtaacggggtccctacccccgggtacccccggttacggttcccctaccgtttcccgttccccggtttcccccccgg

SEQ ID NO: 166567 - DNA, 808 bp, Homo sapiens
  misc_feature: GYAE6OF01DIP5S.26.71.G05.1.454.CMB.1.raw
  modified_base (182)..(182): a, c, t, g, unknown or other
  misc_feature (182)..(182): n is a, c, g, or t
  modified_base (247)..(247): a, c, t, g, unknown or other
  misc_feature (247)..(247): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacgaggactccgtggccttcgatgagctgattcacgtcccaccctnagtcgtccgtcgtccccgaggacagaccacgccaccatccacctgcctcggacagacaagtgganatagaatgctgctaggtactaccgagacgcgacgcacgttcccttgtttgctatcctacaacgtataaggacgaccgtccgtacgacggtcctacccgtacgtaaccgtaagttttccgacgggacccttacccaaacgttccgtaacgggaaaccctaccgaaccggtcctaaccgttctaccggaaccctaacgttacccggacgggaccccggggcctaaaccggacccggaaacgggtaacgtgggaacgggtaaccctacgttaaaacgtttcggtttaaggttacccggtacggtaccgggttaagggtaaacgtaaacctttacggtttaaggttccgggttaagggtttaggggttttaacgggggaccgggttaaccggggaaccggttcggggttaacccgttaccgggtacccgttttaccccggggttaaacgggttcccggaacccgggaacccccggttaaacggtcccccggtttacccccgggtacccccgttacccgggttaccccctccgtttccccccggttccccggttttaacccccccc

SEQ ID NO: 166568 - DNA, 834 bp, Homo sapiens
  misc_feature: GYAE6OF01DEMQN.26.71.G05.1.454.CMB.1.raw
  modified_base (524)..(524): a, c, t, g, unknown or other
  misc_feature (524)..(524): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagcccaccctcagtcgtccgtcgtccccaggacagacacgccaccatccacctgctcggcagacaaagttgggaagataagaaatcgcgtagaccgttaggttaacttaaccgaaggacggacccgaacggtccctaacggttacccccttttagttttcggtacctacttaccgttaccaaagtaacgtaaacgggacgcccggtaccccgttaggaacgggtaccttaccccggtacgtaacccgttaactttcgtacggtacctacccaaacgttcggtaacgggaaaccacgtaacgccctaactacgtacaaccctataccgacgggtacccgggacccacggaacccgaaacgggngtacgggaaacgggaataaccgttacttagttacggccgtaaggggtaccgggttagggaaactaacgttttaacgttaacgtttaggggtttaggttttacggggtttagggaccgggggtaaacgggtaccgtaacggggtccggttaaccggttaaccccgggttaccggttaacgggtacccgaaaccgggtaaccccccggaacgggtaccccgttaccccgggtacccccccggttaccgggttcccgttaacccgtttccccggtttcccccggttacccccccgtcccccgtttaaacccgg

SEQ ID NO: 166569 - DNA, 643 bp, Homo sapiens
  misc_feature: GYAE6OF01BKB30.26.71.G05.1.454.CMB.1.raw
  modified_base (175)..(175): a, c, t, g, unknown or other
  misc_feature (175)..(175): n is a, c, g, or t
  modified_base (233)..(233): a, c, t, g, unknown or other
  misc_feature (233)..(233): n is a, c, g, or t
  modified_base (325)..(325): a, c, t, g, unknown or other
  misc_feature (325)..(325): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctnagtgtccgtgtccccaggacagacagccacatcacctgctcgcagacaaagttggganatagaatgctgacctggtataccagagcagccagtccctatttgcatcttacaagataagagcgcctgaggtactccctgaccgtaatttcncggactaccgaactcgtacgggaaactacgacgtacctacgtctacgaacctataccgaggtcccggggacccaaggaccccgaaacgggatacgggaacgggacgtaactacttaacgttcggtaccgaagggtcgtaggggaagtaaattacgttagtttacggtaaggttcggtttagggaccgggtaacgggaccgtaggtcccgtaggtaacccggttcgtaacgggtccgaaccggacccgaacgggtcccgtccggaccccccgttcgggtcctaaccgtcccggtttcccggttcccccgccctttcccg

SEQ ID NO: 166570 - DNA, 798 bp, Homo sapiens
  misc_feature: GYAE6OF01AI7TH.26.71.G05.1.454.CMB.1.raw
tcagagactatactcacgaccggtgctcgatttagtgtcgtcgcaagagagagggggagtgactcctgtgccccaccatggacacgctttgctccacgctcctgctgctgaccatcccttcatggtcttgtcccagatcaccttgaaggagtctggtcctgcgctggtggacgcccacgcacgaccctcacgctgacctgcctccgtctctggtacttctccactccaccaccgactggaggtgaagttcggtcgggtcccggttcggggttccccggtaccgaacccggggtacccccccggggaaaacgggtccccgttaggggaacggttcgggtccgtttcgaccgtacctttacgttaacttttaccggtggtaaggtcgtacttccgtaccgaacggtaccggtaacctacgttccgtactcgtacggtaacggtaactccggtaactacccaaccctacgttacccgaaccggtaacgggaaccctaaccccgtaaacccggtaaaacccgggttacccggggttaccggttaacccgttaacgtaaccgttaccggaacccgtaactaacgttaaccgtaaccgttccggttaccgggtaccgtaacccgaacgtacggacctaaacgtactttaacgtttacgtacgtaccgaaccaacgtacgtaaccgtaccgtacggccgtaccgacgaacgaaagtaaagtactagagtacgttagggtacgggtaccgtaagggttacgtttcggacccgttacccgtacccttacccgcgtacccctacccgg

SEQ ID NO: 166571 - DNA, 729 bp, Homo sapiens
  misc_feature: GYAE6OF01CYLAZ.26.71.G05.1.454.CMB.1.raw
  modified_base (172)..(172): a, c, t, g, unknown or other
  misc_feature (172)..(172): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctnagtgtccgtcgtccccaggacagacacgccaccatccacctgctcggcagacaaagtggagatagaatgctgcctggtattaccgagacggccaggcccacgtcccctttattttcggtacacttccttaccaagtaactaacgaacgccggcccctacgacgggtactccccgtagaacccgtaacgtttcgtacggtcctaccctaacctcgtacgggaaaccaccgacgaccctacttcacgaccacgtccgacgggcccgggacccacggacccgaacgggagtacgggaacgggtaacgtaaccgttaacgttacgtttcggtaccggagggtccgggttaggggaacgtaagttaaccgtttaagttttacgggttaaggtttggggtttacgggtaccggggaacggggtaacccggtacgggaccgttacgggtacccggttaccggtagggtacccgtacggtaccccgaacgggtcccgtaccccgtccccggttccggtacccgttcccgttacccgtttccccggttaacccctcccgttacccg

SEQ ID NO: 166572 - DNA, 659 bp, Homo sapiens
  misc_feature: GYAE6OF01BSZ0D.26.71.G05.1.454.CMB.1.raw
  modified_base (492)..(492): a, c, t, g, unknown or other
  misc_feature (492)..(492): n is a, c, g, or t
  modified_base (521)..(521): a, c, t, g, unknown or other
  misc_feature (521)..(521): n is a, c, g, or t
tcagagactatactcacgaccggtgctcgatttagtgtcgtcgcaagagagagggggctgggcctcaggaagcagcatcggaggtgcctcagccatggcatggactccctctcttcctcggcgtccttgcttactgcacaggatccggtggccttcgatgagctgtattcacgcccacctcagtcgtccgtcgtccccaggacagacacgccaccatccacctgccgtcgcaagactaagttgggaatataagaatgcgtcgtccgttagtaacttacggagacggccgacggtccctaccgttcctttaggtttcggactaacgttccgttaaccgaaaggtaacgtaacgtaaccggcccgtaccgtacgacgggtaacctcccgtagtaccgttacttcgcgtactaccgaactccggtaacggaacacacgtccctacgtcctaacgacctgccggaccggtacccgggactaaccggacgtaaaggnggtacggaggtactagtacgtagtcgggnggcgtaagaactatcgttagttgtagggttgtacgggagccggacgcggtacgtcgtccggtacgtcggaccgacgacccggtacggcccctcccggtcccgtccgtacttacccgtcccttccccggtccctacccg

SEQ ID NO: 166573 - DNA, 703 bp, Homo sapiens
  misc_feature: GYAE6OF01B5YIZ.26.71.G05.1.454.CMB.1.raw
  modified_base (178)..(178): a, c, t, g, unknown or other
  misc_feature (178)..(178): n is a, c, g, or t
  modified_base (242)..(242): a, c, t, g, unknown or other
  misc_feature (242)..(242): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccaccctnagtcgtccgtcgtccccaggacagacacgccaccatccacctgctcggcagacaaagttggganatagaaatgctgcctggtacttaccaggaggccaggccacgtccccttagttttcggctattcctacaagttataagaagccggccctacgagggacttccccgtaggacccgtaatttccgtcggtaccctaccgtaaaccgttcgtacggggaaccacgacgccctactcctacgacccactccggacggcccggggaccccacggaccccgaacgggacgtagggaacgggacgtaaccttaacgtacgtttcggaccgagggtacgggtagggaagtaacgttacgttagttacggttaggttgggtttacggacggggtacgggtaccgagggttccgtaccggtaacccggttaccgtacggggttccaaccgggtcccccgtaagggtccccgttacccgggtccccccgttacggtacctaccccggttccgttccccggtttaacccccccg

SEQ ID NO: 166574 - DNA, 637 bp, Homo sapiens
  misc_feature: GYAE6OF01CSLQS.26.71.G05.1.454.CMB.1.raw
  modified_base (232)..(232): a, c, t, g, unknown or other
  misc_feature (232)..(232): n is a, c, g, or t
  modified_base (298)..(298): a, c, t, g, unknown or other
  misc_feature (298)..(298): n is a, c, g, or t
  modified_base (383)..(383): a, c, t, g, unknown or other
  misc_feature (383)..(383): n is a, c, g, or t
tcagagactatactcacgaccggtgctcgatttagtgtcgtcgcaagagagaggggggactcctgtgccccaccatggacacgctttgctccacgctcctgctgctgaccatcccttcatgggtcttgtcccagatcaccttgaaggagtctggtcctgcgctggtggagcccacgcagaccctcacgctgacctgctccgtctctggattctcactcaccagactgaggtnaatgtggcctgggtccgtcacggaccccggaaaggccctggacgtggcttgctactctagtttacnggtagtgatctacgaagcggtacaatccgtctctgagactcgactcacatcacaggacacctcaaacggaccggtcgtacctaanactacgaaccgacagtagtaaactccctgtacggaaccaacgaggacctacgtaattaactttactgtcgtaccaactaacacgtcctaacggtcggacttacggacgtaaggaaaaacgtaataacgtaggtaaccttaaggtttcgggggaacccgttaagggggttaaaccgtttttcgggtaaaccccgtaccccggttaccctacccccgacggtaccccctacccggtaaacccggtaaaccccgggg

SEQ ID NO: 166575 - DNA, 633 bp, Homo sapiens
  misc_feature: GYAE6OF01C34KZ.26.71.G05.1.454.CMB.1.raw
  modified_base (177)..(177): a, c, t, g, unknown or other
  misc_feature (177)..(177): n is a, c, g, or t
  modified_base (197)..(197): a, c, t, g, unknown or other
  misc_feature (197)..(197): n is a, c, g, or t
  modified_base (236)..(236): a, c, t, g, unknown or other
  misc_feature (236)..(236): n is a, c, g, or t
  modified_base (300)..(300): a, c, t, g, unknown or other
  misc_feature (300)..(300): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgctttactgcacaggatccgtggccttcgatgagctgattccagcccaccctnagtgtcctgtccccaggacngacagccaccatcacctgctcggcagacaaattgggaanataacgaatgctgctgtatacagacgccacgccacgtcccttagtttcgactatcgtacaaganaacgacgcgtcctacgacggtactccgtcgaacgtatttcgcggtctacccgaactcgaacggaaccaacgtacgcctaactcgtacgaacctacgtacgcggaccgggacccagaccgaaggtacgtacgaacgggactacttaacgtacgttacggacgtaggaccggtacggacgtaacgtaacgttacgttaggttacggttacggttacggtacgggtaacggacggtacggtaccggtacgtaccggtaccgtacgtaccgtacgaccggtacggtccgtcccgtcccggtacccgtcgtacgtaccgtaccgtcccgtcccgtccg

SEQ ID NO: 166576 - DNA, 774 bp, Homo sapiens
  misc_feature: GYAE6OF01AS6YQ.26.71.G05.1.454.CMB.1.raw
  modified_base (174)..(174): a, c, t, g, unknown or other
  misc_feature (174)..(174): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcacgcctaccctnagtcgtccgtcgtaccccgaggacagacacgccaccatccacctgcctcggacaagtaactaaggttgggaatagtaagtaactgactgtcctaggttaactaccgagtacggccgacggacctaccgttcccctttagttttcggacctacttaccttaaccgaaagtaacgtaaacggacggacccggtacctacggacgggtacctacccggtacgtaaccgttaagtttccgtcgtacctacccgtaacgttcggtaaccgggtaaccacgtaccgtaccgtacttaccgtacgaacctacggtaccgaccggggacccggacccctaacggaccggtaaacggtacggtacgggaacggacgttaccttaagttcgttaggtacgtacggggtacggtaacggaacttaaccgttacgttaggtttagggttacggttaggggttacgggaacgggtaggaccgtacgggtacgttaacccggtaccggttaccggtacggacccgtccggaacccgtaccgggtcccgtacccgggtcccccgtttacggtccgtacccgttttacccggtcccggttcccctcccgttacccg

SEQ ID NO: 166577 - DNA, 746 bp, Homo sapiens
  misc_feature: GYAE6OF01B75LN.26.71.G05.1.454.CMB.1.raw
  modified_base (241)..(241): a, c, t, g, unknown or other
  misc_feature (241)..(241): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcacgcccaccctcagtcgtcccgtcgtccccaggacagacagccacatccacctgctcggacagaacaagttggganataagaatgctgcctggtattaccagacggcaggccacgtcccctatttggtcacttctaccaagactaagaagccgcctacgacgggtactcctacgaccgtactttctcggactaccgaactcgtacggaacctacacgccctactctacgaccagtacgacggcccgggacccacggaccgaaacgggacgtacgggaacgggtaacgtaaccgttaacgttagttacggtacggtacgggtacggttaaggggtaacggtaaactttaacgtttaacgtttagggttaacgggtttacggggttttacgggggaccggggttaaacggggacccggtaacgggtacccgttaccgggtaacccggttcccggttaacgggtacccggaaccggtacccgggtaaaccgggtcccgttacccccgggtaccccccggtttccgggttaccccgttacccgtttccccggttaccccgttccccccgtccccgtttaccccgg

SEQ ID NO: 166578 - DNA, 726 bp, Homo sapiens
  misc_feature: GYAE6OF01EG7PY.26.71.G05.1.454.CMB.1.raw
  modified_base (121)..(121): a, c, t, g, unknown or other
  misc_feature (121)..(121): n is a, c, g, or t
  modified_base (151)..(151): a, c, t, g, unknown or other
  misc_feature (151)..(151): n is a, c, g, or t
  modified_base (244)..(244): a, c, t, g, unknown or other
  misc_feature (244)..(244): n is a, c, g, or t
  modified_base (325)..(325): a, c, t, g, unknown or other
  misc_feature (325)..(325): n is a, c, g, or t
tcagagactatactcacgaccggtgctcgatttagtgtcgtcgcaagagagagggggagtgactcctgtgccccaccatggacacgctttgctccacgctcctgctgctgaccatcccttnatgggtcttgtcccagatcaccttgaaggngtctggtcctgcgcgtggtggacgcccacgcagacccctcacgctcgacctgcctccgtctgtggacttctcactcacctacgactggaggtnagtgtcggccgtcggggtcctacgaccgggaccccggaaaggtcccgtgggacgtggtacttcggcacctctagtttacgnggtacgtgtatctacgaacgtcgtaactaactccgtctacgtaggaacggtaactccgtaactccaacctacgtaccgaccggaacgggtaccaacccgtaacggtaaacgggtacccggggttacgttaaccctaaacgaacgtacggaaccgaacgtagttaacgaacttcgtggttaacgaacctacgacgactaacgtacttactacgtcgacgaccgtaactaccggtacgttaccgtacgggacgtaaccgtaaccggagaaaaacggtaaaacgtaaacttacgtaacggtaggtttaacgggacggggtaaacccgttaagggggtttaccgtttaccgggtaaccgttacccgttaccccgtaccccggtacggtaccccgtaaaccccggg

SEQ ID NO: 166579 - DNA, 897 bp, Homo sapiens
  misc_feature: GYAE6OF01AF339.26.71.G05.1.454.CMB.1.raw
tcagagactatactcacgaccggtgctcgatttagtgtcgtcgcaagagagagggggctgggcctcaggaagcagcatcggaggtgcctcagccatggcatggactccctcttcttcctcggcgttccttgcttactgcacgaggtactccggtggtccttcgatgacgtctagtacttacacgtcccacccttacgacggttccggtccgttccgtaccccggaaggaccgaacggacacgacccaactactaccaccgtgtccgtacgggaactaacggtaaaccgtaaagggttacgggaagtaagttaaacggtaaatcgtacgttacggtccgtttaggttaacctaccggaacggacgggtacccgtaacgggtccttaacccggtttacccgttttaaggttttcggtaccttaccgttccttaacggtaaaacgtaaacgtaacgaaccgggtcccgtaccgttacggtacgggtaccctaccggtacgtaaccgttacgtttccgtacgtaccttaaccgtacggtacgggtaacggaacctaaccggtactaacccgttaccgtacctacgtaaccgtacggtaccgggacccggggaccccggtaccgaccgggaaacccggtaagggtaacgggacgggtaacgggtaccgttacttaacggtttacggttgaaccggggttcggggtaacggtaacggtaacgttaacgtttagttaaggtttgggttaacgggtttcggggtaacggaacggggtacggtaccgggacggttcggttaccggtacggttacgggacggttaccggaccggttaccggtaccgggtccgttacccgggtcccgttaccggttacccttaccgggttcccgttacccggttcccg

SEQ ID NO: 166580 - DNA, 708 bp, Homo sapiens
  misc_feature: GYAE6OF01CQ6J8.26.71.G05.1.454.CMB.1.raw
  modified_base (207)..(207): a, c, t, g, unknown or other
  misc_feature (207)..(207): n is a, c, g, or t
  modified_base (230)..(230): a, c, t, g, unknown or other
  misc_feature (230)..(230): n is a, c, g, or t
  modified_base (286)..(286): a, c, t, g, unknown or other
  misc_feature (286)..(286): n is a, c, g, or t
  modified_base (305)..(305): a, c, t, g, unknown or other
  misc_feature (305)..(305): n is a, c, g, or t
tcagagactatactcacgaccggtgctcgatttagtgtcgtcgcaagagagaggggtccatgccatggcatggatccctctcttcctcggcgtccttgcttactgcacaggatccgtggccttcgatgagctgattcagccaccctcagtgtccgtcgtcccaggacagacagccaccatccacctgctcggcagacaaattggganatagaatgctgcctgtatacagngcagccagtccctagtttgcagttctaccaagtagtaagacgcgccctgacgggtntccctagaccgtactttcncggcgttaccaacgtacgtcgggaaactacgagaccctatccgtacgacccgtatacgaacgggtcccggggacccaacggtacccgaaacgggtagtacgggacggtaaagtaccgttaacgttaacggttcgttacggacgggtcggtaagggacgtaaacttaacgttagttacggtaggtttcggttagggtaccgggacgggtaaccgaacgggttacgtccggtaaaccggtcccgttaacgggtacccgtaccggtacccggtaaaccggccccgttaccggtcccccggttccgtacccgttacccgttccgttaccccgttccccgaccctttccggtacccgtaagttacccgtcgttccttaccggtggaccgttcccgggtcgtaaccggg

SEQ ID NO: 166581 - DNA, 674 bp, Homo sapiens
  misc_feature: GYAE6OF01DPNF6.26.71.G05.1.454.CMB.1.raw
  modified_base (177)..(177): a, c, t, g, unknown or other
  misc_feature (177)..(177): n is a, c, g, or t
  modified_base (235)..(235): a, c, t, g, unknown or other
  misc_feature (235)..(235): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctnagtcgtccgtcgtccccaggacagacagccacatcactgctcggcagacaagtggganatagaatgctgactaggtactacgagacggccaggcctaccgttcccctttagttttcggtctacttaccttaccgaaagtaacgtaaacggaacggccggaccctacgaaggggtacctcccgtacggaacccgttaatttcgtacggccctacctaacgtcgtacggaactacgacgtcctactcctacgaaccacgtccgacggcccggggacccacgacccgaacgggtagacgggaacgggaactaaccgttaacgttacgttacgtacggacgggtacgggtacgggaagtaacgttacgttacgttaggttaggttggttacggggacgggtagggaccgtagggtaccgtaccggaccgttaccgtacggtacgacggacccgacggtccgtcccgtccccgtcggtaccctcgttccgtccggtcccccg

SEQ ID NO: 166582 - DNA, 624 bp, Homo sapiens
  misc_feature: GYAE6OF01BHS60.26.71.G05.1.454.CMB.1.raw
  modified_base (172)..(172): a, c, t, g, unknown or other
  misc_feature (172)..(172): n is a, c, g, or t
  modified_base (234)..(234): a, c, t, g, unknown or other
  misc_feature (234)..(234): n is a, c, g, or t
  modified_base (258)..(258): a, c, t, g, unknown or other
  misc_feature (258)..(258): n is a, c, g, or t
  modified_base (294)..(294): a, c, t, g, unknown or other
  misc_feature (294)..(294): n is a, c, g, or t
  modified_base (299)..(299): a, c, t, g, unknown or other
  misc_feature (299)..(299): n is a, c, g, or t
  modified_base (303)..(303): a, c, t, g, unknown or other
  misc_feature (303)..(303): n is a, c, g, or t
  modified_base (307)..(307): a, c, t, g, unknown or other
  misc_feature (307)..(307): n is a, c, g, or t
  modified_base (318)..(318): a, c, t, g, unknown or other
  misc_feature (318)..(318): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctnagtgtccgtcgtccccaggacagacacgccaccatcacctgctcggcagacaaagttggganatagaatgctgctggtattacagngcagccagtcccctatttggcatctcaagataagancgccnaggntccngaccgtattcngctccactcgtaggacacacgaccactctcgacctatacgacggccgggacccacgaccgaacgggataggacggggactaccgttactagttcgtaacgagggtcggtacgggagtaaacttagtttacgttaggttaagggttcgggtttaggggacgggtaacgggtaaccggacggtacggtaccggtacccggttacccgtacgggtacgacccggcccgaacgggtcccgtacccggtccccccggtacggttcccctaccgtttccccttacccgttccccccgtccccgtttaccccg

SEQ ID NO: 166583 - DNA, 790 bp, Homo sapiens
  misc_feature: GYAE6OF01BEYQX.26.71.G05.1.454.CMB.1.raw
  modified_base (247)..(247): a, c, t, g, unknown or other
  misc_feature (247)..(247): n is a, c, g, or t
tcagagactatactcacgaccggtgctcgatttagtgtcgtcgcaagagagagggggcctcaggaagcagcatcggaggtgcctcagccatggcatggactccctctccttcctcggcgtccttgcttactgcacgaggatccggtggccttcgatgagtctgattccacgcccacctcagtcgtccgtcgtccccaggacagaccacgcccaccatcacctgcctcggcagaactaagttgggaanagtaagtaatgctcgactggtactaccgagacggccagcctacgttcccctttagtttcggtctacttaccttaccaagtaagtaacggaacggccggtaccctacggaacgggtacctccccgtaacgtaaccgttacttacgtcggtaccctacgtaaccgttccggtacggaaaccaaccggaacctcccgtaaccttaccgaaccgtaccctacgtacccggaccggggtaccccgggacccaacggtaaccggaacgggtagtaacggggaacggtaacgtaccgttactacggtttcgtacggtacgggtaccggtaggaacgttaacgttacggtagtttacgggtacggtttggggttaccgggacgggtacgggtaccgtacgggtacccgtaccgggttacgtaccggttaacgggtaccccggaacgggttaccggtaaccggttcccgtacccccgggttacccccggttacgtaccccggttacccgttcccgggtttaccccgttcccccccggtcccgtttaccccgg

SEQ ID NO: 166584 - DNA, 622 bp, Homo sapiens
  misc_feature: GYAE6OF01AZMO4.26.71.G05.1.454.CMB.1.raw
  modified_base (238)..(238): a, c, t, g, unknown or other
  misc_feature (238)..(238): n is a, c, g, or t
  modified_base (311)..(311): a, c, t, g, unknown or other
  misc_feature (311)..(311): n is a, c, g, or t
  modified_base (334)..(334): a, c, t, g, unknown or other
  misc_feature (334)..(334): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccacctcagtgtcccgtgtcccccaggacagacagccaccatcactgctcggcagacaaagttggganatagaaatgctgcgtgtattaccagagccaggccacgtccctatttgcatctaccaagataagacgcgccctnagggctcccgtgactaatttcgnggacctaccaactcgtaggacacgagccactctcgaaccatcgacggccggcccacgacccgaacggatagggacggagtactaacgttagtagacgacggtggtacgggtaagtaactacgtagttaggtaagttggtttacgggacgggtacgggaccgtagggccgtacggtacccgttaccggtagggtacccgacgggttacccccgaaagggtccccgttacccggtacccccccggttacgggtaccctacccggttcccgttcccggtttacccccccgg

SEQ ID NO: 166585 - DNA, 672 bp, Homo sapiens
  misc_feature: GYAE6OF01ADPTD.26.71.G05.1.454.CMB.1.raw
  modified_base (183)..(183): a, c, t, g, unknown or other
  misc_feature (183)..(183): n is a, c, g, or t
  modified_base (245)..(245): a, c, t, g, unknown or other
  misc_feature (245)..(245): n is a, c, g, or t
  modified_base (347)..(347): a, c, t, g, unknown or other
  misc_feature (347)..(347): n is a, c, g, or t
  modified_base (402)..(402): a, c, t, g, unknown or other
  misc_feature (402)..(402): n is a, c, g, or t
  modified_base (510)..(510): a, c, t, g, unknown or other
  misc_feature (510)..(510): n is a, c, g, or t
  modified_base (632)..(632): a, c, t, g, unknown or other
  misc_feature (632)..(632): n is a, c, g, or t
  modified_base (657)..(657): a, c, t, g, unknown or other
  misc_feature (657)..(657): n is a, c, g, or t
tcagagactatactcacgaccggtgctcgatttagtgtcgtcgcaagagagaggggcgtgggccgtcgaggaagcgagcagtcggaggtgcctcagccatggcatggactccctctcttccgtcggccgtccttcgtcttactcggcacgaggtactccgtggtccttcgatgatctgattcncgcctccctgacgtgtcccgttacgaccccgaggaccacgacactcccacactccactgccncggacacgaagtaagttggggaactaagtcgaaatcgaccgtagtcccgttaggtactacggaacgcggaccgtacggctaaccgttccctttagtttacgntaccttacgtaccgaagtaacgtacggaacgtccgaccgtacgcgggtactcccnggtaacccttaagttccgtcggaaccctcgtaacgtcgtaacggaacttccgaccgcctacttaccgacgttacacgtcgaccggcggaccgacggtaacgtaccganacgggtacgaccgtacgtacgtaacgtccgtagacggtcgagggactaggttacctagttccgtagttacgggttacgacgggtcgaacggtgtaccgacggtaacgtccgtacgtacggcncggtacgccgtacgccgtcgtaccncgtacctcgtacccg

SEQ ID NO: 166586 - DNA, 749 bp, Homo sapiens
  misc_feature: GYAE6OF01ERV4F.26.71.G05.1.454.CMB.1.raw
  modified_base (181)..(181): a, c, t, g, unknown or other
  misc_feature (181)..(181): n is a, c, g, or t
  modified_base (250)..(250): a, c, t, g, unknown or other
  misc_feature (250)..(250): n is a, c, g, or t
  modified_base (258)..(258): a, c, t, g, unknown or other
  misc_feature (258)..(258): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggactccgtggccttcgatggagctgattcacgcccaccctnagtcgtccgtcgtccccgaggacagacacgccaccatcacctcgctcggacaacgactaaaggttgganataagaangctgcctaggtactacgagaggccacggcctacgttcccgttatttcggtactacttcttaccaagtagtaacgaacgcccgtccgtacgacgggtactccccgtagtaaccgtaactttcgcggtacctaccgtaacttcggtacggaacaacaccgaccctactccgtacgaacctacgtaccgggaccgggcccggggaaccctaacgggaacccggaaaccggtacgggtacgggtaaacgggacgttaaccgttaacgttacggttacggtcgggaacgggtaccgggtaagggaaacgttaacgttaacggtttacgttagggtttagggttttagggtttacggggacgggttacggaccggtacggtaccgttaccgggacccgttaacggtacggttacccgaaccggtccggtaacccggtccgtacccccggtccccgtaaccgggttcctacccgttcccggttcccgttaccccccgg

SEQ ID NO: 166587 - DNA, 768 bp, Homo sapiens
  misc_feature: GYAE6OF01CW6TU.26.71.G05.1.454.CMB.1.raw
  modified_base (218)..(218): a, c, t, g, unknown or other
  misc_feature (218)..(218): n is a, c, g, or t
  modified_base (519)..(519): a, c, t, g, unknown or other
  misc_feature (519)..(519): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacacgccacatcacctgctcgcanacaaagtggacgataacgaatgctagccgtggtacttaccaggacggccaaggccctaacgtccccttaagttttcgggacctacttccgttaccaaaggtaataaacggaacgccggtacccttacgaagggtacctcccggtacgtaaacccggtaaacgttttccgtggacccttaacccgaaacgtttacggaaccggggaaaccaaaccgtagaccccctaacgtttaccgtacggaaacccagttacccgacggggaccccggggtcccaaccggaacccgaaacgggtaaacgnggggaacgggtaaactaacgtaacttacgttagtaccggtaacggagggttaacgggaagtaaacgttaacgttaaggtttaggttaaccgggttggggtttacggacggggtaacggaacccggtaaacgggtctaccgggaccctttaaccgggaggtacccgtaacggacccccggtaaagtcccgtaaccccgcccccgttaacgggtccctaccctccgtaccgtttcccccgcccgttaaccc

SEQ ID NO: 166588 - DNA, 890 bp, Homo sapiens
  misc_feature: GYAE6OF01BH3UQ.26.71.G05.1.454.CMB.1.raw
tcagagactatactcacgaccggtgctcgatttagtgtcgtcgcaagagagaggggggactcctgtcgccccaccatggacacgctttgctccacgctcctgctgctgaccactcccttcatgggtcttgtcccagatcacttgaaggagtctggtctgcgcgtggtggacgcccacgcacgaccctcaccgctcgacctcgcctccgtctcgtggtacttcctcacctccaaccgacgtctaggtaggtacgtagtcggtcgggtccgtccgggtccgtaccggaccgggacccccgggaaacggtcccgtagggacggtcggtcgtaccggacctacgttacttacgtttacggtggtacggtgtacgttaccgtacgaacggtacggtaactaccgttacgttcgtacggtaggtaacggtaacgtaccgtacctaacctaacctaaccgtaccgaaacccgggaaccggtaacccgtaaccccgtaaacgggtaaacccggggttaacccgggttacccgtttaaacccggtaaaccgtaaccgtaaccggaaacccgtaataacgttaacgtaaccgttccggtaacggttaacccgaacgaaaccgtacggtaacctaaccgtttaagttaacctaccggttcgaccgtaacctaaccgtaaccgttaccgtaaccccggtcgggtacccggtaacccggtaacggtaaaccgggaaagttaaaacgtacggttaccgttaaacgggtaacgggtttaaaccggggtaccggggttaaacgtttacggggtttaccctttacggggaaccccctttaccccgtaacccgtacccccgggttaacctaccccgggtacccccggtaaacccgggttaaccccggg

SEQ ID NO: 166589 - DNA, 720 bp, Homo sapiens
  misc_feature: GYAE6OF01EJUM2.26.71.G05.1.454.CMB.1.raw
  modified_base (152)..(152): a, c, t, g, unknown or other
  misc_feature (152)..(152): n is a, c, g, or t
  modified_base (577)..(577): a, c, t, g, unknown or other
  misc_feature (577)..(577): n is a, c, g, or t
tcagagactatactcacgaccggtgctcgatttagtgtcgtcgcaagagagaggggggactcctgtcgccccaccatggacacgctttgctccacgctcctgctgctgaccacttcccttcagtgggtcttgtcccagatcacttggaaggngtctggtcctgcgcgtgggtgacgcccacgcacgaccctcgacgctcgacctgcctccgtctcgtgtacttctcacctccaccgacgtacgtggaggtgtaagttcggtccggtccggttcgggtcccgtaccggacccggggacccccggaacggtccgtagggtacgtcggtcttcgctacttcgttacgtttacggtggtacgtgtactcgtaacgtaacggtaccgttaactaccgttccgttcgtacggtaagaacggtacgtaccgtacctaccgaactacgtaaccgaaccggtaaccgggaccctaacccgtaaaccgggtaacgggtacccggttacgtaacctaacgaacgtaccgaaccgtactaacgtacgtacttcggagtacgaacgtacgagtactaactagttaccgtntcgacacacctcgaccgtgaccgtacggtaacacggaagaaagtaatagttactacggtaacgttcgggtacggtacgttaaggtttacggttccgtaccgtaccccgtccaccccgactcccgtaacccgccgggtaacccg

SEQ ID NO: 166590 - DNA, 723 bp, Homo sapiens
  misc_feature: GYAE6OF01AYN7G.26.71.G05.1.454.CMB.1.raw
  modified_base (176)..(176): a, c, t, g, unknown or other
  misc_feature (176)..(176): n is a, c, g, or t
  modified_base (239)..(239): a, c, t, g, unknown or other
  misc_feature (239)..(239): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggactccgtggccttcgatgagctgattcagccaccctnagtgtccgtgtccccaggacagacacgccaccatcacctgcctcggcagactaaagttggganataagaatgctgcctaggtacttaccgagcggccgaaggccctacgtcccctttagtttcggctacttccttaccaaaggtaactaaggtaaccgcccggtccctacgaacgggacttccccgtaggaacccgttatttcgacggccttaaccctaacttccggtagggtaaaccaccgacggaccctacttcgtacgaaaccctgtacgacgggacccgggccccgaacgacccgaaacgggatacgggaagggacgtacgttacgtattcgtacgtagggtcggtacgggaagtaacgttagttacgttaggttaggtaggtttcggggaacgggtacgggaaccgtacgggtaccgtacgggtacccgttaccggtacggtacccgaccggtaccccggaacgggtcccctcccgggtaaccccccttcggttacccgtacccgttccggtttccccgttcccccgtccccgtttacccgg

SEQ ID NO: 166591 - DNA, 812 bp, Homo sapiens
  misc_feature: GYAE6OF01ASTWV.26.71.G05.1.454.CMB.1.raw
  modified_base (512)..(512): a, c, t, g, unknown or other
  misc_feature (512)..(512): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttgatgagctgacttcacgcccaccctcagtcgtccgtgtccccgaggacacgacacgcccacctactccaccgttcgccgtaccggacaacgtaaccgtaaaagttggggaagaacgtaagtaaaacgttcggaccgttaccggtacccgttaggttaaccgtttaacccgaacgggtaccggacccgaacggtaccccgttaaccgttcccccgttttaagttttccgggtactaaccgttcccgttaacccgtaaagtaacgtaaacggaaccggcccggtaccccgttagaaccggggtaacctccccgtagtaacccgttagtttccgtcgtacctaccctaacgtcgtacgggaaccncgaccgcctacgtcaccgacacgtccgacgggacccggacccacgaccgtaacggtagtacgggaacggtaactaacgtaacgtagttcggtaccgacgggtacggtaggtaacgtaacgttacgttaacgttaggttaggttacgggttcgggaaccggggtacgggtaacgcggtacgtaccggtacccggttaccgtaaggtcccgaacggtaccccgaacggtccccgttacccgtaccccggttccgggtaccccttaccgtcccgtttccccggttccccctccccgttacccg

SEQ ID NO: 166592 - DNA, 708 bp, Homo sapiens
  misc_feature: GYAE6OF01BQJ6U.26.71.G05.1.454.CMB.1.raw
  modified_base (227)..(227): a, c, t, g, unknown or other
  misc_feature (227)..(227): n is a, c, g, or t
tcagagactatactcacgaccggtgctcgatttagtgtcgtcgcaagagagaggggggcctcaggaagcagcatcggaggtgcctcagccatggcatggatccctctcttcctcggcgtccttgcttactgcacaggatccgtggccttgatgagctgattcagccacctcagtgtccgtgtcccaggacagacagccacatcacctgctcggcagcaaattggganatacgaaatgactgcctggtattaccagtaggccaggccagtcccctattttcggtctatcttccaagtactaagaacgcggcctcgagggactccgtacgtaccgtaatttcgcggtctcccgaacgtcgtagggaaccacgacgcctacgtctcgaaccattccgaacgccggggtacccaacggtacccgaaacgggtacgttaggaacgggaacgtaaccgttaacgttacgtttaggtacgtaacggggtacggttaggggtaacgtaaacgttaacgttaagtttaacgggttaacggttacgggttttacgggacggggttaacggtacccggtaagggtcccgtacggtaccgggttacctaaccgggtcctaacgggtaccccgtaaaccgggtcccgttaccggtaccccccgttacccggttaccgaacccttacggtttacccgttacccccgtacccgtttaaccccg

SEQ ID NO: 166593 - DNA, 705 bp, Homo sapiens
  misc_feature: GYAE6OF01B8PNP.26.71.G05.1.454.CMB.1.raw
  modified_base (167)..(167): a, c, t, g, unknown or other
  misc_feature (167)..(167): n is a, c, g, or t
  modified_base (463)..(463): a, c, t, g, unknown or other
  misc_feature (463)..(463): n is a, c, g, or t
  modified_base (557)..(557): a, c, t, g, unknown or other
  misc_feature (557)..(557): n is a, c, g, or t
  modified_base (632)..(632): a, c, t, g, unknown or other
  misc_feature (632)..(632): n is a, c, g, or t
tcagagactatactcacgaccggtgctcgatttagtgtcgtcgcaagagagagggggactcctgtgcccacatggacacgctttgctccacgctcctgctgctgaccatcccttcatgggtcttgtcccagatcacttgaagagtctggtcctgcgcgttggagacncccacgcacgaccctcacgctcgacctgctccgtctcgtggacttcacactccaacacgaactggaaggtgaatggtcggccgttcggggtccgtacgaccggggaccccgaaaggtccgtaggacgtcggtacttcgacctacgtataagtttacgtggtaacgtgtaactcgtagaacggtacgtaacaacgtccgttacacggttacggaaggtaactcgaccttacaacccgaactacgaaccggaacggaccaaccgtaaccggaaagggttccggtaccgtaaccttaanaaagtccggaaacctaataacgacggttaacctcggttacgaaccggaacaacgacggaactacgtaattacgtttacgagtacgaacctaacncgttaacggtctaacgcgaacgttaacgaagaaagtaaaacgattaacgtaacgtcgttaagggtccgggtaaanacgggttttagtttacccgaccgtaaccgttcccttacccgaaccgcccgttaaccgaaacgggtaaccccgg

SEQ ID NO: 166594 - DNA, 605 bp, Homo sapiens
  misc_feature: GYAE6OF01BDMM7.26.71.G05.1.454.CMB.1.raw
  modified_base (209)..(209): a, c, t, g, unknown or other
  misc_feature (209)..(209): n is a, c, g, or t
  modified_base (235)..(235): a, c, t, g, unknown or other
  misc_feature (235)..(235): n is a, c, g, or t
  modified_base (329)..(329): a, c, t, g, unknown or other
  misc_feature (329)..(329): n is a, c, g, or t
  modified_base (495)..(495): a, c, t, g, unknown or other
  misc_feature (495)..(495): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattccagcccaccctcagtgtccgtgtccccaggacagacagccaccntccgactgctcggcagacaatggganatagaatgctgctgattaccagagcaggccatccctattggtcagtctccaaggataagtaacgcgcctgaggactccgagaccgtaacttcgngtcctaccaaatccgtagggaaccacgaacgcccaacttctacgacctatcgacggtaccggggacccacgaacccaacgggtatacggaaggtacgaacttacgtgttagtacaggcgtaggaggaactagtattggtacgtggtttggacgggtggaccgaggntcggtaccgccgttaacggtcgacggtaacccgacggtaccgtacccggtcccccgttaccggtacctacccggttaccttccccgttcccctaacccccgtttacccgg

SEQ ID NO: 166595 - DNA, 745 bp, Homo sapiens
  misc_feature: GYAE6OF01A8KDV.26.71.G05.1.454.CMB.1.raw
  modified_base (244)..(244): a, c, t, g, unknown or other
  misc_feature (244)..(244): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccaccctcagtcgtccgtgtccccaggacacgacacgccaccatccactgcctcggcagactaaagttgggaanataagaatgctgcctggtaacttaccagacggccacggcctacgttccccttagttttcggctacttccgttaccaagtaacgtaacgacgtccggtaccctagacgggtactccccgtagtaacccgtaatttccgtacggtcctaccgtaaccgttccgtaacgggaacctaccgacgtaccccgtactcgtacgaccgtacgaccgacgggcccggggaccccaaccgggaaccccgaaacgggtacggtaacgggaacggggaactaaccgttacgttacgttcggtacgacggggtacggtaggggtaactaagttaccgttaagtttagggttacggttagggtttacggggaccgggtacgggtaaccggtgggtaccggttaccggacccgggttacgtaaccgggtacccgtaacggaccccgtaccgggtcccgttaccccggtcccccgttacggtaccctaccggttcccgttccccggttccccccgg

SEQ ID NO: 166596 - DNA, 711 bp, Homo sapiens
  misc_feature: GYAE6OF01D19PD.26.71.G05.1.454.CMB.1.raw
  modified_base (179)..(179): a, c, t, g, unknown or other
  misc_feature (179)..(179): n is a, c, g, or t
tcagagactatactcacgaccggtgctcgatttagtgtcgtcgcaagagagaggggggctgggcctcaggaagcagcatcggaggtgcctcagccatggcatggactccctctcttcctcggcgtccttgcttatgcacaggactccgtggccttgatgagctgattcacgccaccctnagtcgtccgtcgtaccccgaggactacgaacacgacctaccactcctaccgtcgccgtacggaacaagtaactaaagttgggaataactagaactgcctcgtaccgttacgttacaaccgcggacggacctagccctttacggttccctttagttcgtactactaccgtacaagactaacggaccgccggtacccgtagaccgggtacctaccctaggtaccgttacgttcgcggtacctccgtaacggtactacggaacgaccacgtcctactacccggtactaaccacgtaccggcggtacccggcgaaccggacgaacggtaggagacggtactacgttacgtgtacgaggtacggtacgtaggtacgtaagttacgttggttaaacgggttcggtagggtacggggtagggtaccggtaacgtccggtaacggtccggtaaccgtcggtacgaccggtaccgtaccgggtccgtcccggttaccccgtcccgttcgtaaccgttcccttccgtcccgttaaccccccg

SEQ ID NO: 166597 - DNA, 670 bp, Homo sapiens
  misc_feature: GYAE6OF01EEPBR.26.71.G05.1.454.CMB.1.raw
tcagagactatactcacgaccggtgctcgatttagtgtcgtcgcaagagagagggggggactcctgtgccccaccatggacacgctttgctccacgctcctgctgctgaccactcccttcatgggtcttgtcccagatcaccttgaaggagtctggtcctgcgctggtggacgcccacgcacgaccctcacgctgacctgcctccgtctctggtacttctcactccaccacgactgaggtgaatggtcggccgtcggtccgtcgaccggaccccggaaggcccgtgggagtcggtcttgacctacttctatttacgtggtagtgactctacgaacggacgtaactacttccgtctcgtaggaacggaactccgactaccaaccactccgaaccgaacggacctaaccctaaccggaaacggtaccgggttacgtaccttaacgaacgtaccgaacccgtaactaagtacgtaacgttccgtaggtacggaaccaacgaggaccaatactttacttacgtgtacaccaacgacgtacgtaccgtagggaccgtacctaacggagtaaagaaaacgtatacgtagtacgttaggtacggggtacttaaggggttactttcggacccgtacccgttccccaccccacggtacccctacccgaaccggtaccgg

SEQ ID NO: 166598 - DNA, 725 bp, Homo sapiens
  misc_feature: GYAE6OF01DWF1S.26.71.G05.1.454.CMB.1.raw
  modified_base (348)..(348): a, c, t, g, unknown or other
  misc_feature (348)..(348): n is a, c, g, or t
tcagagactatactcacgaccggtgctcgatttagtgtcgtcgcaagagagagggtccattccatggcatggatccctctcttcctcggcgtccttgcttactgcacagatccgtggccttcgatgagctgattcacgccaccctcagtcgtccgtgtccccaggacagacagccacatcacctgctcggacagacaagttggagataagaatgctgcctggtatacgagacggccacggccacggttcccttagttttcggactacttaccttaccgaaagtactaaggaacggtccggtacccctagtaacgggacttaccccgtaggtaccggttaattttccgnggtaccctacccgtaactccggtaaagggtaccaaccgacgtccccttaacgtaccgtacgaccgttacgccgacggggccccggggaaccacggtaccgaaaccgggtagacgggaaggtaacgtaacctttacgtacgttacggtacggacgggtacggtagggtaaattaacgttaacgttagttagttacgggtttcgtttacgggcgggttaacgggcccggtagggtacctacggttaccggtacgtacggtaccgacgtaccggacggttcgtccccgtacccgttcgttcaccgtttccgtaccgttccccgtccgttccgagtaccttacgttcgtccgtcaacggttcggcggttccgtaggaccgg

SEQ ID NO: 166599 - DNA, 724 bp, Homo sapiens
  misc_feature: GYAE6OF01DF1Q7.26.71.G05.1.454.CMB.1.raw
  modified_base (341)..(341): a, c, t, g, unknown or other
  misc_feature (341)..(341): n is a, c, g, or t
  modified_base (345)..(345): a, c, t, g, unknown or other
  misc_feature (345)..(345): n is a, c, g, or t
tcagagactatactcacgaccggtgctcgatttagtgtcgtcgcaagagagaggggggactcctgtgccccaccatggacacgctttgctccacgctcctgctgctgaccatcccttcagtgggtcttgtcccagatcaccttgaaggagtcgtggtcctgcgctgggtggagccccacgcacgaccctcacgctcgacctgccgttccgtctcgtggacttcctcacctacacccacgacgttaggaggtgaagtggtcggccggttcgggtcccgtcgacccggggaccccggaacggtcccgtgggtacgtggtccttcgcacttacgtattttacgnggtntacgtatcgtacgaacgtcggtactaactccgtacgtcgtaggaagacgtcgacctaccactacgtaccgacgaacggaccaacccgtacgaaacggtccgggttacgtacttaacgaagtaccgtaaccacggtaattcggtaactcccgttaggacgaacgacggaacgactaacttaagttacctttagtccgtactaccaactaaccgtaccgttaccgtacggtccggtaaccgtaacggaaaccgtaagaaaaacgtagttaacgtaaccgttacggttaggtaccggggttaacgttaacgggtttaggtttaccgtacccgttacccgtacccgtaccccgaccgtacccctaccgaacccggtaccccgg

SEQ ID NO: 166600 - DNA, 678 bp, Homo sapiens
  misc_feature: GYAE6OF01CEBB2.26.71.G05.1.454.CMB.1.raw
  modified_base (235)..(235): a, c, t, g, unknown or other
  misc_feature (235)..(235): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccacatcacctgctcggcagacaaattggganatagaaatgctgctggtataccagagccagccagtcccctattgtcatcttcaagataagaagcggcctcagggactccctgaccgaatttctggcctccaaactctagggaaaccacacgcccactctcgaaccatcgacggccgggggaccccaacgccccgaaacgggtacgagggaacgggaacgtaaccgttaacttacgttaggtccgagggtacggtacgggggaaacgtaaattaacccgtagtttagggttaggtttcgggtttagggtacccggggaggggaaccccgtaaggggtcccgttacggaacccggttaccggttaaccgggtactaaccggggacccccgaaaacggggtcccgttacccgggccccccccgtttacgggggttcccccaacccggtttccccgtacgggtttaccccccccccg

SEQ ID NO: 166601 - DNA, 523 bp, Homo sapiens
  misc_feature: GYAE6OF01B5U7J.26.71.G05.1.454.CMB.1.raw
  modified_base (234)..(234): a, c, t, g, unknown or other
  misc_feature (234)..(234): n is a, c, g, or t
  modified_base (315)..(315): a, c, t, g, unknown or other
  misc_feature (315)..(315): n is a, c, g, or t
  modified_base (320)..(320): a, c, t, g, unknown or other
  misc_feature (320)..(320): n is a, c, g, or t
  modified_base (331)..(331): a, c, t, g, unknown or other
  misc_feature (331)..(331): n is a, c, g, or t
  modified_base (342)..(342): a, c, t, g, unknown or other
  misc_feature (342)..(342): n is a, c, g, or t
  modified_base (349)..(349): a, c, t, g, unknown or other
  misc_feature (349)..(349): n is a, c, g, or t
  modified_base (360)..(360): a, c, t, g, unknown or other
  misc_feature (360)..(360): n is a, c, g, or t
  modified_base (408)..(408): a, c, t, g, unknown or other
  misc_feature (408)..(408): n is a, c, g, or t
  modified_base (442)..(442): a, c, t, g, unknown or other
  misc_feature (442)..(442): n is a, c, g, or t
  modified_base (487)..(487): a, c, t, g, unknown or other
  misc_feature (487)..(487): n is a, c, g, or t
  modified_base (514)..(514): a, c, t, g, unknown or other
  misc_feature (514)..(514): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaatgctgcctggtattaccagaggccaggcccagtccccctattttggcatcttccaagataagaagcgcctgaggntcccngaccaatttcngcctcaactcngggaacncaagccactcngaccatcagccgggcccagccaagatgaggagactactagttgcaggngcgggaagaatacttatggttacttgggttgggngtacgggcacggctcggaccgttccgaggtcgagcccgaaggtcnccgcccctgtccaccttgtcgttcccncccgttacc

SEQ ID NO: 166602 - DNA, 702 bp, Homo sapiens
  misc_feature: GYAE6OF01EKEQR.26.71.G05.1.454.CMB.1.raw
  modified_base (240)..(240): a, c, t, g, unknown or other
  misc_feature (240)..(240): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtcccccaggacagacagcccaccatcacctgcctcggcagacaaagttggganatagaatgctgcctggtatacagagccaggccacgtcccctagtttcggtctactcttaccaagataaggaacgcggccctacgagggtactcccgtagaaccgtaatttcgcggcctaccaacgtcgtacggaaccacgacgacccacttctcgacctagtccgtacggccggggtccccaaggaccccgtaaacgggacgtaggggaacgggtaacgtaacccgttaagttaacgtttacgggaccgtaacgggtaccgggtaggggtaacgtaaacgttaacggttagtttagggttaacggtttggtttacgggggaccggggtaacggggtacccgtaagggtccgttacgggaacccggtttaccggtacgggttaccgaaccgggtacccgaacgggtcccggtcccgtacccccgttcgggtacccctaccgttcccgtcccggttaccccccg

SEQ ID NO: 166603 - DNA, 699 bp, Homo sapiens
  misc_feature: GYAE6OF01BTET6.26.71.G05.1.454.CMB.1.raw
  modified_base (242)..(242): a, c, t, g, unknown or other
  misc_feature (242)..(242): n is a, c, g, or t
  modified_base (358)..(358): a, c, t, g, unknown or other
  misc_feature (358)..(358): n is a, c, g, or t
  modified_base (372)..(372): a, c, t, g, unknown or other
  misc_feature (372)..(372): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtgccttcgatgagctgattcagccacctcaggtcgtccgtcgtccccaggacagacacgccaccatccacctgcctcggcagacaaagttgggganaagtacgaatgcgtcgaccttggttaacttaccaggacggccacggccctacgtccccgtttagtttcgactactcttaccaagtactaagacgcggccctagacggtactcccgngtaaccgtattcgngtcctacacgttcgaggaacacgacgtcctactccgtacgacctactaccggacgggaccggggtccccaacgggaccccgaaacggtacggtacggaaaccggggtaacgtaaccttaacggttagtttcccggaacggtacggggtcggttaagggaacgtttaacgtaacgtttaggtttaacgggttagtttacgggttacgggaccggtaacggggtacgcggggtactaccgggtaccggttaccgtacggtccgaaccggtcccgacggtcccgtacccggtccccgtacggtaccctccgttcccgttccgtacccccg

SEQ ID NO: 166604 - DNA, 730 bp, Homo sapiens
  misc_feature: GYAE6OF01BWP7X.26.71.G05.1.454.CMB.1.raw
  modified_base (253)..(253): a, c, t, g, unknown or other
  misc_feature (253)..(253): n is a, c, g, or t
  modified_base (391)..(391): a, c, t, g, unknown or other
  misc_feature (391)..(391): n is a, c, g, or t
  modified_base (447)..(447): a, c, t, g, unknown or other
  misc_feature (447)..(447): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccggtggccttcgatgagctgattcacgcccaccctcagtcgtccgtcgtccccaggaccagacacgaccaccactccaccgtgcctcggcaagaacgtaaagtgggaanataagaaatgtctcgctggttaactaccgagacggccgaggccctaccgttcccctagttttcggctactcttaccaagtagtaaacgacgccggtacccctgaacgggtacctcccgtaggtaaccttaacgtttcncggtcctaaccgtaacgtacggtacgggaacaccgaccgccacttccgactaccgngtaccggacgggccgggaaccgacggacccgtaaagggacgtacggggaacggtaactaccgtttaacgtacgttcggtaccgtacgggcgggttaagggtaacgtaacgtttaagttacggtttaggttaacggggtttaggggtttaggggaccgggtacggaaccgggtacgggtcggtaccgggtaccggttaccggtaacgggtcccaaccgggtaccgacgggttcccgacccggtcccgttaccgggtcctacccggttccgtcccgttacccccg

SEQ ID NO: 166605 - DNA, 605 bp, Homo sapiens
  misc_feature: GYAE6OF01AW2RL.26.71.G05.1.454.CMB.1.raw
  modified_base (236)..(236): a, c, t, g, unknown or other
  misc_feature (236)..(236): n is a, c, g, or t
  modified_base (333)..(333): a, c, t, g, unknown or other
  misc_feature (333)..(333): n is a, c, g, or t
  modified_base (362)..(362): a, c, t, g, unknown or other
  misc_feature (362)..(362): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccaccctcagtgtccgtgtccccaggacagacagccacatcacctgctcggcagacaaagttgganatagaatgctgctggtataccagagccaggccacgtccctatttgctatcttacaagataagagcgacctgaggactccgtagaaccgtaattccgnggcctaccaaactcgtagggaacacgacncccgtactcacgtaccagtccgacggccggggaccccaggacccgaaacggtatagggaacggacgaacttacgtaagttcgaccgtaggcggtagggaagtaactacgttattggtagttggttacgggcggtaggaccgtaggtccgtaggaacccggttccgtaacggtcgaaccggacccgaacggtcccgacccggtacccccgtcggtacccaccgttccgttaccgttaccccccg

SEQ ID NO: 166606 - DNA, 627 bp, Homo sapiens
  misc_feature: GYAE6OF01B0HMB.26.71.G05.1.454.CMB.1.raw
  modified_base (241)..(241): a, c, t, g, unknown or other
  misc_feature (241)..(241): n is a, c, g, or t
  modified_base (426)..(426): a, c, t, g, unknown or other
  misc_feature (426)..(426): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccaccctcagtgtccgtcgtccccaggacagacacgccaccatcacctgctcggcagacaaagttgggaanataagaaatgctgcctaggtaacttaccgagacggccacggccacgtccccttatttcggtctatctacaagataagacgcgccgtagacggactccctagaccgtaattcgtcggctaccaactcgtacggaacacgacgccactctacgaccagtcgacggccgggcccagacccgaacggangggacggacgaacgttactacgttcggtacgacggcggtagggaataagtacgtagttgtagttggttgggacgggagggtacccgagggtaccgtacggtaacccgttacggtacgggtaccaacgggacccccgaaagggccccttacccgggacccccttacgggtaccctaccgttccccgttccggttaccccccc

SEQ ID NO: 166607 - DNA, 733 bp, Homo sapiens
  misc_feature: GYAE6OF01EHZEF.26.71.G05.1.454.CMB.1.raw
  modified_base (175)..(175): a, c, t, g, unknown or other
  misc_feature (175)..(175): n is a, c, g, or t
  modified_base (226)..(226): a, c, t, g, unknown or other
  misc_feature (226)..(226): n is a, c, g, or t
  modified_base (233)..(233): a, c, t, g, unknown or other
  misc_feature (233)..(233): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctnagtcgtccgtgtcccccaggacagacacgccaccaactcacctgctcgganccgtaanaaaggttgggagaagtaagaaatgactgccttcggtacttaccgaggacgccaggcctacgttccctttagttttcgacctacgtctttaccgaaaagtaatcccggaacggtacccggtacctaccggtacggttcgaaacccccgttcgtaaccgttaacgtttccgtacggtacctacccggtaaccgtaccgtaacgggacctaaccaccgtcctaccgtacgtacgaaccacggtaccgaccggccgggtaccccaacgggaccgtacgggaacgaacgggaacgggtcgaaaaaccgtttactacgttacgtcgaacggggtaccgtagggtaacgtaacgttaacgttagtttacgggtaggttacgggttaggaaccgggtacggcacggtcctacgggtccgttacgaacccggtcgaccgtacccggtaacgcccgtaccggtacccctacggtcccttactaccctcccgtttacccccgccttacccg

SEQ ID NO: 166608 - DNA, 738 bp, Homo sapiens
  misc_feature: GYAE6OF01ETTCX.26.71.G05.1.454.CMB.1.raw
  modified_base (250)..(250): a, c, t, g, unknown or other
  misc_feature (250)..(250): n is a, c, g, or t
  modified_base (255)..(255): a, c, t, g, unknown or other
  misc_feature (255)..(255): n is a, c, g, or t
  modified_base (264)..(264): a, c, t, g, unknown or other
  misc_feature (264)..(264): n is a, c, g, or t
tcagagactatactcacgaccggtgctcgatttagtgtcgtcgcaagagagagggggctgggcctcaggaagcagcatcggaggtgcctcagccatggcatggatcccctctcttcctcggccgtccttgccttactgcacaggatccgtggccttcgatgagctgattcagcccacccgtcagtgtcccgtcgtccccaggacagaccacgccaccatcacctgcctcggcagacgtaaagttcggganagtanaaacgggtnacctagtcccgttaggttaacttaccgaggtacggaccgacggacctaccgttccccgttaagttttcggtactacttccttaccgaaagacgtaaaggaacgccgtacccctacggacggtacctcccgtagtaaccgtatttcgtggacctaccgacttcgtacggaactacgacgtcctacgctcgaccacgtacgacggcccgggacccacgtacccgaaggtactaagggacgggtaacctaaccgttaaccgttacgtttacgaccgggtaagggttccggagggtaagtaaaccgtttaaccgttagtttcgggttaagtttcgggtttagggaccgggtacgggtacccgaggttcccggtacggtaccccggttacggttaccggtacccgaacggtcccggaaccggtccccgtccccgaccccggttccgtaccctaccccgtttgtcccccggttacccccg

SEQ ID NO: 166609 - DNA, 725 bp, Homo sapiens
  misc_feature: GYAE6OF01BYY7D.26.71.G05.1.454.CMB.1.raw
  modified_base (253)..(253): a, c, t, g, unknown or other
  misc_feature (253)..(253): n is a, c, g, or t
  modified_base (261)..(261): a, c, t, g, unknown or other
  misc_feature (261)..(261): n is a, c, g, or t
  modified_base (263)..(263): a, c, t, g, unknown or other
  misc_feature (263)..(263): n is a, c, g, or t
tcagagactatactcacgaccggtgctcgatttagtgtcgtcgcaagagagagggggctgggccctcaggaagcagcatcggaggtgcctcagccatggcatggactccctctcttcctcggcgttccttgctttactgcacgaggctccggtggtccttcgatgagctgattcacgcccacctcagtcgtccgtcgtccccgaggacagacacgccaccatccacctgcctcggacagaactaaggtggaanatagaatncncgtctagtactacgaggacgccgacgacctaccgttcccttagtttcggactacttactaccgtaagaacgtaacggacgtccgtcccttacggacggtacctcccgacggtacctagttcgtacgtcctacctacgtacggtacggaccacgtaccgactaccgtctacaccgactccggaccggccccgggtacccacgggaaccccgaagggtacgacgggaacggtacttaccgttacgttacggtaggaccggtagggtacggtaaggtaagtaacgttacgttaggttacgttaagggttccggggtacgggtacgggaacggtaccggtacggtaccggtccggttaccggtaccggtacggtacccaccggggacccgtaccggtacccccggttccccggtacccccgttacggtaccccgttacccgttcccgttcccccggtttacccccg

SEQ ID NO: 166610 - DNA, 850 bp, Homo sapiens
  misc_feature: GYAE6OF01DTATP.26.71.G05.1.454.CMB.1.raw
  modified_base (244)..(244): a, c, t, g, unknown or other
  misc_feature (244)..(244): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccaccctcagtcgtccgtgtccccaggaccagacacgccaccatccacctgcctcggacagactaaagttgganatagaatgctgccgtaggtataccgagacggccacggcctacgttcccctttagttttcggcctagttccttaaccgaagtaacgttaaaggaaaccggtcccggtacccctacggaaccggggtaccttaccccgttacggtaacccgttaaagttttcccggtacggtacccttaccccgtaaaccgttccgtaacggggtaaaaccctaccgtaaccggtacccctaaccgtttcccgtaacggtacccctaacgtttacccggacccggggaccccgggggtacccccgaaaccgggtaaccccggaaacgggtaacggtacggggaaccggggtaacgtaaccgttaaccgtttacggttcggtaaccggtacggggtacgggtaacgggtaacgttaaacgttaacgtttaagtttacgggttaacgggtttcgggtttacgggaccggggtacgggtaccggtacgggtaccgtaccggtacccggttacccgttaacgggtacccgtaccggtaaccccggtaaaccgggtcccgttccccggtaccccccgttacgggtaccccgttaccgttccccgttcccggtttacccccccg

SEQ ID NO: 166611 - DNA, 732 bp, Homo sapiens
  misc_feature: GYAE6OF01EMNVY.26.71.G05.1.454.CMB.1.raw
  modified_base (177)..(177): a, c, t, g, unknown or other
  misc_feature (177)..(177): n is a, c, g, or t
  modified_base (236)..(236): a, c, t, g, unknown or other
  misc_feature (236)..(236): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctnagtcgtccgtcgtccccaggaccagacagccacatcacctgctcgcagactaagtgganatagaatgctgcctgtactacgagacggccacggcctacgttcccttagttttcggtactacttccttaccaaagtacgtaaacgacggtccgacccgtacgtaacgggtacttccccgaggtaacccgttaagtttccgtacggtacccttaccctaacgttaccggtacggggaaaacctaacccggtaaccgtacccgtaacccttccgtaaccgtaaccctacgtacccgggaaccgggaccccgggggaccccgtaaccggaaccccgtaaacgggaacggtaacggggtaacgggaacgtaaccgttaacgtacgttacggtacggacgggttacggaggggtaactaacgttacgtaggttaggttacgttgggttacgggacggtacgggaccgtaggtccgtacggtaaccgttccggtaacgtcccgaacgcccgaacggtcccgtcccgtaccccgtcggtaccctactccgtcccgttcccccg

SEQ ID NO: 166612 - DNA, 854 bp, Homo sapiens
  misc_feature: GYAE6OF01EGLHW.26.71.G05.1.454.CMB.1.raw
  modified_base (285)..(285): a, c, t, g, unknown or other
  misc_feature (285)..(285): n is a, c, g, or t
  modified_base (632)..(632): a, c, t, g, unknown or other
  misc_feature (632)..(632): n is a, c, g, or t
tcagagactatactcacgaccggtgctcgatttagtgtcgtcgcaagagagagggggcctcaggaagcagcatcggaggtgcctcagccatggcatggactccctctcttcctcggcgtccttgcttactgcacgaggactccgtgggtcctttcgatgagtcgttgtacttcgacgcccctaaccctctaggtcggttccgtcggtcccccaagggacacgaccgacgcccaacactaccacccgtgccgtcgggactaacggaaactaaacggttggggaaanaaagtaagtaaacgttcggtcgttcgtaccggtttacggttaacttaacccggaaggtaccggggaccgaacgggtccccgttaaccgttttacccccggttttagttttcggtacttactttacgtaacctaaagtaacgtaacggaccggccggtaccgttacggaacgggtccttacccgacggtaaccgtttaacgttcgtacgtccaaaccgttacggtccgtacgggaaacctaacgactacccgtacttcccgaatacccgactaccgggacggacccgggaccctaggaccgtaaggtggtaacggacgtacgtacttaccttaggtacgcggtacggngggtagggtaactaacgttagtaacggttttgggtaacggtttgggttaacgggtaccggggacggttaccggtaacgggtcgttaccgggtaaccccgttcggtaaggggtaaccccgtcggtaaacccggtaccgttccccgggtacccggttcccccggttccggttaaccggttccccttttaacccggcccccggttttcccgacccctttaaccgg

SEQ ID NO: 166613 - DNA, 676 bp, Homo sapiens
  misc_feature: GYAE6OF01DMYRC.26.71.G05.1.454.CMB.1.raw
  modified_base (177)..(177): a, c, t, g, unknown or other
  misc_feature (177)..(177): n is a, c, g, or t
  modified_base (234)..(234): a, c, t, g, unknown or other
  misc_feature (234)..(234): n is a, c, g, or t
  modified_base (257)..(257): a, c, t, g, unknown or other
  misc_feature (257)..(257): n is a, c, g, or t
  modified_base (276)..(276): a, c, t, g, unknown or other
  misc_feature (276)..(276): n is a, c, g, or t
  modified_base (294)..(294): a, c, t, g, unknown or other
  misc_feature (294)..(294): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctnagtgtccgtgtccccaggacagacagccaccatcacctgctcggcagacaagtgganatagaatgctgcctgtatacagngcagcacgtcctattggcntctcagataagagcgccncgaggactcctagaccgtaattctaggtcctaccaacgttcgtacgggaaccacgacgccgtactacgtacgacccagtaccgtacggaccggggccccaacggacccaacgggtaagtacgggacggggtaacgtaaccgttaacttacggttacggttacggtaacgggccgggttaaggggtaacgtaaacgttacgttaacgttttagggttaagggttgggttttacgggacgggtaacgggtaccggtaacgggtcgtacccgggtaccggttacccggttacgggtaccgtaacggaccccgtaaacgggtcccgtaccccgggttcccccggtacccggttaccgaccctttcccggttcccggttaccccccg

SEQ ID NO: 166614 - DNA, 854 bp, Homo sapiens
  misc_feature: GYAE6OF01DU0J5.26.71.G05.1.454.CMB.1.raw
  modified_base (178)..(178): a, c, t, g, unknown or other
  misc_feature (178)..(178): n is a, c, g, or t
tcagagactatactcacgaccggtgctcgatttagtgtcgtcgcaagagagagggggctgggcctcaggaagcagcatcggaggtgcctcagccatggcatggatccctctcttcctcggctccttgcttactgcacaggatccgtggccttcgatgagcgtgtatcacgcccacctnagtcgtccgtcgtaccccgaggacagaccacgaccaccactccacctgacctcggacaagtaaacgaagttggggaagtaagtaagaaagtcgcgttacggccgttaggttactaaccgaaggtacggaccgaccggtaccgtaccgtttacccccgttttagttttacgttcctactttaccgttaaccgaaagtaacggtaaaacggtaacccggccggtccccgtaacggaacgggtccctacccggttaaccggtaaccgtttaacgtttcccggtacggtaccccttaacccgtaaccgttaccggtaacgggaaccctaaccgtacccgtacctacccgttacgacctaaccgtaacgtaccccgggaacgggccccggggaaccccgacggaaccccggaagggtacgggtacggggtaaacggtaccgtaaccgttacgttacgggttacgtacgggacgggtagggtacggtaacgttaaagttacgttaaggtttgggtttagttacggggtttcgggaacggtaccggggtaaccgtcggaccggtacccggttaccggaccggttccggtaccgaacccgggtacccgtaaccgggtccttacccccggtcccccggtttacggtacccccgtaccgggtttccccgtcccccggttacccccg

SEQ ID NO: 166615 - DNA, 835 bp, Homo sapiens
  misc_feature: GYAE6OF01EHLBY.26.71.G05.1.454.CMB.1.raw
  modified_base (232)..(232): a, c, t, g, unknown or other
  misc_feature (232)..(232): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacacgccaccatcacctgctcgcagacaagtgganatagaatgctgctgtataccagacggccaggccacgtccccttatttcggtctatcttaccaagataacgaacgcgcctcgaggtactccgtagaccgtaattcgtcggtacctaccaactcgtacggaacacgacgccactctacgacctagtccgacggccggggacccacggaccgaaacgggacgtacgggaacgggtaacgtaaccgttaacgttaacggtttacggtaccggtaacggggtaccgggttaacgggggtaaacgtaaacgtttaaccggtttaaaggttttaacgggtttaacgggtttacgggggttttacgggggtaaccgggggttaacggggtaaccccggtacgggggttacccgttaaccggggtaacccccgggttaccgggttaaacccggggttaccccgggtaaacccggggtaacccccggttaaaaccgggggttcccccgttaacccccggggttaacccccccccgggtttaccccggggtttaccccggttaacccccggttttaaccccccgggttttacccccgggtttttaaccccccccccgtaacccccccggttttaacccccccgg

SEQ ID NO: 166616 - DNA, 757 bp, Homo sapiens
  misc_feature: GYAE6OF01ACXQ9.26.71.G05.1.454.CMB.1.raw
  modified_base (134)..(134): a, c, t, g, unknown or other
  misc_feature (134)..(134): n is a, c, g, or t
  modified_base (250)..(250): a, c, t, g, unknown or other
  misc_feature (250)..(250): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttacngcacaggatccgtggccttcgatgagtctgattcagcccaccctcagtcgtccgtcgtccccaggacagaccacgccaccatccacctgccgtcggacagaactaaagttgggaanataagaatgactcgctaggtactaccaggacgccaggtaccctacgttccccttagtttcggctattccttaccaagtataacggacgtccggccctagacgggtacctcccgtacgaaccgtatttccggcgtacctacctacggtccgtaacggaaccaccgacgtcccctaactccgtacgaaccctacgtcccggaccgggtcccggacccccgtaggaaccccggtaacggtacggtacggggaacgggtacccgttaacgttacggttaccgtttacgggaccgtacggggttacgggaacggggtaattaaacccggtttacgttagttttaggggttaacggttcggggttttaacgggaccgggtaaccgggtacccggtaggtccggttaccggtacccggtaccgggttaccggttaccgacccggtaccgtacccggtcccttacccgggtcccccttacggtccctacccggttccgttccccgttaacccccg

SEQ ID NO: 166617 - DNA, 751 bp, Homo sapiens
  misc_feature: GYAE6OF01C628M.26.71.G05.1.454.CMB.1.raw
  modified_base (251)..(251): a, c, t, g, unknown or other
  misc_feature (251)..(251): n is a, c, g, or t
  modified_base (441)..(441): a, c, t, g, unknown or other
  misc_feature (441)..(441): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtcttgcttactgcacaggatccgtggccttcgatgagctgattcacgcccaccctcagttcgtcccgtcgtccccaggaccagacacgcccaccactccacctgcctcggacagaactaaagttggganaataagaatgctagtccgtagtaacttaaccgagacggaccgacggccaccgtttcccctttaagttttcggtacctacgttccttaaccaaaggtaacgtaacggaacggtccggtacccgtcgaacgggtactcccgtacgtaccgtaatttcgtcggtcctacctaacgtcgtacggaaccacgacncctactccacgactactccggacggtcccggggaccccaaggacccgaacgggactacggggaacgggacgtaaccgttaacgtagttcggtaccgtaagggaccggttaagggaacgttaaaacgttacgttaaggttttacgggttaggttgggttacgggacgggtacgggaaccggtaggtccgtaccggtaccggtacccggttaggtaacccgtaccggcccggaaccgggttcccgttaccccggaccccccggtttaccggtcccttaaccccgttcccgggtttccccttaaccccccccg

SEQ ID NO: 166618 - DNA, 731 bp, Homo sapiens
  misc_feature: GYAE6OF01B9KGZ.26.71.G05.1.454.CMB.1.raw
  modified_base (337)..(337): a, c, t, g, unknown or other
  misc_feature (337)..(337): n is a, c, g, or t
tcagagactatactcacgaccggtgctcgatttagtgtcgtcgcaagagagaggggggactcctgtgccccaccatggacacgctttgctcccacgctcctgctgctgaccatcccttcatgggtcttgtcccagatcaccttgaaggatcgtggtcctgcgcgtggtggacgcccacgcacgacccctcacgcctgacctgcctccgtctcgtgactttcctccacctaccaccgacgacgtggaggtacgaagtggtccggtccggttcgggtccgtaccgaccgggacccccggaacggccgtggagtcggtcgtcgctactctacgtttacgnggtagtcgtactactacgaacgtaccgtaactacgtccgtctacgaggaacgtactaccgacctaccaacctacgtacccgaaccgaacggtaacccaccctaacccggaaacgggtaccgggttaccttacctaacgtacgtaccgacgtaactagtacgtacgttcgtaggtacgacaccggacgactaactagtacgttaactcgcctacaccacgtaccgtaccggacggtaccgtacgaacgaacgggaaaataaacgtagtaaacgtacgtaacggtttaacggggttaccgggtaaccggttaagggttaccgttttaccggaccccgttacccgttcccccaaccccgtaacccgtacccctaacccggaaacccggtaaccccgg

SEQ ID NO: 166619 - DNA, 626 bp, Homo sapiens
  misc_feature: GYAE6OF01CMMDY.26.71.G05.1.454.CMB.1.raw
  modified_base (241)..(241): a, c, t, g, unknown or other
  misc_feature (241)..(241): n is a, c, g, or t
  modified_base (391)..(391): a, c, t, g, unknown or other
  misc_feature (391)..(391): n is a, c, g, or t
  modified_base (452)..(452): a, c, t, g, unknown or other
  misc_feature (452)..(452): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggactccgtggccttcgatgagctgattcagccaccctcagtcgtccgtcgtccccaggacacgacacgcccaccactcacctgcctcggacagacaaagttggganatagaaatgctgcctggtactacgagacgccaggcctcgtccctagttttcggctacttcttacgaagataacggaacgtccggaccctacgacgggactcccgtagaaccgtatttcgtacgcttaccaacgtcgtacggaacacgacncctactctacgactagtcgacgggacccgggaccacgaccggacggagtaggaagggtaanactactagttcggtcgacgggtaggtaggaagtaagttacgttagttaggttaggttcgggttagggaccgggacgggacgtggaccgtcggtacccgtcgtacggtaccgtccggaccgacggccctccgaccccgtcgtcccgtacttcccggtcccttccccgtccctacg

SEQ ID NO: 166620 - DNA, 709 bp, Homo sapiens
  misc_feature: GYAE6OF01B896L.26.71.G05.1.454.CMB.1.raw
  modified_base (236)..(236): a, c, t, g, unknown or other
  misc_feature (236)..(236): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtcgtccgtgtccccaggacagacagccaccatcactgcctcggcagacaagtggganatagaatgctgctgtatacagagccagccacgtccccttagtttcggtactatccttaccaaagtaagtaaagaacggccggtacccctacgaacgggtacctcccgtacggtaacccgtaacgtttcgtacggtccctacctaaccgttcgtaacgggaacaccgacgtaccctacgtactacgaacctacgtaccggtaccgggcccggggtaccccaacgggaccccgaaacgggtacgtacgggaacgggtaacgtaaccttaacgttacgttacggtacgtacgggtacgggtagggaacgtaacgttaaccgttagttaggttaggttcggtttacggggaacggggtacggtaccggtacggtcgtaccggtaacccgttcgtaacggtacccgaccggtacccgacggtcccgaccggtcccccgttacgggtacccttaccgttcccgttcccggttccccccg

SEQ ID NO: 166621 - DNA, 752 bp, Homo sapiens
  misc_feature: GYAE6OF01AMGQ9.26.71.G05.1.454.CMB.1.raw
  modified_base (181)..(181): a, c, t, g, unknown or other
  misc_feature (181)..(181): n is a, c, g, or t
  modified_base (266)..(266): a, c, t, g, unknown or other
  misc_feature (266)..(266): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggctccgtggccttcgatgacgctgtatccacgcccaccctnagtcgtcccgtcgccccaggacacgacacgcccaccatccaccgtcgcgccggacaagtaactaaagttggggaacataacgaancgtactcgcgtaggtactaacgagacgaccgacgcctcgtccctttatttcgatctctacgaagatagacgccgcctgacggctcctacgtaccgtacttctacggtacctaccctaacggtccgtacgggaaccctaccaccgtacccgtaccttcgtacccgaaccgtacgtacccggacgggccccggaccgacccggtaaccgtaacgggacggtaacgggaacgggaccgtaaccttaacgttacggttaccgtacgggaccgggttcggtaaggggtaaacttaacggttaacgttaggtttaacgggttagggttttacgggtacggggaccgggtacgggaaccggtaccggtacggtacccggtaaccgttaccgggtaccggtaccgtaacccgggacccggtaccgggttccccgtacccccggttccccgttccggtaacccgttccccgttcccgtttccccggtaacccccg

SEQ ID NO: 166622 - DNA, 699 bp, Homo sapiens
  misc_feature: GYAE6OF01DJZEV.26.71.G05.1.454.CMB.1.raw
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagcccaccctcagtcgtccgtcgtcccaggacagacacgccaccatccacctcgctcgcagaactaagttgggagatagaatgctgcctggtacttaccgagacgccaggccacgttccccttagttttcggtctattccttacgaagtaagtaagaacgccggacctcgacggtactacccgtacgtaccgtaatttcgtcgtcctacctacgtacgtacggaacacgacgcctactacgtacgaccacgtcgacggcccggggacccacggaccgaacgggacgtaagggaacgggtaacgtaacgttaacgtttaacgttcggtacgacgggtacgggtagggaacttaaccgtttaagttaagtttggttaaggtttggtttacggggacgggtacgggtaaccgacgggtaccgttaccggaccggttaccggtacggtaccgtaaccggcccggtaacggtcccctaccccggttcccccggtacgttccccgttaccgttccctttcccgtcccccgttcccgttacccg

SEQ ID NO: 166623 - DNA, 964 bp, Homo sapiens
  misc_feature: GYAE6OF01BDDIZ.26.71.G05.1.454.CMB.1.raw
  modified_base (138)..(138): a, c, t, g, unknown or other
  misc_feature (138)..(138): n is a, c, g, or t
tcagagactatactcacgaccggtgctcgatttagtgtcgtcgcaagagagagggggcctcaggaagcagcatcggaggtgcctcagccagtggcatggactccctctcttcctcggcgtccttgcttactgcacagntccgtcgtccttcgagtgacgtcgtagtacgttcaacgccccacccgtcgaggtccgttcccgttcgacccccgagggaccacgaccacgacccaccgaacttccgaccctggcccgtacggacaacggtaacgtaaaggttcgggaagtaagtaaggaaacgttcgtccgtcgtaccgttacggtaacgttaccggaaggtaccgaccggtaacggccccgttaaccggttaccccttttaaggtttacggtccttaccttaaccgttaaccgtaaaggtaaacctaaccggaaccggtcccggtaccccgttaaggaacccggggttaccttaccccggtaaccggttaaccgttaccgttttacccggtaccgtacccgttaacccgtaaccgtttacgggtaaaccccgggaaaccgtaacccgtaacccgggtacctaaacccggttccgtaaaccggtacccggttaaaccgttacccgggggtaacccgggtaccccccggggacccccgtaaaccggttaacccccgggaaacggggttaaccggtaaaccgggggtaacggtaaacccggtttaacccggttacgtttaaaccgggtttccgggaacggtaaccggggtacgggttaacgggtaaacgttaaccgtttaacggttaggtttaggttacgggttagggttaccgggggaacgttaccggggtacgagggttacccgtacggtaccgtaccgtaaacgtccggaccgtacccggacgtccggtaccccgtccggacccgttagtccccgttaccgtcccgttcccgaacccttacccgg

SEQ ID NO: 166624 - DNA, 762 bp, Homo sapiens
  misc_feature: GYAE6OF01BBODS.26.71.G05.1.454.CMB.1.raw
  modified_base (177)..(177): a, c, t, g, unknown or other
  misc_feature (177)..(177): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctnagtcgtccgtcgtccccaggacagacacgccaccatcacctgctcggcagactaaagttgggatataagaaatgactgccgtaggtacttaccaggacggccgaggcccctacgttccccttagttttcggcctattccgtttaccaaggtaactaaacggtacggccggtacccctacggacgggtacctaccccgtaggtaacccggttaatttccgtacgggtaccttaacccgaaccgttaccggtacgggaaacctaaccgaaccgacccgtaaccgtccgtaacgtacccctacgttcccgaacgggtccccggggaaccccaaccgggacccggaaacgggtacgtaggggaaccggtacgtaaccgttacgttacgttacgccggtaacgggtcggtaagggaactaaacggttacttaaggtttaggtagggtttacgggtttacggacggggtaacggcccgggagggtccgttaccgggacccgttaccggtcgggttaccacggtacccggacggtccctcccggtacccccgttccgggtacctaccccgttccggttccgtttaccccccg

SEQ ID NO: 166625 - DNA, 689 bp, Homo sapiens
  misc_feature: GYAE6OF01DCIJ6.26.71.G05.1.454.CMB.1.raw
  modified_base (178)..(178): a, c, t, g, unknown or other
  misc_feature (178)..(178): n is a, c, g, or t
  modified_base (241)..(241): a, c, t, g, unknown or other
  misc_feature (241)..(241): n is a, c, g, or t
  modified_base (250)..(250): a, c, t, g, unknown or other
  misc_feature (250)..(250): n is a, c, g, or t
  modified_base (252)..(253): a, c, t, g, unknown or other
  misc_feature (252)..(253): n is a, c, g, or t
  modified_base (267)..(267): a, c, t, g, unknown or other
  misc_feature (267)..(267): n is a, c, g, or t
  modified_base (464)..(464): a, c, t, g, unknown or other
  misc_feature (464)..(464): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggattccgtggccttcgatgagctgattcagccaccctnagtcgtccgtcgtccccgaggacagacacgccaccatccgacctgctcgcagacaagtggganataagaatncnncgtgtactacaggngccgagccacgttcccgttatttcgactactctaccaagtagaagaacgcgtaccgtcgaacggctccgtacgtaccgttaatttcgcggtacctaccgtaaccgttcgtaacgggtaaccaccacgtaccctacgtaccgtaccgtaacctacgtacccgacgggccccggggaccccaacggacccgtaaacggnggtaacgggccggttaacgtaaccgttacgtaagttcggtacggtacgggtaacgggtagggaattaacgtacggtttagttacgggttaacggttggggttaccgggtggggtaaccgggcgtaacgggtccgtcgggtacccggtacggtacggtacgaccggtaccggacgtcccgtcccgtccccggtacggtccctaaccgtccgttcccgttaaccccg

SEQ ID NO: 166626 - DNA, 806 bp, Homo sapiens
  misc_feature: GYAE6OF01AWDGC.26.71.G05.1.454.CMB.1.raw
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtcgtccgtgtccccaggacagacacgccaccatcacctgctcgcagacaagttgggagatagaatgctgcctggtacttaccgagacggccaggcctacgtccccttagtttggtctacttcttaccaagaataaggaacgtccggaccctacgacgggtactccccgtagacccgtaactttcgtcggtcctaccgaaccgttcgtacgggaaccaaccgacgaccctaccttactaccgaaccctacgtaccggacgggccccgggggtacccccaacggggacccccgtaaacggggaacgtaaccggggtaacgggaaaccggtaaccttaaccggtttacgtttacgggtaccgtaacgggggtaccgggttaagggtaaacggttaaacgttaacgggttttaaccgtttaaggtttaagggtttcgggtttacggggtaccggggtaacggggtaacccgggagggtcccggttaccgggtaacccggttcccggttaacgggtacccgtaccgggtaaccccggaaccgggttcccgttaccccggtacccccccggttccgggttaccccttacccccggtttcccgttccccggtttcccccccgtccccggtttacccccg

SEQ ID NO: 166627 - DNA, 654 bp, Homo sapiens
  misc_feature: GYAE6OF01ELPU0.26.71.G05.1.454.CMB.1.raw
  modified_base (223)..(223): a, c, t, g, unknown or other
  misc_feature (223)..(223): n is a, c, g, or t
  modified_base (482)..(482): a, c, t, g, unknown or other
  misc_feature (482)..(482): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggtccttcgatgagctgattcacgcccacctcagtcgtccgtcgtccccaggacagacagcccaccactcaccgtnccgtcggacagaactaagttgggaatagtagaatgactcgctagtactacgagcgccaggccctacgttcccctttagtttcggactattcctaccgaagtataacgacggcccgtccgacgacgggtctcccggagtaacccgttagtttccgacgtacccttacctaacgttcggtaaccggtaacacgtacccgtaccacgtttaccacgaaccgtacgtacgaccgggcccggacccacggacccgaaggtacgngggaacggactactacgttatggtacggaggtcgaggtaagtaagtttaagtcgttacgtaggtttacggttcgggacggtacggccgtaggccgtacggacgtcgtacgacgacccggcgtaccggcctccccggtacccctggttaccacccgttcgttcccctaccccg

SEQ ID NO: 166628 - DNA, 732 bp, Homo sapiens
  misc_feature: GYAE6OF01BLVO6.26.71.G05.1.454.CMB.1.raw
tcagagactatactcacgaccggtgctcgatttagtgtcgtcgcaagagagagggggctgggcctcaggaagcagcatcggaggtgcctcagccatggcatggatcctctctcctcggctccttgcttactgacacgacggactccggtggtcccttgatggacgtcgtagtacttccacgcccctaccctcaggtcggtacccgttcggaccccaaggacctacgaccacgcccaacgtactaccacccgtagccgtacgggactaaacggaactaaggttaggaagtaactaaagtaagtcgcgtacgtcgttaagtaaccgtaacgaggtacgacccgaaggtcctaccgttaccttagtttcgactactctaacaacgtaagtaacgacgtccgtactacggacggtactacccgtagaaccgttagttccgtagaccctacgaacgttacgacggaaacacgaacggtccctaagtcaacggtacgtaacgcggacccggacgggtaccgacgacgaacggtaacgaggaacggtaactaacgtagtacgtttgacggtaggacggtaggtaacttaacgtaatttacggttattaggggttacgttacgggacgggtacggtacggaggtaccggtacgtaacgttcggaaccggtcgaaccggtacccgacgtacccggttcccgtacccgttacccgaccgtaccgtcgttcccggtaaccccc

SEQ ID NO: 166629 - DNA, 752 bp, Homo sapiens
  misc_feature: GYAE6OF01B2ZHI.26.71.G05.1.454.CMB.1.raw
  modified_base (237)..(237): a, c, t, g, unknown or other
  misc_feature (237)..(237): n is a, c, g, or t
  modified_base (376)..(376): a, c, t, g, unknown or other
  misc_feature (376)..(376): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtcccccaggacagacagccaccatccaccgtgctcggcagacaaattggganatagaaatgctgccgtgtacttaccgagacggccaggccctacggttccccttagttttcggctacttccgttaaccaaggaataaggaacgccggcccctacgtaacgggcctacccgtcggaacccgtagtttccgnggtccctaaccgtaacttccggtacgggaaaccaccgacgtaccccaacttccgtaccgaacctacgtaccgacgggaccccgggggaccccaacgggaccccgaaacgggacgtacggggaacggggtaacgtaaccttaacgttcgtttacgggtaccgaggggtaccggtagggtaaacgtaacgttacgtttaaggtttaggttacggtttcgggttttaggggacggggtaacgggtaccggtacggtaccgtacgggtaacccgttccgtaacggggtaccaccgggtaccccgaacgggtcccctaccggtccccccgttacgggtaccctaccccgttccgttaccccgttccccgtaccccgtaccg

SEQ ID NO: 166630 - DNA, 730 bp, Homo sapiens
  misc_feature: GYAE6OF01CC613.26.71.G05.1.454.CMB.1.raw
  modified_base (197)..(197): a, c, t, g, unknown or other
  misc_feature (197)..(197): n is a, c, g, or t
  modified_base (289)..(289): a, c, t, g, unknown or other
  misc_feature (289)..(289): n is a, c, g, or t
  modified_base (706)..(706): a, c, t, g, unknown or other
  misc_feature (706)..(706): n is a, c, g, or t
tcagagactatactcacgaccggtgctcgatttagtgtcgtcgcaagagagagggggctgggcctcaggaagcagcatcggaggtgcctcagccatggcatggatccctctcttcctcggctcttgcttactcgcacgaggacttccggtggtccctttggattggtaagtttgactttacgaccgacccacccttntaagttccgtccgtccgtaccccaggaacaaggacaccgaccaacctagtccaccttggacgtaccggcaaagaacgtaaaggttgggaaanagtaaagtaaatgctgacgttaggtaacttacgaggacgctacggacctacgtcccttagtttcgactactctacaagagtaagacggtccgaccgtacgacggtactaccgtacggtaaaccgttactttcgtacgacctacctaaacgtcgtaacggaaaccacaaccgtacctaacaacgtacccggactaacggtaccgaaccggcccgggacccctaaacggaccgaaaccggagtaagggaacggtaacggttaacctaacgtttaacgtgtaacggaacgggtagtaggggtaactaagttaaccgttaggtacggtttaggttacggtttgggaacgggtaacgtacggagtccggtacgaccgttagacgtcgaacgcccgtaggacctcccggacccttcggtaacnccgttcgttccgacccccgtaccg

SEQ ID NO: 166631 - DNA, 708 bp, Homo sapiens
  misc_feature: GYAE6OF01ACVYS.26.71.G05.1.454.CMB.1.raw
  modified_base (138)..(138): a, c, t, g, unknown or other
  misc_feature (138)..(138): n is a, c, g, or t
  modified_base (234)..(234): a, c, t, g, unknown or other
  misc_feature (234)..(234): n is a, c, g, or t
tcagagactatactcacgaccggtgctcgatttagtgtcgtcgcaagagagaggggctgggcctcaggaagcagcatcggaggtgcctcagccatggcatggatccctctcttcctcggcgtccttgcttactgcacnggatccgtgccttcgatgagctgattcagcccacctcagtcgtccgtgtccccaggacagacagccaccatcacctgctcgacagacaagttgganatagaaatgactgccttggtacttaccagacggccagggccctacgttcccccttaagtttttcggtacctacgttcctttacccgaaagtactaaacggaacgccggaccccttagacgggtactcccgtggaaacccgtaacttttccgtcggtcctaccgaaccgtccggtagggaaccacgacgtcccacgtcgttcgaacctgtccgacgggcccgggccccaacggccccgaaacgggtcgtacgggaaggaccgttaaccttacgagtttacggtcgacgggtccggttagggaaacgtacgtaacgttagtttacgggttaggttcggtttgggacccgggaggtaccccgagggtccgtaccggtacccgtaccggttacgggaccgaaccggtccccgaaacgggtccccttacccggtccccctacggttaccccacctttcccggtccgttaccccccccgg

SEQ ID NO: 166632 - DNA, 661 bp, Homo sapiens
  misc_feature: GYAE6OF01B4KWH.26.71.G05.1.454.CMB.1.raw
  modified_base (227)..(227): a, c, t, g, unknown or other
  misc_feature (227)..(227): n is a, c, g, or t
  modified_base (324)..(324): a, c, t, g, unknown or other
  misc_feature (324)..(324): n is a, c, g, or t
  modified_base (363)..(363): a, c, t, g, unknown or other
  misc_feature (363)..(363): n is a, c, g, or t
  modified_base (556)..(556): a, c, t, g, unknown or other
  misc_feature (556)..(556): n is a, c, g, or t
tcagagactatactcacgaccggtgctcgatttagtgtcgtcgcaagagagaggggggactcctgtcgccccaccatggacacgctttgctccacgctcctgctgctgaccatcccttcatgggtcttgtcccagactcaccttggaaggagtctggtcctgcgcgtgggtcgacgcccacgcacgaccctcacgctcgacctcgcgttccgtctcgtggactttcncaactcaccacgacgtgacggtgattggtcggccgtcggtccgtcgaccggaccccggaagccgtaggagtcgtcgtcgcctcgtactactttacgnggtagtgctcgtaacgaacgtcggtaactactcccgttntaccgtagaacggtactccgtactccaactactaccgaacgtaacggacctacctaaccggtaacggaccgggttacgtaaccctttaacgaacgtaccgaacccgataacgtacgtaactccgttagacggactacggacggtacaataacgttacttacgtgtgaccacacgtccgtacgtacgccgtaanacggtaaccgaaagaaaacgtagtacgagtaccgtagggtacggtacgtaggtttacgttccgtaacgtccctaccgtacccagtcccaaccgtacggtacccgg

SEQ ID NO: 166633 - DNA, 870 bp, Homo sapiens
  misc_feature: GYAE6OF01DAYDD.26.71.G05.1.454.CMB.1.raw
  modified_base (247)..(247): a, c, t, g, unknown or other
  misc_feature (247)..(247): n is a, c, g, or t
tcagagactatactcacgaccggtgctcgatttagtgtcgtcgcaagagagagggggcctcaggaagcagcatcggaggtgcctcagccatggcatggatccctctcttccctcggcgtccttgcttactgcacaggactccgtggccttcgatgagctgattcagcccaccctcagtcgtcccgtcgtccccaggacagacacgccaccatccaccgtgccgtcggcaagaactaaagttgggganataagaatgctcgctaggtacttacgaggacgccgacggcctacgttccccttagttttcggtcctacttccgttaaccaaagtaagtaacggaacggtcccggtaccctacggacgggtacctacccgtacggtaacgttacgtttcgtaccggtccttaaccaaccgttcggtaacggaaccaccgtaaccggccctaacctaccgtaccgaacctacggtaccggaaccggggtccccgggacccaaccgggtaccgaaacgggtacggtagggaacgggtaaccgtaccgttaacgttacggttacgggtacggtagggtaccggggttaagggtaaacgttaacgtttaacggtttacgggttagggttttaacgggtttcgggggtttacggggggaaccgggtaacggggtaacccggtacggggtacccggttaacccgggtaaccccgggttacccgggttaccgggtaaccccggtacccgggtaaacccgggacccggttcccccggttaacccccgggttccccccggttaccggttacccccggttaccccggtttcccccggttttaaccccccgggttccccccggttccccgtttaaaccccccggg

SEQ ID NO: 166634 - DNA, 723 bp, Homo sapiens
  misc_feature: GYAE6OF01A7N6F.26.71.G05.1.454.CMB.1.raw
  modified_base (233)..(233): a, c, t, g, unknown or other
  misc_feature (233)..(233): n is a, c, g, or t
  modified_base (408)..(408): a, c, t, g, unknown or other
  misc_feature (408)..(408): n is a, c, g, or t
tcagagactatactcacgaccggtgctcgatttagtgtcgtcgcaagagagagggggcctcaggaagcagcatcggaggtgcctcagccatggcatggactccctctcttcctcggcgtccttgcttactgcacaggatccgtggccttcgatgagctgattcagcccaccctcagtcgtccgtcgtccccaggacagaccgccaccatcactgctcggcagacaagtggganataagaatgctgccttaggtactaccgaggacgccaggcctaaccggttccccttagttttcggacctacgtccttaccgaaagtaagtaacgacgccggacctacgacggtacctccgtacgacgtattcacggtctaccactcgtaggaaccacgtcgactactctacgaccngtacgacggccgggtacccacgaccgaacggagtacggaacggtacaacgttactagttcgtaccggaggtacggtaaggaacgttaatacgttaagtttggtttacggtacgggttttcgggaacgggtaaccggggactacggggtacgtaccggtaaacccgggttcgttaaccgggtaccgtaaaccgggtccccggtaaacgggttccccgttaccccgggtaccccccggttaccggttaccccgttaccccggtttaccccgtttaccccgggtttaccccccctaccggttttcccccgtaacccgg

SEQ ID NO: 166635 - DNA, 734 bp, Homo sapiens
  misc_feature: GYAE6OF01BWP6O.26.71.G05.1.454.CMB.1.raw
  modified_base (187)..(187): a, c, t, g, unknown or other
  misc_feature (187)..(187): n is a, c, g, or t
tcagagactatactcacgaccggtgctcgatttagtgtcgtcgcaagagagaggggggactcctgtgccccaccatggacacgctttgctccacgctcctgctgctgaccatcccttcatgggtcttgtcccagatcaccttgaaggagtctggtcctgcgctggtggacgcccacgcagacccctnacgctgacctgcctccgtctctggattctcactcaccacgactggaggtgagtggtcggccgtcgggtccgtccgaccgggacccccggaaaggccccgtgggacggtggtcttcgacctacgtctagtttaccgtgggtagtacgatctacgtaacggaccggtaactaacgttccgtctcgttaggaacggtaactaccggacctaccgaaccctactaccgaacccggaccgggtaacccaaccccgtaacccggaaaacgggtaccccgggggttacggttaaccccttaaccgtaaacgtaccggaaccccgtaacgtaacgttacgtaaaaccgtttcccggtacggtacgggaaccgtaacgaaccgggtaccaaacgttaacttaacgtttacgtcgtacgtacaaccgaccgtacgttccgtaacggccggtacgtacggacgaaacgaaagtagtatacgacgttaggtcgggtacgtagggttactttcggacccgtaccgtccctacccgacctccctaccgaccggtaacccgg

SEQ ID NO: 166636 - DNA, 699 bp, Homo sapiens
  misc_feature: GYAE6OF01AWHMT.26.71.G05.1.454.CMB.1.raw
  modified_base (179)..(179): a, c, t, g, unknown or other
  misc_feature (179)..(179): n is a, c, g, or t
  modified_base (242)..(242): a, c, t, g, unknown or other
  misc_feature (242)..(242): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggcccttcgatgagctgattcagcccaccctnagtcgtcccgtgtccccaggacagacagccaccatcacctgcctcggcagacaaagttggaanatagaaatgactcgcctggtacttaccgaggacggcccaggcccacggtcccccttagtttcggtaccattcttaccaagtactaaagtaacgccggtcccctacgacgggtactacccgtcgaaccgtaactttcgtcggacctaccgtaactcgtacggaaccacgacgacccacctctaccgacacgtacgacggcccggggacccacgtacccgaacgtagtaggaacgggtacacgttaacgacgttggacccggaggtacggagggtaaacgtaaactttacgttaagttaggttacggttacggttttgggaccgggttacgggacggtaaccgggtccgtaccgggtaacccgttacccggtaacggtacccgacggtccccgaacggtcccgttccccggacccccgttcggtaccccgtaaccgttcccgttcccgttacccccccg

SEQ ID NO: 166637 - DNA, 740 bp, Homo sapiens
  misc_feature: GYAE6OF01B4AMS.26.71.G05.1.454.CMB.1.raw
  modified_base (177)..(177): a, c, t, g, unknown or other
  misc_feature (177)..(177): n is a, c, g, or t
  modified_base (241)..(241): a, c, t, g, unknown or other
  misc_feature (241)..(241): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctnagtcgtccgtcgtccccaggacagacacgccaccatccacctgcctcggcagacaagttggganaatagaatgctcgccttaggtataccgagacgccgaggcctacgttcccctttagttttcggtctacttaccttaccgaaagtaacgtaaacggaaccgggtcccgtaccccgtaggacgggtaaccttccccgtacggtaaccctttaacgtttccgtcgggtacccttacccgtaacgttacgtaacggggaaccaccgaacgcccctaacgtccgttaacgaccctaagtcccgacgggccccggggacccaacggacccgaacggaggacgggacgggactaacttacgtagttccggcgtacgggcggtaagggtaataacgttacgttaggtttacgggtttagggttcgggtttaccgggacggggtacggacccgtagggtccgtaccgtacccgggttacgtacggtacccgaccggttacccggacgggtccccgttaccccggtaccccggttacggacccttcccggttaccgtcccgttacccccc

SEQ ID NO: 166638 - DNA, 656 bp, Homo sapiens
  misc_feature: GYAE6OF01C0UMJ.26.71.G05.1.454.CMB.1.raw
  modified_base (237)..(237): a, c, t, g, unknown or other
  misc_feature (237)..(237): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactggcacaggatccgtggccttcgatgagctgattcagccaccctcagtgtccgtgtccccaggacagaccagccaccatccacctgctcggcagacaaagttgggantagaaatgctgcctggtattaccagacggccaggccagtcccctagtttcggcatcttccaagataagagcggcctacgaggactcctgaccgtaatttctaggcctccactctagggaacctcacgcccacgtctacgacccaatcgaaggcccggggacccaacgaccccgaacggagtacggacgggaagaccttaactagtttacggtcgagggtaccggtagggaactaagttaccgttaattagggtttacggttaggtttacgggcgggtaacggggtaccaagggtccgtacggtacccggtaccgtacgggttaccgaaccggtcccggaaacgggtcccgttacccgggacccccccgttggggtaccccaccgttccgttccccggttcccccggtccccttaccccg

SEQ ID NO: 166639 - DNA, 803 bp, Homo sapiens
  misc_feature: GYAE6OF01DW82A.26.71.G05.1.454.CMB.1.raw
  modified_base (109)..(109): a, c, t, g, unknown or other
  misc_feature (109)..(109): n is a, c, g, or t
  modified_base (175)..(175): a, c, t, g, unknown or other
  misc_feature (175)..(175): n is a, c, g, or t
  modified_base (180)..(180): a, c, t, g, unknown or other
  misc_feature (180)..(180): n is a, c, g, or t
  modified_base (218)..(218): a, c, t, g, unknown or other
  misc_feature (218)..(218): n is a, c, g, or t
  modified_base (259)..(259): a, c, t, g, unknown or other
  misc_feature (259)..(259): n is a, c, g, or t
  modified_base (589)..(589): a, c, t, g, unknown or other
  misc_feature (589)..(589): n is a, c, g, or t
  modified_base (628)..(628): a, c, t, g, unknown or other
  misc_feature (628)..(628): n is a, c, g, or t
tcagagactatactcacgaccggtgctcgatttagtgtcgtcgcaagagagaggggctgggcctcaggaagcagcatcggaggtgcctcagccatggcatggatccctntcttcctcgcgtccttgcttactgcacaggactccggtggtccttcgatgagctgtattcagcccnccctnagtcgtccgtgtccccaggacagtacaacgcccaaccntaccacctcgccgtcggacctaagaacctaaaggtgggaanagtaacgtaaatgcttagccgttacggttaataaccgagaccggccaacgggccctaacggtttcccctttaagttttcggacctagtttaccgttaaccgaagtaaactaacggtaaaccggtcccggtaaccccttacggtaaccgggttacctaccccggttacgtaaacccgtttacgttttaccggacccggttacccttaaccccgtaaaccgtttaacggtccgggaaaaacccaccgtacggacccctaaccgtttccacgaaacccgtacgtaccggacccggggacccgggccccgtaaacgacccggaaaacgggttanaccgggggtaacggtaactaattaccgttgtcggtacgngggtacggttagaacttaaacgttattgtttacggtaggttcggtttagggaccggtacgggaacgttccgagtttacccggaccggtttcgtaacgggttaccacccggtaccggtacgtacccggtcccctaccccggtacgtaccttaccttccccgtttacgtaccccccg

SEQ ID NO: 166640 - DNA, 1045 bp, Homo sapiens
  misc_feature: GYAE6OF01C10WS.26.71.G05.1.454.CMB.1.raw
  modified_base (1028)..(1028): a, c, t, g, unknown or other
  misc_feature (1028)..(1028): n is a, c, g, or t
tcagagactatactcacgaccggtgctcgatttagtgtcgtcgcaagagagagggtccatgccatggcatggatccctctcttcctcggcgtccttgcttactgcacaggatccgtggccttcgatgagctgattcagccacctcagtcgtccgtcgtcccgaggacagacacgccaaccatccacctgctcggacagacaagtggagagtagaatgacgcgtcgtaggtacttaccgaggacggaccgacggccgtaacgttccccgttaagttttcgggtaccttaactttcccgtttaacgaaaacggtaacttaaaacgggaaccggtcccgggtaccccgtttaacggaacggggttaacctttacccccggtacggttaaacccggttaacgttttccggtacggtaccccttaacccgttaaacgttccggttaacggggaaaacccaccgtaaccggtaccctaaaccggttttacccgaaaccggtaacccgttaacgttaacccgggtacccgggggtaaccccgggggtaccccgaaacccggggtaaccccgggtaaaaccgggtaaccggtttaacggggggaaaacggggtaacccgtttaaacccggtttaaccgttttaacggtttccgggggtttaaaccccgaagggggggttacccgggtttaaacggggaaaaccggtttaaaacgtttaccggttttaaaggtttacggggttttaaggggttttccggggttttaaccgggggaccgggggtaaaccggggttaacccggtaacgggttaacccggggttaccccggttaaaccccggggttttaacccgggtaaccgggtttaaccccgggaacgggttaaaacccccgggttacgggttacccctaccccccggggttccccgtaacgggtttacccctaccccgggttaccctttccccggttaaccccccgtccccgttaacttacccggacggtttacttaccgggttactacccgggtaggtaccccggnggttcccgggtaaacgg

SEQ ID NO: 166641 - DNA, 686 bp, Homo sapiens
  misc_feature: GYAE6OF01B0Z9W.26.71.G05.1.454.CMB.1.raw
  modified_base (152)..(152): a, c, t, g, unknown or other
  misc_feature (152)..(152): n is a, c, g, or t
  modified_base (234)..(234): a, c, t, g, unknown or other
  misc_feature (234)..(234): n is a, c, g, or t
  modified_base (349)..(349): a, c, t, g, unknown or other
  misc_feature (349)..(349): n is a, c, g, or t
  modified_base (404)..(404): a, c, t, g, unknown or other
  misc_feature (404)..(404): n is a, c, g, or t
  modified_base (472)..(472): a, c, t, g, unknown or other
  misc_feature (472)..(472): n is a, c, g, or t
tcagagactatactcacgaccggtgctcgatttagtgtcgtcgcaagagagaggggggactcctgtcgccccacatggacacgtctttgctccacgctcctgctgctgaccatcccttcagtgggtcttcgtccagactctacttgaaggtntcgtggtcctgcgtcgtgggtacgacgcccacgcaccgtaccctcgacgtctcgacctcgccttccgtctcgtgtacttccnccacgtaccaccgaacgtactaggaggtacgtacgtcggtcggtccgtcggtaccgaccggaaccgggacccggaacgtccgagggtcgtcgtctcgctacgtcgtaatttcggnggtagtcgtactacgacggacgtacgtactacgtccgtagtacgtagaacgtacncgtaacctacaactactacgaaaccgaacggacctaaccgaacggtaacgggtccggtactacctaanacgtacgaaccgtagtactacgtacgtcgtaggtaacgacaccggagtactacgtaattaacttgtctacgacaacgtacgtactacgtaccggacgtacgtaacgaacgaaagaacgttaatacgtaacgtaacggtacggtacggggaacgttaggttaaccgtcgtaaccgccgttacccgaccaaccgtcccgtaaaccgccggtaaccg

SEQ ID NO: 166642 - DNA, 674 bp, Homo sapiens
  misc_feature: GYAE6OF01AZKBE.26.71.G05.1.454.CMB.1.raw
  modified_base (236)..(236): a, c, t, g, unknown or other
  misc_feature (236)..(236): n is a, c, g, or t
  modified_base (301)..(301): a, c, t, g, unknown or other
  misc_feature (301)..(301): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccacatcacctgctcggcagacaaagttggganatagaaatgctgcctggtattaccagaggccaggccagtccccttatttggtcatcttcaagtanaagagcggccctcagggactccctgaccgtaattcgtcgactccaactctacgggaacctacacgaccactcctacgacctactcaacgggccgggggacccccgtacggaaccccgaaccgggacgtacgggtaacggggaacggtaaccgttacgttaacgttggtaccgtacggggacgttaggggacgtaaagttaacccgttagtttacggttaggtttaggtttagggcggggtaacggggtaccgagggtcgttaccggtaccggttaccgtcggtacccgtacggaaccccgtaacgggtcccgtacccggtccccccgttaccgggttacccgaccgtttacccgtcccggtttacccccccgg

SEQ ID NO: 166643 - DNA, 764 bp, Homo sapiens
  misc_feature: GYAE6OF01BMY94.26.71.G05.1.454.CMB.1.raw
  modified_base (243)..(243): a, c, t, g, unknown or other
  misc_feature (243)..(243): n is a, c, g, or t
tcagagactatactcacgaccggtgctcgatttagtgtcgtcgcaagagagagggggcttggcctcaggaagcagcatcggaggtgcctcagccatggcatggatccctctctcctcggcgtccttgcttactgcacaggatccgtggccttgatgagctgattcagcccaccctgagtcgtcccgtcgtccccgaggacagacacgcccacactcacctgcctcggcagaacaagttggganatagaatgctgctgtactacagacggcacggcctacgttccccgtttagttttcggtctacttccgttaccaaagtaactaaacggacgcccgggtacccctaggaacgggtacctacccgtaggtaacccgtaagttttccgaggtaccctacctaaaccgtcggttacgggaactaaccgacgtaccctaacgttccgtacgaccctacgtaccggaccggggccccggggtaccccacgggaaccccggtaaacgggtaggtacggggaaacggggtaccttaaccggtttaacgttacggttacggtaccgggtacgggtacggggtaagggtaagtaaaccgtttagttacggtttagggtttaccgggttgggtttaccggggacgggtaccgggacggtacgggtcccgtagggtaaccccgttcggtaccgggttaccacccggtacccggtaaccggcccgttccccggtccccgttcggaccctttcccgtccgttccccgttaccccccc

SEQ ID NO: 166644 - DNA, 1023 bp, Homo sapiens
  misc_feature: GYAE6OF01BDJ0C.26.71.G05.1.454.CMB.1.raw
  modified_base (255)..(255): a, c, t, g, unknown or other
  misc_feature (255)..(255): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggcttcgatgagctgattcagccaaccctcagtcgtccgtcgtaccccaggaccagaccagacccaacactccaacctgcctcggaccaaggaacctaaagttggggaanaagtaacgaaaattcggaccttggtacccttagggtaacttaacccgaacggtaacggacccgaagggtaccccttaaccgggttccccctttaagtttttcgggtacttacctttaccggttaacccgaaaggtaagttaaacggaaacggtccccggggtcccctaacggaaccgggtacccttaccccgttaggtaaaccccggttaaacgttttccgtaccgggtaacccttaaccccgtaaaccgtttaccggttaaccgggggaaacaaacccgtaccgtaccccgtaccctttaaccgaccggtaaaacccgaacgttaacccggaaccggggtaccccgggggtaaccccccgtaaacggtaaacccccgggaaaccgggtaaaggtaaccgggtaaaacgggggtaaacgttaaacccgtttaaacgttttaaccggtttaccggggtaacgtaacggggtaccgggtttaaaaggggaaagttaaaacccggtttaagtttaaccggttttaggtttaacgggggttacgttttaaccgggggggtaccggtaaaacggggtaacccgtacgggtaaaccgttaaccgggtaccccgtttaaacccgggtaaggtttaacccggaccccggttaaccccgggtaaacccgggttccccggtaaccccggttaccccccccggggtaagtttaccccccggttaccgttaaccccggtttacccccggtttaaccccccacccggttttaaaccccccg

SEQ ID NO: 166645 - DNA, 704 bp, Homo sapiens
  misc_feature: GYAE6OF01DQD9E.26.71.G05.1.454.CMB.1.raw
  modified_base (402)..(402): a, c, t, g, unknown or other
  misc_feature (402)..(402): n is a, c, g, or t
  modified_base (506)..(506): a, c, t, g, unknown or other
  misc_feature (506)..(506): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgacacaggtatccgtggccttacgatgagctgtattcagcccacctcagtcgtccgtcgtccccgaggacacgacacgcctaccatccactgcctacggacagtacaaaggttggactaagtaagaatcgctacgcgtaacggtataccgaggtacgcgacgtcctacgtaccctttagtttcggactactcgtaccaaggtagaacgaacgtccgcctagacggcctaccgtgaccttattcgtgccctacgtactcgtacgaaccngacccacctataccgtacgacctacgtaccggcggaccggtacccgaacgaccgtaacggtagtaacgggaacgggacgttaactacgttacgtcgtaaccggngggtaccggtaagggtacgttaaaacttcggttaagtttagggtaggttttgggtaacgggtcgggtaacggtaccggtacggtacggtacccggtacgttacccggtaaggtacccgtaacggtcccggtaacgccccggttacccgggtaccccgttacgttccctaacccggttcccgttcccggttaacccccg

SEQ ID NO: 166646 - DNA, 833 bp, Homo sapiens
  misc_feature: GYAE6OF01E252H.26.71.G05.1.454.CMB.1.raw
  modified_base (161)..(161): a, c, t, g, unknown or other
  misc_feature (161)..(161): n is a, c, g, or t
  modified_base (170)..(170): a, c, t, g, unknown or other
  misc_feature (170)..(170): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggactccgtggccttcgatganctgacttcncgcccacctcacgtcgtccgtcgtaccccaggacagacacgccaccactccacctcgctccggacacgtaacgtaagttggggaacgtaataacgaaatcgacgtcgtccgttaaggttacttaccgacggtacggacccgtacggacccttaaccgtttccccgttaaggtttttcggaccttactccgtttaccgaaagtagtaaacgacggtcccgtacccgtacgaacgggttactaccccgtaggaaacccgttaagtttccgtcggtacccttacccgtaaccgttccgtaacggggaaaccaccgtaccgtcctaacgttccgaaccgtaaccgtcgttaacccggcccggggtaaccccgggaccccgaacgggtaccccggaaaacgggtaccggtaggggaaaccggtaacgttaaccgtaacggtttacgttaccggacggttacgggggttacggaacggtaaacgttacgtttaacgttacggtttagggttaacggggtttcggtacgggggtaccgaaccgggggtccgtaacgggtccccggtaaagttaccccggttggtaaccggtaccggacccggtaccggtacccggtacccgtcccccgtaccgtacggtacccttccgttccccgttcccggttcccccg

SEQ ID NO: 166647 - DNA, 734 bp, Homo sapiens
  misc_feature: GYAE6OF01BG8K7.26.71.G05.1.454.CMB.1.raw
  modified_base (279)..(279): a, c, t, g, unknown or other
  misc_feature (279)..(279): n is a, c, g, or t
tcagagactatactcacgaccggtgctcgatttagtgtcgtcgcaagagagagggggctgggcctcaggaagcagcatcggaggtgcctcagccatggcatggactccccttctccttcctcggccttccttgccttactgacacaggacttccgtggtccttgatgagctgatcacgccaccctgacgtgtaccgtcgtaccccgagacagaccagcccaacaactccacctgctccggacaagaacgaaagtttagggggaataaagtaagtaaaancgtaccgtacgtaccgtaggttaactttaaaccgaggaaccggacccgaacggtcccgtaaccgtttacccctttacgtttttaggtaccgtaactttcccttaaccggaaaagtaaccgttaaacgggaaacgccgggtaacccctacgaacgggtaccgtcccctaaggacccgtaattttcgccgtaaccgtacccgtaaagttaccggacggaacctaaccggacacccgtaacttcgaccgtaacacgtaccgaccgtccgggaccgacgacccgaaacggagtacggaacggacgtaacgtacgttacgttacgtacggacggtagtacggtaagtaacgttaacgtatggttacgtgttacggacggtaggccgagtacgtcgtaccgtacgtacgacgacggacgacgtccgcccgtacccgtgtacccactccgttcccgtacccg

SEQ ID NO: 166648 - DNA, 714 bp, Homo sapiens
  misc_feature: GYAE6OF01ECHUH.26.71.G05.1.454.CMB.1.raw
  modified_base (190)..(190): a, c, t, g, unknown or other
  misc_feature (190)..(190): n is a, c, g, or t
  modified_base (405)..(405): a, c, t, g, unknown or other
  misc_feature (405)..(405): n is a, c, g, or t
  modified_base (692)..(692): a, c, t, g, unknown or other
  misc_feature (692)..(692): n is a, c, g, or t
tcagagactatactcacgaccggtgctcgatttagtgtcgtcgcaagagagagggggctgggcctcaggaagcagcatcggaggtgcctcagccatggcatggactccctctcttccgtcggcttccttgctttactggaccacgaggattccggtggtccttcgatgagctgtattcgacgcccacctnagttcgtccgtcgtcccaggacagaccacgaccactactccacctgcgtcggacagaactaagtggaatataagaatgctcgtacgttacgtactacggaggtacggccgacggtccctaccggttccctttagttttcgtactacttacctaaccgaagtaacgtaacgacggtccgacccgtacgacgggtacctccggttacgtaccgtttntttcggacgtaccctacctaacgtacgtacggaacacgaactccgtacgtcgtaccgtactaccgcggaccgggaccggaccgtaacgaccggaaacgtagggtacggaaggtacctaccggttaattacggtacgtacggacgggttaggtacgggtaataacgttacgtttaggttggtttaggttacggttacgggaacggttaccggacggtacgtcggtacccgtaggtaccggtacgtacggaaccgtcgaccggtctaccccggtcccgtaccgttaccnccgttaccgttcccgtaccccg

SEQ ID NO: 166649 - DNA, 648 bp, Homo sapiens
  misc_feature: GYAE6OF01BRGAR.26.71.G05.1.454.CMB.1.raw
  modified_base (180)..(180): a, c, t, g, unknown or other
  misc_feature (180)..(180): n is a, c, g, or t
  modified_base (257)..(257): a, c, t, g, unknown or other
  misc_feature (257)..(257): n is a, c, g, or t
  modified_base (451)..(451): a, c, t, g, unknown or other
  misc_feature (451)..(451): n is a, c, g, or t
tcagagactatactcacgaccggtgctcgatttagtgtcgtcgcaagagagagggggctgggcctcaggaagcagcatcggaggtgcctcagccatggcatggactccctctcttcctcggcgtccttgcttactgcacaggatccgtggccttcgatgagctgattcacgcccaccctnagtcgtccgtcgtccccaggaccacgacacgccaaccactccacctgcctccgggacaagaactaaaggttgggaanaagtaagaaatgctcgccgtaggttactaccgaggacggccgaggccctacgttacccttgttttcgtcctacttccttacgaagtataagacggccgcctggacgggtctccgagtacctattcgtgcctacacgtcgtaggaaccacacgcacgtcacaccacgtcggaccggtccggccacgaccgaacgnggacggacggatacgttagtacgttgcgagggtacggtagggtaactagtacgtagttggttaggttcgggttgggacgggacgggaccgtagggtcgtccgacccggttacggtggaccgtacccggcccgtaacggtcccgtccccggtaccccgtacggtaccccttaccgttccccgttcccgttaccccccg

SEQ ID NO: 166650 - DNA, 811 bp, Homo sapiens
  misc_feature: GYAE6OF01CCGB3.26.71.G05.1.454.CMB.1.raw
  modified_base (153)..(153): a, c, t, g, unknown or other
  misc_feature (153)..(153): n is a, c, g, or t
  modified_base (179)..(179): a, c, t, g, unknown or other
  misc_feature (179)..(179): n is a, c, g, or t
  modified_base (353)..(353): a, c, t, g, unknown or other
  misc_feature (353)..(353): n is a, c, g, or t
tcagagactatactcacgaccggtgctcgatttagtgtcgtcgcaagagagaggggggactcctgtgccccaccatggacacgtctttgcctccacgctcctgctgctgaccactcccttcagtgggtcttgtcccagatcaccttggaaggngtcgtggtcctgcgcgtggtcggacncccgacgcacgaccctcacgtctcgtacctgtcctccgtctcgtgtacttcctcacctaccaccgtaccgtacgtggaggtagagtcggtcggtccggtcgggtcccgaccggacccgggaacccccggaaggtccggtaggtacgtcggtctcgcctactcgttagtttacgngggtagtacgtacttccgacgtaacggtaccgttaacgtaccgttccgttactacggtacggaacggtacgtaccgtacctacccgaacctacgtaccggaacccggtaaccgggtaaccctaaccccggtaaaccgggtaaacccggggtttacccggggttacccgtttaaaccttaacggaaccgttacccggaaccgtaacgttaacggttaaccgtaaccgttacggtaacgggtaaccggaaccaacgtacggaacctaagttaaaccgttacttacgtacgtaccgtacctaacgtaccgtaccgtaccggtaccgtacggacgtaaaccgggaataaagaaacgtaagttacgaggtacgttcggggtacggaacggttaagggtttacggttccggaaacttacccggtccgtaccccgacccgtccccgtaacccgaccggtacccgg

SEQ ID NO: 166651 - DNA, 883 bp, Homo sapiens
  misc_feature: GYAE6OF01E553J.26.71.G05.1.454.CMB.1.raw
  modified_base (135)..(135): a, c, t, g, unknown or other
  misc_feature (135)..(135): n is a, c, g, or t
  modified_base (140)..(140): a, c, t, g, unknown or other
  misc_feature (140)..(140): n is a, c, g, or t
tcagagactatactcacgaccggtgctcgatttagtgtcgtcgcaagagagagggggctgggcctcaggaagcagcatcggaggtgcctcagccatggcatggacttccctctcttcctcggctccttgcttacngcacnggtatccgtgtccttgatgagtctgtactcacgcccacctgacgtcgtccgtacgtcccgaggacacgaccacgtccaacactccgaccgttcgccgtcgacgtagtaaccgtaaaggttggaagtagtaagaacgttcgcttacggtccgttaggtaaccttaccggaggtaccggacccgaggtaccccttaccggttacccctttaggtttcgtacctacgtttaccctaacggtaagtaacgtaacgaccgggtcccgtaccgtaacggacggtaccctaccgttaccgtaaccgtttcgtccgtcgacccttaaccgacgttaccggtaacggaaccctaccgtaccggtacctacgttacccggtaactaccggtacggtccccggaacggggtccccggaaccgtaccggaacccggtaaagggtacgtacggggaacgtaactacggtttaacgtaggttccgggaaggttacgggtacgggttaagtaacggttaacggttttacgtaggttttacgggttagggtttaccggggtaccgggttacgggaacccggggtaacttcggggttacccggtaaccgttaacccccggggttacggtttaccggggaaacccgtaccccggggtaacccgtttcccgggtacccccgggtttcccccgtacccccgggggttcccgtttaaaccccgttccccggtttttcccggaccccccggtttttaccccccgg

SEQ ID NO: 166652 - DNA, 864 bp, Homo sapiens
  misc_feature: GYAE6OF01C30TK.26.71.G05.1.454.CMB.1.raw
  modified_base (180)..(180): a, c, t, g, unknown or other
  misc_feature (180)..(180): n is a, c, g, or t
tcagagactatactcacgaccggtgctcgatttagtgtcgtcgcaagagagagggggctgggcctcaggaagcagcatcggaggtgcctcagccatggcatggactccctctcttcctcggcgtccttgcttactgcacaggatcccgtggccttcgatgagctgattcagcccaccctnagtcgtcccgtgccccgaggacagacagcccaccagtccacctgacctcggacaagtactaaagtggggatagtaagaatgctgtaccgtaggtactaaccgaggacggaccgacggtcccctaacgttcccccgtttagttttcggtacctacttccttaaccgaaggtaacgtaaacggtaaccggtcccggacccgttacggaaccgggtacctaccccgtacggtaacccgttaattttccggacggttacccctaccgtaacgtttacggaacgggtaaacccaaccgtacggtacccctacttccgacgtacccaacgtacccggacgggaccccgggaccccgtaacgggaaccccggtaaacggacggtaaggggaaccggggtacgttaaacccgttaacccggtttagtaccgggttaacgacggggtaccgggttaaggggtaaacgtaaacggtttaacgttttaaggttaccgggtttaagggttttacgggtttaccgggggacgggttaccggggtaacccgacggggtttaccccgtaaccgggtaccccggttaccgggttaccggtaacccgtacgggtaaacccccggaggtcccccgttcccgggtaccccccgtttacgggtaacccttcccggttcccggtttcccccggttacccccccgg

SEQ ID NO: 166653 - DNA, 869 bp, Homo sapiens
  misc_feature: GYAE6OF01EZYCK.26.71.G05.1.454.CMB.1.raw
  modified_base (842)..(842): a, c, t, g, unknown or other
  misc_feature (842)..(842): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcacgcccacctcagtcgtccgtcgtccccaggacagacacgcctaccatccaccgttgccgtcggcaagtaactaaagttcgggaagtaagtaacgaaagtcgtacgtcggaccttgggttaacttaaccgagggacggtaccccgaacggggacccctaccggtttacccccctttaagttttttcgggtacctactttaccctttaccgaaaaggtaacttaaaacgggtaaggccccgggtacccccgttaccggaacggggtacctttaccccgtaccggttaaacccggttaaactttttccggtacggggtacccctttaacccgtaaacgttccgggtaaaccggggtaaacctaaccccgaacggtaccccttaacgtcccgtttaacgaacccctacggttaccggaaccgggtccccgggggacccctacgggaaccccgtaaacgggagtaacggggaagggtaacgtaccgttaacgttacgttcggtacggacgggtaggtacgggggtaagttaacttaacgttacggtttggttaagggttttcgggttacgggtaacggggtaccgggtaaccgtacgggtccgtaccgggtaaccgttccgggtaacggtcccgaacggccctaaccggccgttaccccgtcccccggtcggttacccnccgtttcccgtacccggtttccccccg

SEQ ID NO: 166654 - DNA, 726 bp, Homo sapiens
  misc_feature: GYAE6OF01DEIM5.26.71.G05.1.454.CMB.1.raw
  modified_base (104)..(104): a, c, t, g, unknown or other
  misc_feature (104)..(104): n is a, c, g, or t
  modified_base (208)..(208): a, c, t, g, unknown or other
  misc_feature (208)..(208): n is a, c, g, or t
  modified_base (496)..(496): a, c, t, g, unknown or other
  misc_feature (496)..(496): n is a, c, g, or t
  modified_base (520)..(520): a, c, t, g, unknown or other
  misc_feature (520)..(520): n is a, c, g, or t
tcagagactatactcacgaccggtgctcgatttagtgtcgtcgcaagagagaggggtccatgccatggcatggatccctctcttcctcggcgtccttgcttacngcacaggctccggtgccttcgatgagctgattccacgcccacctcacgtcgtcccgtcgtccccaggacagaccacgccctacacgtccaccgtcgcgtcgganaacgaacgtaaggttgggataattaagaaagtgtacctcggtaccgtaggttactaccggacggaccggaccgaacggtccctaaccgttaccccgtttagttttggaccttacgttaccttaaccgaaagtaacgtaacggaccggccggtaccccgttacggaaccggtccttaccccgtacggaaccgtttacttcgtaccgacctacgtaacgtcggtaacgaactacaacgtcctaacttccacgtacagccgtacggacccggacctaacgaccgaagggtntaacggacggtactactaacgttntcggacgtacgggcggtaagtattaatacgttagttgtaaggttcggtacggacggacggtacgtagccgtacggaccgttagtacgactaccgaccggacgtcccgtcccggtaccccgttacctaccgtaccgttcccttacccggtcccccttaactccgtacgtaagttcctaggtccctaagggcgacgggcgaggtccgg

SEQ ID NO: 166655 - DNA, 764 bp, Homo sapiens
  misc_feature: GYAE6OF01CAYVT.26.71.G05.1.454.CMB.1.raw
  modified_base (733)..(733): a, c, t, g, unknown or other
  misc_feature (733)..(733): n is a, c, g, or t
tcagagactatactcacgaccggtgctcgatttagtgtcgtcgcaagagagagggggggggcctcaggaagcagcatcggaggtgcctcagccatggcatggatccctctccttcctcggcgtccttgcttactgcacgaggactccggtggtccttcgatgagctgtattcacgcccacctcgagtcgtccgtcgtccccgaggaccagacacgcccaccatccacctgccgtcggacaacgaactaaaggttgggaatataagaatgctgtccgttagtactacgaggacggaccgaggtccctaccggttccccttagttttcggacctaacttccgttaaccaaaaggtacgtaaaacggacggtcccggtacctacgggaacgggttactaccccggtagtaccgttaatttcgtacggacctacctacgttcggacggaaaccaccgtacgaccctaacttccgacgtaacccgtacgtaccgggacgggaccccgggtacccaacgggaacccggtaaagggagtaaccggggacggttaacgtaacctttacgtagttacggccggtagggtacggaggtaacttaattacgtagtttacgggtaggtttagggtcgggaacggtacggaccgtacggtccggttaccgtccggtaccgtaacggtaccgaccggtaccccgtaaggtccccgtacccggttaccccgtcgttaccgtttacccncccggtttccccgttcccctccccgttaacg

SEQ ID NO: 166656 - DNA, 947 bp, Homo sapiens
  misc_feature: GYAE6OF01AR5XA.26.71.G05.1.454.CMB.1.raw
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgacttcacgcccacctcagtcgtccgtcgtcccgagacacgacacgaccaccactcacctgccgtcggacaagaacgtaaagttggaagaataagaactgcctgtccgtaggttactaccgaggacggccgacggtaccctacggttcccctttagtttcggtacctacgttccttaacgaagtaacgtaaggaacgccgtacccgtacgtacggtaccgttacccgtaggttaaccgttaacgtttccgtacggtacccttaacccgtaaccgttaccgggtaaccggggtaaaccctaaccggtaaccggttaccccttaaacccggtacccgttaccggtaaaaccccgtaccggttaccccgggaaaccccggggggacccccgggggtaacccccgtaaccccggggtaaaacccccgggtaaaaccgggggtacgggtaaaccgggggaaacgggggttaacccgttaaaccggttttaaaccgtttaaccgggtttaccgggtaaccggggtaaccgggggttagggttaaacccgggtaaacggtttaaaccggtttaaacggtttaccgggttttagggttttaacggggttttacgggttaacggggtacgggggtaacgggtacccggtaacgggtcccgttaaaccgggttaccccggttaaccggttacggtacccggaaacccggttacccggaaccccggttcgtccccccggttacccccggtcggttaaccccgtttccggttaccccgttcccccggttaaaccccc

SEQ ID NO: 166657 - DNA, 880 bp, Homo sapiens
  misc_feature: GYAE6OF01B0AOE.26.71.G05.1.454.CMB.1.raw
tcagagactatactcacgaccggtgctcgatttagtgtcgtcgcaagagagagggggctgggcctcaggaagcagcatcggaggtgcctcagccatggcatggactccctctcttcctcggcgttccttgtctttactgcacgaggacttccggtggtccttcgagttgagtcttagtacttcaccgtcccacccgtcgtagtcgttccgtcgtaccccgaggacaggacacgacccacctactcctaccgtcgtccgtccggactaacggtaacgtaaacggttggggaaaactaacgtaaagtaaacgttcggtacgttaccggtaccgttaacggttaacttaaccggaaggtaccggcccgtaacggtcccgttaccgttaccccgttttagtttcggtacctacgttacctaacggaaagtacggtaaaccgaccgggtcccgtacccgtacggtaacggtaccctccggttagtaacgtttacttcggtacggacccttaccgaacgttccggaaacggtaaccaccggtaccgtacctacgttaccgacgtaacccgtcgaccgggtacccgggccgggtaacccgaacggaacccggtaagggtacggtaaggaccggtaacttaacttaacggttcgttaaccgggacggtaagggtcgggtaacgtaacgttaagttaacggttaggtttacgggttaggtttaccgggttacgggaacccgggtacggtaacccgggtacggttccggtaacccgggtaacggttacccggtacggttacccgggaccggttaaccccggacggttccccgtaacccccgggttccgttacccgtacgttcccctcccgggtttacccccgtacccccg

SEQ ID NO: 166658 - DNA, 885 bp, Homo sapiens
  misc_feature: GYAE6OF01AT4TG.26.71.G05.1.454.CMB.1.raw
  modified_base (279)..(279): a, c, t, g, unknown or other
  misc_feature (279)..(279): n is a, c, g, or t
  modified_base (284)..(284): a, c, t, g, unknown or other
  misc_feature (284)..(284): n is a, c, g, or t
tcagagactatactcacgaccggtgctcgatttagtgtcgtcgcaagagagaggggcgtgggcctcgaggaagcagcatcggaggtgcctcacgccagtggcgatggactccctctcttccgtcggccgttccttgtcttactgcacgagactccgtcggtccttacgatggacgtctagtacttcgcgacccctacccttcgagttcgtacccgtcgtaccccgaggacacgactcgacccactactcacctcgcgtccgacagaacgtaagtggaanataanaagtcgtacgtccgtaccgtttaagtaccgtacgaacggcggacccgacggtaccccaccggttttcccctttaggttttaccggacctacttttaccggttaaccgaaaggttaacctaaacggaccggtcccgtcccggtaacgtaacgggcccttacccgttaagtaacccgttagtttcgtccgggaaccttaccggtactaacggaaccgtaaccgacacccgtacccgtaacttcgttaaccgaacctaaccgtccgggaccggaccccggggttacccaacgggaccccggaaacggtacggtaacgggtaaccggaaccggtaccgtttaacgttaacgtaccggtacgtacggggtaaggttaccggtaaagttccggttaaccggttaagtttaccgggggttacggtttaacgggtttccggggaacgggggttacggtaccccgggtaagggtcccggttacccggtaaccggttcccggttaaggaaccccggttaccggtcccggtaaaccgggtcccgttaccccgggtcccccgttacccgggttaaccttccccgggttaacccgtttcccccggttacccccg

SEQ ID NO: 166659 - DNA, 870 bp, Homo sapiens
  misc_feature: GYAE6OF01CL17I.26.71.G05.1.454.CMB.1.raw
tcagagactatactcacgaccggtgctcgatttagtgtcgtcgcaagagagaggggtccatgccatggcatggatccctctcttcctcggcgtccttgcttactgcacgaggctccggtggccttcgagtgacgtctgtattccgacgccctaccctacgtggtccgtccgtacgtaccccgaggaccagacacgacccacctactccaccgtgaccgcggacaagtaacgtaaaggtggaagtaagtaagaagtcgcgttacgtaccggtaagttaacgtaccggaacgggaccggacccgtacggacccgttacccgtttaccccgttttaggtttaccggtaacttaccgtacctttaaacgaaagttaacgtaaacggaacggccccggtaacccgtacggaaccggtaccctcccgtaacgttaaccgttacgttttcgaccgtacctaaccgtaacggtacgacggaaccacccgaacgtcccgtaacttaccgactaaccgtcgacccgggaacggccccggaacaccggtaaagacggtacggaacggtacggacgttaacttaaggttacgtaccggtacgtaccggggtaggtaacggtaaagtacgttagttaaggttggttacgggttggtagggacggtacggacgacgtacggtcgtaaccggtagtacgggacctacgggacctccgggtaccctacccggtccccgtaccgtttacccgtaccgtacccccgtttaccccggtacccctttacccgtaaaccccgtttacccggttaacgttacgtttaacccccggttccgggttaaacccgggtacggggtaccggtaccggggttcccggtaaacccgggg

SEQ ID NO: 166660 - DNA, 818 bp, Homo sapiens
  misc_feature: GYAE6OF01CFU2O.26.71.G05.1.454.CMB.1.raw
  modified_base (690)..(690): a, c, t, g, unknown or other
  misc_feature (690)..(690): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacagactccgtggtccttcgatgacgctgtacttcacgccctaccctcgtagtcgtccgtcgtccccgaggacagacacgcccaaccacgtccacccgtggaccgtaccggactaagaaccgtaaaggttcggggaaagaagttaaacggaaaacttcggtaccgtcggtaccgttaacggttaactttaacccggaagggaacccgggcccgtaacggccccgtaacccggtttcccccgttttacgttttacgggtacctaccgttttaccgtaacccgtaaaacggtaaacgttaaaccggaaacgggtacccccggtaccccgtaaccggtaacgggtaacccttaaccccgtacggggtaaacccgtttaaggtttcccgtaccgggtaccccttaaacccgtaaccggttccggtaaacgggaaccctacgaaccggtcccttaacctccgttacgaaccctacggtaacccgacggggtaccccggggtaaccaacccggaccggaacggtaaggtacggacggtacgtactaacgtatcggtacgngggtacgaggtaatatacgttattggtacgttggttacggacggacggagtcgcggtaccggccgtacgtcggtacaccgtccgtacgccctcccggtacctcgtaccgtccttccgtcccgttcccc

SEQ ID NO: 166661 - DNA, 855 bp, Homo sapiens
  misc_feature: GYAE6OF01BV3RS.26.71.G05.1.454.CMB.1.raw
  modified_base (210)..(210): a, c, t, g, unknown or other
  misc_feature (210)..(210): n is a, c, g, or t
  modified_base (220)..(220): a, c, t, g, unknown or other
  misc_feature (220)..(220): n is a, c, g, or t
tcagagactatactcacgaccggtgctcgatttagtgtcgtcgcaagagagaggggggctgggcctcaggaagcagcatcggaggtgcctcagccatggcatggactccctctcttcctcggcgtccttgcttactgcacaggatccgtggtccttacgatgagctgattcacgcccacctcagtcgtccgtcgtaccccaggacagacncgccaccacnccgacctcgacctcggacaagaacctaagtggggaatataagtaatcgctcggcctagttaacttaacgaacggacggaccgacggcctacgttaccccgtttagttttcggactacttccttacgtaaacgagtaaacggaccgcccggtaccgtaccggacggtacctacccgtaccgaacgttacttcgtcggtccctaccgtaacgttccggtaacggaactaaccgaccgtaccctaaccgttcgtaccgaaccctacgtacccggtaccggggccccggggaccccgaaccgggacccggaaaacgggtcggaaacggggtaaccggaacgttaaccggttaaacgttacgtttaccggtacgggtacggggtaacggggttaacgggaacgttaaacggttaacgttttacggtttaaggggttacgggttttaccggggttgggggtaaccgggggttaaccgggtaaacccgtgggggtacccgtcgggttaaccccgggttcccgttacgggggtaccccggacccgggttaacccggtaaccggtaccccggttccccccggttaccccgggttacccgggttacccgttcccggtttcccgttcccccggtttacccccccgg

SEQ ID NO: 166662 - DNA, 973 bp, Homo sapiens
  misc_feature: GYAE6OF01EE1T0.26.71.G05.1.454.CMB.1.raw
tcagagactatactcacgaccggtgctcgatttagtgtcgtcgcaagagagagggggctgggcctcaggaagcagcatcggaggtgcctcagccatggcatggactccctctcttcctcggcgtccttgcttactgcacaggactccgtggccttcgatgagctgacttcacgcccacctgagttcgtccgtcgtccccaggacacgacacgcccacatccaccgtgccgtcggacaagaacgtaaaggttgggaataagtaacgaaatcgccttcgccgttaggtaacttaaccgaggacggacccgacggccctaaccgttcccctttaagttttccggtactacgttccttaaccgaaagtaacgtaaacggaaccggtccccggtaccccgtacggaaccgggtaccttacccccgtaaggtaacccgtttacgttttccggaccgggtaacccttacccgttaaacggttccgggtaaacggaaaccctacccgtaccgtacccctaccgtttaacccggtaccgtaaccccgtaacgtacccggggtacccggggacccccgggggtaacccccgaaaccgggtaaaccccgggaaaaccgggttaacggttaacgggggaaaccggggtaaccttaacccggtttaaacgtttaccggtttacgggtaacccgggtaacgggggttaaccgggtaacggggtaaaacgtttaaactttacgggttttaacgggtttacggggtttaacgggttttaccgggggttaacgggggaaccccggggttaaacgggggttaccccgtaaacgggggttacccgttaaccccggggttaacccggtttaacccgggttaacggggaccccgtaaccggtaacccccgggaacggggttccccttacccccgggttcccccgtacgggttaccccttaccccggtttccccgttacccccgttacccccccg

SEQ ID NO: 166663 - DNA, 636 bp, Homo sapiens
  misc_feature: GYAE6OF01CX1NR.26.71.G05.1.454.CMB.1.raw
  modified_base (240)..(240): a, c, t, g, unknown or other
  misc_feature (240)..(240): n is a, c, g, or t
  modified_base (295)..(295): a, c, t, g, unknown or other
  misc_feature (295)..(295): n is a, c, g, or t
  modified_base (301)..(301): a, c, t, g, unknown or other
  misc_feature (301)..(301): n is a, c, g, or t
  modified_base (308)..(308): a, c, t, g, unknown or other
  misc_feature (308)..(308): n is a, c, g, or t
  modified_base (316)..(316): a, c, t, g, unknown or other
  misc_feature (316)..(316): n is a, c, g, or t
  modified_base (327)..(327): a, c, t, g, unknown or other
  misc_feature (327)..(327): n is a, c, g, or t
  modified_base (349)..(349): a, c, t, g, unknown or other
  misc_feature (349)..(349): n is a, c, g, or t
  modified_base (353)..(353): a, c, t, g, unknown or other
  misc_feature (353)..(353): n is a, c, g, or t
tcagagactatactcacgaccggtgctcgatttagtgtcgtcgcaagagagagggggctgggcctcaggaagcagcatcggaggtgcctcagccatggcatggatccctctctcctcggcgtccttgcttactgcacaggatccgtggccttgatgagctgattcagcccacctcacgtcgtcccgtcgtccccaggacagacacgccacatccacctgctcggcagaacaaggtggaanataagatgctgctagtactcagcgcagcctcgtcctatttgctatctacaagtanaacggnccgaccngagctccngacgtattcgngcctaccgagtcgaggtaaccngacncctagtcacgactagtacgaccggccgggaccacggacccgaaggtacgtaggaacggtacgtaacgtacgttacgtcgtacggacgggtacgtagggaagttaacgtacgttagtttacgggttagttcgggttaacggggacgggtaccggtaaccgtgggtacccggtaaccgggtcccttaacgggtaccgggtacccgtacggtaccccgggtacggtcccgtaccccggtacccccggttacgttaccctaccggtttcccgttcccggtaaccccc

SEQ ID NO: 166664 - DNA, 639 bp, Homo sapiens
  misc_feature: GYAE6OF01CRQCZ.26.71.G05.1.454.CMB.1.raw
  modified_base (140)..(140): a, c, t, g, unknown or other
  misc_feature (140)..(140): n is a, c, g, or t
  modified_base (222)..(222): a, c, t, g, unknown or other
  misc_feature (222)..(222): n is a, c, g, or t
  modified_base (239)..(239): a, c, t, g, unknown or other
  misc_feature (239)..(239): n is a, c, g, or t
  modified_base (243)..(243): a, c, t, g, unknown or other
  misc_feature (243)..(243): n is a, c, g, or t
  modified_base (246)..(246): a, c, t, g, unknown or other
  misc_feature (246)..(246): n is a, c, g, or t
  modified_base (263)..(263): a, c, t, g, unknown or other
  misc_feature (263)..(263): n is a, c, g, or t
tcagagactatactcacgaccggtgctcgatttagtgtcgtcgcaagagagaggggctggcctcaggaagcagcatcggaggtgcctcagccatggcatggatccctctcttcctcggcgtccttgcttactgcacaggntccggtgccttcgatgagctgattcagccctaccctcagtcgtccgtgtccccaggaccagacacgccaccatccacctgcncggcagacaaagtgganatanaangctcgctggtacttacngacgccagcccagttcccttattggctactactaccaagtactaagacggtccgacccctgacggtctacccgtagacctatttcgtacggacctacaacgtcgtacggtaaccacctacgcctaactccgtacgacctacgcgtaccggcccgggaccacgacccgaacggtaacaagggacggaacgtactacgtagtacgtacgaggtccggagtaacgaagtaacgttagttggttaggttcggttacgggcgggtacgtacgtaccgggtacgtaccggtcgtacgggtacgtacccgaaccggtacccgtaggtcccgtcccgtacccccgttcgtaacccggttccttcccgttacccggttccccccg

SEQ ID NO: 166665 - DNA, 756 bp, Homo sapiens
  misc_feature: GYAE6OF01BPOFX.26.71.G05.1.454.CMB.1.raw
  modified_base (159)..(159): a, c, t, g, unknown or other
  misc_feature (159)..(159): n is a, c, g, or t
  modified_base (189)..(189): a, c, t, g, unknown or other
  misc_feature (189)..(189): n is a, c, g, or t
  modified_base (529)..(529): a, c, t, g, unknown or other
  misc_feature (529)..(529): n is a, c, g, or t
  modified_base (539)..(539): a, c, t, g, unknown or other
  misc_feature (539)..(539): n is a, c, g, or t
  modified_base (672)..(672): a, c, t, g, unknown or other
  misc_feature (672)..(672): n is a, c, g, or t
tcagagactatactcacgaccggtgctcgatttagtgtcgtcgcaagagagagggggctgggcctcaggaagcagcagtcgggaggtcgcctacacgccagtcggctagtgggaccttccccttcttcctttcccgtccggtccgttccttgctttacnggcacgaggtacttccgggtcgtccttagnggtgacgtcgttagttactccgacccgtacccctaccctaggtacggttccgtcccggttaccgtaccccggaaggaaccacgaccgacccgacccctaaccacttcccgtacccgtcgaccgtccgggaacaagtaaccggtaagggttaggaattaagtacgtaagtcgtacgtacgtacgttacggttacctacggacggtacgaccgacgtaccgtacgttaccttacggtttcgactattccgtacgaacgtacgaacgaccgggccgtacgacggacgtacctaccgtacgttacgtacgtcaacgtcctacctacgtacggtacaacccgacnccgtactacncctacgaacgtcgacgccggggaccgacccgacgggtaccgaacgggaggtacggaacggtacctagttacggtacggtacgcggtagggtacgaggtaactagtacgttagttgtggtaggtacgcggtacncggacgtacgaccgtcggtagtaccggtacacggcccgttacggcccttcccggacttccgtcctacgttcccgtcgtaccccg

SEQ ID NO: 166666 - DNA, 733 bp, Homo sapiens
  misc_feature: GYAE6OF01BABG8.26.71.G05.1.454.CMB.1.raw
  modified_base (220)..(220): a, c, t, g, unknown or other
  misc_feature (220)..(220): n is a, c, g, or t
  modified_base (246)..(246): a, c, t, g, unknown or other
  misc_feature (246)..(246): n is a, c, g, or t
tcagagactatactcacgaccggtgctcgatttagtgtcgtcgcaagagagaggggggactcctgtgcccaccatggacacgctttgctccacgctcctgctgctgaccatcccttcatgggtcttgtcccagatcaccttgaaggagtctggtcctgcgctggtggacgcccacgcacgaccctcacgctcgaccctgcctccgtctcgtggtattccncactccaaccacgtacgtggaggtanagttcggtcggccgttcgggtcccgtacggaaccgggaccccggaaacggcccgtgggaggtcggtcgttcgcctacgttctaagtttacgtgggtagttagtactacgtacgtacggtacgtaactaccgttccgtcgtacggtagtaacgtaacgtaccgtactaccaactacaccgaaccggaaccgaccaaccgtaaccggaacgggtcggttaccgtactaacgaacgtccgaaccgtactattacgacttcgaaggacaaccgtagacgtactattaacgttactactcggtaccaacgtaccgtacctaggttacccggtagtaccgtaaccggaacgtaaacgtaaaagtaaaagtacgttaacgtaaagtacgggttaacggtacggggtaaccgttaagggtttaaacccgtttcggaaccccgttcccgtacccctacccgtaacccgtcccgaaacccgtaccgggtaaccccgg

SEQ ID NO: 166667 - DNA, 706 bp, Homo sapiens
  misc_feature: GYAE6OF01D18XQ.26.71.G05.1.454.CMB.1.raw
  modified_base (158)..(158): a, c, t, g, unknown or other
  misc_feature (158)..(158): n is a, c, g, or t
  modified_base (335)..(335): a, c, t, g, unknown or other
  misc_feature (335)..(335): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtgccttagatgagctgnttcagcccaccgtcagttcgtccgtcgtaccccgaggaccacgacacgaccaccatccactcgccgtccggacaagtaactaaaggttgggaatagtaagaatggactcgtaccgtagttaactaccgaggacgacgacgacctacgtcctttagttacgctagttctacaagtaanaacggcgccgtacacggacggtactaccgtacgactagttcgcgtctaccgtactcggtacggaacaccgtacgacctactcgtaccgacaacggtccggaacgggtcccggaacccgaacgaccggtaaacgggtgtacgggaacgtaacgtactagttacgttcggtacggacgggtcgggtaacgaagttacgttacgttaggttacgggttaggtttcgggttacggggaaccgggtacgggtaacgtacgggtgttaaccccggttacggtaaccgttcggaaccggccggtaacccggacgttcccggtccccgttcccggtaccgtccttacccgttccggttacccctcccctcccgttaccg

SEQ ID NO: 166668 - DNA, 798 bp, Homo sapiens
  misc_feature: GYAE6OF01E2XGT.26.71.G05.1.454.CMB.1.raw
  modified_base (177)..(177): a, c, t, g, unknown or other
  misc_feature (177)..(177): n is a, c, g, or t
  modified_base (260)..(260): a, c, t, g, unknown or other
  misc_feature (260)..(260): n is a, c, g, or t
tcagagactatactcacgaccggtgctcgatttagtgtcgtcgcaagagagagggggctgggcctcaggaagcagcatcggaggtgcctcagccatggcatggactccctctcttcctcggctccttgcttactgcacaggatccgtggccttcgatgagctgattcacgccacctnagtcgtccgtcgtccccgaggacacgacacgcccaaccactccacccttcgccgtcggacaacgaacctaaaggttggggaanaagtaagaaagtcgcgtacgtccgtaggttaacttaaccgaacggacggcccgacggcccctacgttccccctttagttttcggtctacttcctttaaccaaagtaacgtaaaggaacggtcccggaccccgttacgaacgggtacctccccgtacggtaacccgttaacttttccggtcgggtacccttacccgtaaaccgttcgtaaccgggaacaccgaccgtaccctaccttcctaccgaccctagtccgaaccgggcccggggaccccacggaccccgtaaacgggtaacgtacgggaagggtacgtaaccttaacgttacgtttcgaaccggtacggggtcggtaggggtaactaaggttaactttaggtttagttaagggttttcgggttacgggacgggtaacgggtaccgtagggtaccgttacggtacccgttaccggtacggttaccgaaccgggtccccgtagggtcccttaccccggtacccccgttaccggtaccttccccgttccgttccccggttccccccg

SEQ ID NO: 166669 - DNA, 821 bp, Homo sapiens
  misc_feature: GYAE6OF01EINI9.26.71.G05.1.454.CMB.1.raw
tcagagactatactcacgaccggtgctcgatttagtgtcgtcgcaagagagagggggctgggcctcaggaagcagcatcggaggtgcctcagccatggcatggatcccctctcttcctcggccgtccttgcttactgcacagatccgtggccttcgatgatctagtacttcacgcccaccctcagtcgtccgtcgtccccaggacacgacacgaccctaccatccaccgtcgactccggacacggaacttaaagttaggggaataataacgaaatcgtcgtacgtcgttacgtaacttaccgaggacggaccaccggccctaccgttcccctttagtttcgtactacttaccgtaccgaagtaacgaacggtaaccgcccgtccgttacggaacgggtaccttacccggtacggtaaccgttacgtttcgacgtacccaacctacggtaccggtaacggaacccacggaaccgtccctaagttccctaacggaaccgttcgacgggacccgggcccgggaacccgtacggtaccccgaaagggaccggtaaggggaaccgtaaccgttaaacgttacctttacggtacgggttaccggagggtttacggtacgggtaaacttacgttaaacgttggtttaagggttacggttaaggggtcccgggttaaggaccgggttaacgaccgggttcggtaccgggtaacccgttttacggacccggtaaccggttacccggaaccgggtaccccggaccgtttacccccggcccccggggttttccacccccggtcttttccccccgtcccggtttacccccccg

SEQ ID NO: 166670 - DNA, 840 bp, Homo sapiens
  misc_feature: GYAE6OF01AWTIG.26.71.G05.1.454.CMB.1.raw
  modified_base (132)..(132): a, c, t, g, unknown or other
  misc_feature (132)..(132): n is a, c, g, or t
tcagagactatactcacgaccggtgctcgatttagtgtcgtcgcaagagagaggggggggcctcaggaagcagcatcggaggtgcctcagccatggcatggatccctctcttcctcggctcctgtcttactnacacgaggtacttccggaggccctttcgagtggtaacggtccttggtaacttccggacggtcccccaaccccttcgacggtttcgtcccggttaccggtacccccaaggaccgaacgggaccacgaccctaaccactacctaccctcggccgtacggacaacggaaacctaaggttgggaaagtaagttaaagaagtcgacgtactaccggttacgttaaccgtaccggaacggtaccgaccgacggttaacctcgttaccccgtttattttccggactacgtttaaccctaagtaacggtaaagtaaaccggaaccggtccggtcccctaacggacgggttacctaccccgtacggtaaccgtactttcggtacgtaccctaaccgtaacgttcggtaaaccggactacccgaacgtacccctaacgttaccgtaccgtaccacgtaaacccgggcccggggacccgggtacccgaacgggtaacccggtaacgggtaacgtaaggggaacggttaccctaacgttaccggtaagttaaccggcgggttaaggtaacgggcgttaaagtactttaagtcgggtaggtttaggtacggttgggacggaacgggttacgcgtcgtacggttccgagtacgcgaccggtaacctgggccccttaccggcccgttaaccgcctacccgttcggtccccgtcccgttactcg

SEQ ID NO: 166671 - DNA, 775 bp, Homo sapiens
  misc_feature: GYAE6OF01AX78I.26.71.G05.1.454.CMB.1.raw
  modified_base (178)..(178): a, c, t, g, unknown or other
  misc_feature (178)..(178): n is a, c, g, or t
  modified_base (680)..(680): a, c, t, g, unknown or other
  misc_feature (680)..(680): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccaccctnagtgtcccgtgtccccaggaccagacagccaccatccacctgctcggcagacaagttgggagatagaatgctcgctggtattaccgagacggccaggcccacgttccccttagttttcggtctacgttaccttaccgaaagtaagtaaacggaacggtcccgggtaccccgttacggaacggggtaccttacccccggttacggtaaacccggttaaacgttttcccgtaccgggtacccttacccgtaaacccgtttaccggttaacggggtaaaccctaaaccgaaccggtacccctaaccgttccggttaaccgaaccccgtacgtaccggtaaccgggtaccccggggaccccgaaccgggaacccccgtaaacgggacgtacgggtaacggggtacgtaaccgttaacgttacgttacggtacggtcgggacggtagggtaacgtaacgttaccgtagtttacggtaagttcggttacgggacgggtacggtaccgnggtccgtacggaccgttccgtacggtcccgacggtcccgaacggtcccgtaccggtcccccgttacggtccctacgttcccgtccgttacccccg

SEQ ID NO: 166672 - DNA, 784 bp, Homo sapiens
  misc_feature: GYAE6OF01CTWFW.26.71.G05.1.454.CMB.1.raw
  modified_base (165)..(165): a, c, t, g, unknown or other
  misc_feature (165)..(165): n is a, c, g, or t
  modified_base (278)..(278): a, c, t, g, unknown or other
  misc_feature (278)..(278): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgagtgagctgnttcagcccaccttcagttcgtccgtacgtaccccaggacagaccgagacccaacctactaccacccgtcgtaccgtaccgggactaaaggtaaaccgtaaaggttcggggaanaaagttaagaacgtagtacgtcgaccgttaggtaactaaccgaggaacggccgtaacggtaccgacgttaccccgtttagttttcggaccttacgttaccgtaaccgtaaaggtaacgtaaacgaacggtacccggtacccgtacggaacgggtaccgtacctacgtaacccgttaacgttcgtacgggtaccctaaccgtaaccgttagtaccgggaacctaacgaccgtacgtaacctcgtacgacacgttacccggagggaccccggtaccgaacggaccggtaacggggtaggtaaaccgggacgtacgttaacttacggttaggacggtacggtacggacggaagttaactaacgttagttaggttacggttgggttacggtaaccgggacgggaccgtacggtaccgtaccggtacggttccggacggtaaccgaccgaccgggtacgtcccggtccctacccggttctacccgctttacccggtcgtccccgtaccccg

SEQ ID NO: 166673 - DNA, 518 bp, Homo sapiens
  misc_feature: GYAE6OF02GV0IL.26.71.G05.1.454.CMB.1.raw
  modified_base (235)..(235): a, c, t, g, unknown or other
  misc_feature (235)..(235): n is a, c, g, or t
tcagagactatactcacgaccggtgctcgatttagtgtcgtcgcaagagagaggggcgtggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctattttggtcatcttccaagataagaagcggccctcagggatccctgaccgaatttctggctccaactctgggaacacagccactctgaccatcagcgggccagccacgatgaggagactactattgtcaggcgtgggagaatactattgtagtgtttggcggaggacaggctgaccgtccgtaggtcagcccgaaggcctcggcccccgtcggtaccaccgttccgtcgttaccccccg

SEQ ID NO: 166674 - DNA, 526 bp, Homo sapiens
  misc_feature: GYAE6OF02IFSLK.26.71.G05.1.454.CMB.1.raw
  modified_base (333)..(333): a, c, t, g, unknown or other
  misc_feature (333)..(333): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctatttggtcatcttccaagataagaagcggccctcagggatccctgaccgaatttcnggctccaactctagggaacacagccactctgaccatcagcgggcccagccaacggatgagggagactactattgtcaggcgtgggagaatactattgtagtgtttggcggaggaccgaggcgtgaccgtcgtaggtcgaacgcccgaaggcctcgcccccgtcggtccaccgtctcgttccccgcccttcccg

SEQ ID NO: 166675 - DNA, 515 bp, Homo sapiens
  misc_feature: GYAE6OF02H60N7.26.71.G05.1.454.CMB.1.raw
  modified_base (233)..(233): a, c, t, g, unknown or other
  misc_feature (233)..(233): n is a, c, g, or t
  modified_base (333)..(333): a, c, t, g, unknown or other
  misc_feature (333)..(333): n is a, c, g, or t
  modified_base (418)..(418): a, c, t, g, unknown or other
  misc_feature (418)..(418): n is a, c, g, or t
  modified_base (465)..(465): a, c, t, g, unknown or other
  misc_feature (465)..(465): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctattttggtcatcttccaagataagaagcggcctcagggatccctgaccgaatttcnggctcaactctgggaacacacgcactctgacatcagcgggcccagccaacggatggagggacgatactattgtcaggcgtggganaatactagtgtagtgttggcgagggaccaggctgacgtcctaggtcngcccgaaggccttcgccccgtcggtccacgtcctcgttccccaccttccc

SEQ ID NO: 166676 - DNA, 513 bp, Homo sapiens
  misc_feature: GYAE6OF02IYRGV.26.71.G05.1.454.CMB.1.raw
  modified_base (235)..(235): a, c, t, g, unknown or other
  misc_feature (235)..(235): n is a, c, g, or t
tcagagactatactcacgaccggtgctcgatttagtgtcgtcgcaagagagaggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctattttggtcatcttccaagataagaagcggccctcagggatccctgacccgaatttctggcctccaactctgggaacacagccactctgaccatcagcggggcccagccaacggatgagggagactactattgtcgaggcgtggagaatactagttgtagtgttggcggaggaccaggctgaccgtcgtaggcaggccaaggctcggcccctcggtccaccttctcgttacccc

SEQ ID NO: 166677 - DNA, 492 bp, Homo sapiens
  misc_feature: GYAE6OF02I98YZ.26.71.G05.1.454.CMB.1.raw
  modified_base (321)..(321): a, c, t, g, unknown or other
  misc_feature (321)..(321): n is a, c, g, or t
  modified_base (350)..(350): a, c, t, g, unknown or other
  misc_feature (350)..(350): n is a, c, g, or t
tcagagactatactcacgaccggtgctcgatttagtgtcgtcgcaagagagaggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagagccaggccagtcccctatttggtcatctccaagactaagaagcggcctcagggactccngaccgaattcaggctccaactctggaacncagccactctgaccatcagcgggcccagccaacggatgaggagactactattgtccaggcgtgggagaatactatgtagtgttgcggaggaccaggctgagtcgtcctaggcagcccaaggctgcccctggcacgtctccgg

SEQ ID NO: 166678 - DNA, 513 bp, Homo sapiens
  misc_feature: GYAE6OF02F12L7.26.71.G05.1.454.CMB.1.raw
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggtcatcttccaagataagaagcggccctcagggatccctgaccgaatttctggctccaactctgggaacacagccactctgaccatcagcgggcccagccaacggatgagggagactactattgtcaggcgtgggagaatactattgtagtgtttggcggagggaccaggctgaccgtctaggtcgagcccaaggcctgcccctcggtcacctctcgttcccgccctccc

SEQ ID NO: 166679 - DNA, 501 bp, Homo sapiens
  misc_feature: GYAE6OF02GGFKJ.26.71.G05.1.454.CMB.1.raw
tcagagactatactcacgaccggtgctcgatttagtgtcgtcgcaagagagaggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggtcatcttccaagataagaagcggccctcagggatccctgaccgaattctggctccaactctgggaacacagccatctgaccatcagcgggcccagccaacggatgagggagactacattgtcaggcgtgggagaatactattgtagtgtttggcggagggacaggctgaccgtcgtaggtcaggcccaagctcgcccctcggcactctgtccccg

SEQ ID NO: 166680 - DNA, 535 bp, Homo sapiens
  misc_feature: GYAE6OF02I9QBW.26.71.G05.1.454.CMB.1.raw
  modified_base (423)..(423): a, c, t, g, unknown or other
  misc_feature (423)..(423): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggcatcttccaagataagaagcggccctcagggatccctgaccgaatttctggctccaactctgggaacacagcccactctgaccatccagcgggcccagccaacggatggagggagactactagttgtcaggcgtggganaagtactagttgtagtgtttggcggtagggaccaggctgaccgtccgtaggtccgaaggcccaagggcctcggtcccccgtcggtccacctcctcgttccccacccttcccg

SEQ ID NO: 166681 - DNA, 685 bp, Homo sapiens
  misc_feature: GYAE6OF02HRO6W.26.71.G05.1.454.CMB.1.raw
  modified_base (236)..(236): a, c, t, g, unknown or other
  misc_feature (236)..(236): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctattttggtcatcttccaagataagaagcggccctcagggatccctgaccgaatttctggcctccaactcgtaggaacacacgccactctcgaccatccacggccgggcccacgaccgaaacggagtggacgggacgaacttaacttagttcgtacgagggtcggtaggggaagtaaacgttaacgttaagtttacggttaaggtttgggttttacggggaccggggtaacgggtaacccgtaaggggtccgttacgggtaaccccggtttacccggttaacggggttacccgaaccgggtaacccccgtaaaacggggtcccgttaccccgggtacccccccggtttacccggggttaccccgtaaccccggtttcccgtttacccgggttttaacccccccccg

SEQ ID NO: 166682 - DNA, 507 bp, Homo sapiens
  misc_feature: GYAE6OF02H373Y.26.71.G05.1.454.CMB.1.raw
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggtcatcttccaagataagagcggccctgaggctccctgaccgaattctggctccaactcgtaggaacacagccactctagaccatcagccgggcccagccaacggatggagggagactactattgtcaggcgtgggagaatactagtttgtagtgtttggcggaggaccaggctgaccgtcgtaggcagcccgaaggctcgcccctggtcactctctcccc

SEQ ID NO: 166683 - DNA, 531 bp, Homo sapiens
  misc_feature: GYAE6OF02H7719.26.71.G05.1.454.CMB.1.raw
  modified_base (233)..(233): a, c, t, g, unknown or other
  misc_feature (233)..(233): n is a, c, g, or t
  modified_base (350)..(350): a, c, t, g, unknown or other
  misc_feature (350)..(350): n is a, c, g, or t
tcagagactatactcacgaccggtgctcgatttagtgtcgtcgcaagagagaggggccgtcgaggaagcagcatcggaggtgcctcagccatggcatggatccctctcttcctcggcgtccttgcttactgcacaggatccgtggccttcgatgagctgattcagccacactcagtgtccgtgtccccaggacagacagccaccatcacctgctcggacagacaaattggganatagaaatgctgcctggtattaccagagccaggccagtcccctatttgtcatcttccaagataagaagcggccctcagggatccctgaccgaatttctggctcaactctgggaacanaagccactctgaccatcagcggggcccaggccaacggatgaacgggagactacaatttcgtcaggcgtggaacgtaagacttattgtaagtggtttggcggagggcctagggctcggaccgtcgtacggtcagacccaaggctcggccccctacgggtcactacctcgttccccgtccccg

SEQ ID NO: 166684 - DNA, 529 bp, Homo sapiens
  misc_feature: GYAE6OF02GHNLH.26.71.G05.1.454.CMB.1.raw
  modified_base (231)..(231): a, c, t, g, unknown or other
  misc_feature (231)..(231): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctatttggtcatcttccaagataagaagcggccctcagggatccctgaccgaatttctggctccaactctggaacacagccactctgaccatcagcgggcccagccaacggatgagggagactactattgtcaggcgtgggagaatacgtaattgtagtgtttggcggagggacaggctcgaccgtcgtaggtccaggcccaaggccttacgcccccgtcggtccaccgttccgtccgttccccaccccgttcccg

SEQ ID NO: 166685 - DNA, 517 bp, Homo sapiens
  misc_feature: GYAE6OF02GJOM4.26.71.G05.1.454.CMB.1.raw
  modified_base (333)..(333): a, c, t, g, unknown or other
  misc_feature (333)..(333): n is a, c, g, or t
  modified_base (396)..(396): a, c, t, g, unknown or other
  misc_feature (396)..(396): n is a, c, g, or t
  modified_base (452)..(452): a, c, t, g, unknown or other
  misc_feature (452)..(452): n is a, c, g, or t
tcagagactatactcacgaccggtgctcgatttagtgtcgtcgcaagagagagggggccctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggtcatcttccaagataagaagcggccctcagggatccctgaccgaatttcnggctccaactctgggaacacagccactctgaccatcagcgggcccagccaacggatgaggganactactattgtcaggcgtgggagaatacgtattgtagtgtttggcggtagggaccnggctgaccgtctaggtcaggcccaaggcctcgccccgtcggtcaccgtctcgttcccgccctccc

SEQ ID NO: 166686 - DNA, 525 bp, Homo sapiens
  misc_feature: GYAE6OF02IGD0I.26.71.G05.1.454.CMB.1.raw
  modified_base (238)..(238): a, c, t, g, unknown or other
  misc_feature (238)..(238): n is a, c, g, or t
  modified_base (418)..(418): a, c, t, g, unknown or other
  misc_feature (418)..(418): n is a, c, g, or t
tcagagactatactcacgaccggtgctcgatttagtgtcgtcgcaagagagaggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaaattggggaanataagaatgctgctgtatacagagcagccacgtccctatttgtcatctacaagataagaagcgcctcgaggactcctagacgtaattcgtggcctaccaactcgtaggaacacacgaccactctacgaccatcgacgcggaccgacgacgaacgagagaggagacgtactatagtcgagngtaggagaagtaactagtagtagtagttgtacggaggacgacgacgtacgtacgtacgtacgtacgacgaccgacgacgtcgtcccgtccgtcgtactactcgtccc

SEQ ID NO: 166687 - DNA, 520 bp, Homo sapiens
  misc_feature: GYAE6OF02HD4C0.26.71.G05.1.454.CMB.1.raw
  modified_base (236)..(236): a, c, t, g, unknown or other
  misc_feature (236)..(236): n is a, c, g, or t
  modified_base (298)..(298): a, c, t, g, unknown or other
  misc_feature (298)..(298): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctatttggcatcttccaagntaagaagcgccctcagggatccctgaccgtaattctggctccaactctagggaacacagccactctcgaccatcgagcgggcccagccaacggatgagggagactactattgcaggcgtgggagaagtacgtagttgtagtgtttggcggaggaccgaggctgaccgtccgtaggtccaggcccgaaggcctcgccccgtcggtccacgtccgtcgtccccg

SEQ ID NO: 166688 - DNA, 512 bp, Homo sapiens
  misc_feature: GYAE6OF02HHZXI.26.71.G05.1.454.CMB.1.raw
  modified_base (232)..(232): a, c, t, g, unknown or other
  misc_feature (232)..(232): n is a, c, g, or t
tcagagactatactcacgaccggtgctcgatttagtgtcgtcgcaagagagaggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctatttggtcatcttccaagataagaagcggccctcagggatccctgaccgaatttctggctccaactctgggaacacagccactctgaccatcagcgggcccagccaacggatgagggagactactattgtcaggcgtgggagaatactattgtagtgtttggcggtagggaccaggctgaccgtctaggtcagcccaaggcctcgcccctcggtccactctcgttcccgcctcccg

SEQ ID NO: 166689 - DNA, 531 bp, Homo sapiens
  misc_feature: GYAE6OF02IV4ZT.26.71.G05.1.454.CMB.1.raw
  modified_base (237)..(237): a, c, t, g, unknown or other
  misc_feature (237)..(237): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtcccccaggacagacagccaccatcacctgctcggcagacaaattggganatagaaatgctgcctggtattaccagaggccaggccagtcccctattttggtcatcttccaagataagaagcggccctcagggatccctgaccgaatttctggctccaactctgggaacacagccactctgaccatcacgccggggcccaggacccaaacggatggagggagactaactattgtcgaggcgtgggagaatactagttgtagtgttggcggaggaccgaggcctgaccgtccgtaggtcacggcccgaaggcctcgccccgtcggtccaccgtcctcgttccccc

SEQ ID NO: 166690 - DNA, 566 bp, Homo sapiens
  misc_feature: GYAE6OF02GC5V9.26.71.G05.1.454.CMB.1.raw
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctatttggtcatcttccaagataagaagcggccctcaggggatccctgaccgaattctggctccaactctgggaacacagccactctgaccatcagcgggcccagccaacggatgagggagactactattcgtcagggcgtaggggagtaagtacttagttacgtagttggtttagggcgggtagggaccgagggccgttcggacccgtccggtaaggtccacggccccgtaaagggcctaccggtccccccgttcgggtaccctaccgttccgtccgttaccccccg

SEQ ID NO: 166691 - DNA, 507 bp, Homo sapiens
  misc_feature: GYAE6OF02HIT0I.26.71.G05.1.454.CMB.1.raw
tcagagactatactcacgaccggtgctcgatttagtgtcgtcgcaagagagaggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggtcatcttccaagataagaagcggccctcagggatccctgaccgaattctggctccaactctgggaacacagccactctgaccatcagcgggcccagccaacggatgaggagactactattgcaggcgtgggagaatactagttgtagtgtttggcggtaggaccgaggctgaccgtccgtaggtcagcccaaggcctcgcccctggtcactctgttccccg

SEQ ID NO: 166692 - DNA, 510 bp, Homo sapiens
  misc_feature: GYAE6OF02HA8R8.26.71.G05.1.454.CMB.1.raw
tcagagactatactcacgaccggtgctcgatttagtgtcgtcgcaagagagaggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctatttggtcatcttccaagataagaagcggccctcagggatccctgaccgaattctggctccaactctgggaacacagccactctgaccatcagcgggcccagccaacggatgagggagactactattgtcaggcgtgggagaatactattgtagtgtttggcggaggaccgaggctagaccgtcgtaggtccagcccaaggcctcgcccctcggtccactctcgttccccc

SEQ ID NO: 166693 - DNA, 510 bp, Homo sapiens
  misc_feature: GYAE6OF02ID64T.26.71.G05.1.454.CMB.1.raw
  modified_base (330)..(330): a, c, t, g, unknown or other
  misc_feature (330)..(330): n is a, c, g, or t
tcagagactatactcacgaccggtgctcgatttagtgtcgtcgcaagagagaggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctatttggtcatcttccaagataagaagcggccctcagggatccctgaccgaatttcnggctccaactctagggaacacagccactctgaccatcagcgggcccagccaacggatggaggagactacattgtcaggcgtagggagaatactattgtagtgtttggcggtagggaccaggctgacgtcgtagtcgagccaaggctacgcccctggtcaccgtctcgttcccacctcccg

SEQ ID NO: 166694 - DNA, 512 bp, Homo sapiens
  misc_feature: GYAE6OF02GVVRR.26.71.G05.1.454.CMB.1.raw
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggtcatcttccaagataagaagcggccctcagggatcctgaccgaattctggctccaactctgggaacacagccactctgaccatcagcgggcccagccaacggatggagggagactactattgtcaggcgtgggagaatactattgtagtgtttggcggaggaccaggctgaccgtcgtaggtcagcccaggcctcgccccgtcggtcacgttccgtgttcccccg

SEQ ID NO: 166695 - DNA, 528 bp, Homo sapiens
  misc_feature: GYAE6OF02F93RK.26.71.G05.1.454.CMB.1.raw
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggagatagaaatgctgcctggtattaccagaggccaggccagtcccctatttggtcatcttccaagataagaagcggccctcagggatccctgaccgaatttctggcctccaactcgtgggaaacacgagcccactctgaccatcacgcggggcccagccaacggatggagggagactactattgtacaggcgtgggagaatactagttgtagttgttggcggaggacgaggcgtcgaccgtcgtaggtcacggcccgaaggcctcgccccgtcggtccaccgttcgtcgttacccg

SEQ ID NO: 166696 - DNA, 302 bp, Homo sapiens
  misc_feature: GYAE6OF02HQ5OW.26.71.G05.1.454.CMB.1.raw
  modified_base (297)..(302): a, c, t, g, unknown or other
  misc_feature (297)..(302): n is a, c, g, or t
tcagagactatactcacgaccggtgctcgatttagtgtcgtcgcaagagagagggggccctcagggatccctgaccgaatttctggctccaactctgggaacacagccactctgaccatcagcgggcccagccaacggatgagggagactactattgtcaggcgtgggagaatactattgtagtgtttggcggagggaccaggctgaccgtcctaggtcagcccaaggctgccccctggtcactctgttcccgccctcctcagtatagtctctgagcgggctggcaaggcgcatagnnnnnn

SEQ ID NO: 166697 - DNA, 503 bp, Homo sapiens
  misc_feature: GYAE6OF02G3M04.26.71.G05.1.454.CMB.1.raw
  modified_base (355)..(355): a, c, t, g, unknown or other
  misc_feature (355)..(355): n is a, c, g, or t
tcagagactatactcacgaccggtgctcgatttagtgtcgtcgcaagagagaggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctatttggtcatcttccaagataagaagcggccctcaggggatccctgaccgaatttctggctccaactctgggaacncagccactctgaccatcagcgggcccagccaacggatgagggagactactattgtcaggcgtgggagaagtactattgtagtgttggcggagggaccaggctgaccgtccgtaggcagccaaggctgcccctcggtcactctgtcccc

SEQ ID NO: 166698 - DNA, 520 bp, Homo sapiens
  misc_feature: GYAE6OF02F0N1K.26.71.G05.1.454.CMB.1.raw
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggtcatcttccaagataagaagcggcctcagggatcccctgaccgaatttctggctccaactctgggaacacagccactctgaccatcagcgggcccagccaacggatgagggagactactattgtcaggcgtgggagaatactattgtagtgtttggcggagggaccaggctgaccgtcgtaggtcaggcccaaggcctcgcccccgtcggtccacctctcgttccccaccctcccg

SEQ ID NO: 166699 - DNA, 511 bp, Homo sapiens
  misc_feature: GYAE6OF02GFI9A.26.71.G05.1.454.CMB.1.raw
  modified_base (235)..(235): a, c, t, g, unknown or other
  misc_feature (235)..(235): n is a, c, g, or t
tcagagactatactcacgaccggtgctcgatttagtgtcgtcgcaagagagaggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctattttggtctatcttccaagataagaagcggccctcaggggatccctgaccgaatttctggctccaactctgggaacacagccactctgaccatcagcggggcccagccaacggatgagggagaactactattgtcaggcgtgggagaatactattgtagtgtttggcggaggacaggctgaccgtctaggtcagcccaaggctcgccccgtgtccactccgtgttaccccc

SEQ ID NO: 166700 - DNA, 780 bp, Homo sapiens
  misc_feature: GYAE6OF02JV4AY.26.71.G05.1.454.CMB.1.raw
  modified_base (243)..(243): a, c, t, g, unknown or other
  misc_feature (243)..(243): n is a, c, g, or t
  modified_base (382)..(382): a, c, t, g, unknown or other
  misc_feature (382)..(382): n is a, c, g, or t
tcagagactatactcacgaccggtgctcgatttagtgtcgtcgcaagagagaggggggcgtcgaggaagcagcatcggaggtgcctcagcccatggcatggtatccctctcttcctcggcgtccttgcttactgcacaggatccgtggccttcgatgagctgattcagccaccctcagtgtccgtgtcccccaggaccagacagcccaccatccacctgcctcggccagaccaaagttggganatagaaatgctagcctggtattaccagacgccaggccagtcccctagtttcggctatctacaagactaagagcggccctgaggtactccctagacccgtaatttaccgtggacctaccgaaccttcgtacgggaaaccncagcccacgtcctagacccagtaccacggtcccgggacccaggaccccgaaacgggacgttacggaacggggtaaccgtaaccggttaaccgtaagtttaccgggttaccgaacgggtaccgggttaacggggaaaccggtaaacggtttaacgttaacggttttacgggttaaacgggtttgggttttaacgggggaccgggggttaaacccgggggtacctaacgggggtaccgttaaccggggtaaccccggttaccgggttaacggtacccgggtaaccggtaacccccgggtaaggtaccccggttaccggtccccccccggttacgggtttaccccgaacccgtttcccggtttaacccccggttttcccccggacccccccgtttacccgg

SEQ ID NO: 166701 - DNA, 301 bp, Homo sapiens
  misc_feature: GYAE6OF02GKBWU.26.71.G05.1.454.CMB.1.raw
  modified_base (296)..(301): a, c, t, g, unknown or other
  misc_feature (296)..(301): n is a, c, g, or t
tcagagactatactcacgaccggtgctcgatttagtgtcgtcgcaagagagaggggccctcagggatccctgaccgaatttctggctccaactctgggaacacagccactctgaccatcagcgggcccagccaacggatgagggagactactattgtcaggcgtgggagaatactattgtagtgtttggcggagggaccaggctgaccgtcctaggtcagcccaaggctgccccctggtcactctgttcccgccctcctcagtatagtctctgagcgggctggcaaggcgcatagnnnnnn

SEQ ID NO: 166702 - DNA, 554 bp, Homo sapiens
  misc_feature: GYAE6OF02ILGL9.26.71.G05.1.454.CMB.1.raw
  modified_base (369)..(369): a, c, t, g, unknown or other
  misc_feature (369)..(369): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtcccccaggacagacagccaccatcacctgctcggcagacaaattgggagatagaaatgctgcctggtattaccagaggccaggccagtcccctattttggtcatcttccaagataagaagcggccctcgagggatccctgaccgtaattctggcctccaactctgggaacacagccactcngaccatcaggccggggcccaggcccaaacggactaggaacgggagacgtaactattgtcaggtcgtagggagaatacgtattggtagttggtttggacgggaggaccgaggccgtaggaccggtccgtagggtccacggcccaaggccctcggccccctcggtccaccttccgtgttccccccgg

SEQ ID NO: 166703 - DNA, 676 bp, Homo sapiens
  misc_feature: GYAE6OF02H6PAO.26.71.G05.1.454.CMB.1.raw
  modified_base (335)..(335): a, c, t, g, unknown or other
  misc_feature (335)..(335): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaatgctgcctggtacttaccagagccaggccagtcccttattcggtcatctaccaagataagaacgcgcctacgaggactcctagaccgtaatttcgngtctccaactcgtaggaacacgagccacttctacgacctatcgaacggccgggacccacgacccgaaacgggatgggaacgggacgtaacgttacttaagttcggtacgacgggtcggttaggggaaagtaaacgttaacgttaagtttacggttaggtttagggttttaggggccgggtaacggggtaaccgagggttaccgtacgggtaacccgttacccgtaacggggtaccgaaccggtaaccccgaacggggtccttacccggtacccccccgtttcgggtacccctaaccgtttcccggtttaccggtttcccccccggtaccctttacccccgg

SEQ ID NO: 166704 - DNA, 529 bp, Homo sapiens
  misc_feature: GYAE6OF02IP1O9.26.71.G05.1.454.CMB.1.raw
  modified_base (236)..(236): a, c, t, g, unknown or other
  misc_feature (236)..(236): n is a, c, g, or t
  modified_base (339)..(339): a, c, t, g, unknown or other
  misc_feature (339)..(339): n is a, c, g, or t
  modified_base (407)..(407): a, c, t, g, unknown or other
  misc_feature (407)..(407): n is a, c, g, or t
  modified_base (431)..(431): a, c, t, g, unknown or other
  misc_feature (431)..(431): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctattttggtcatcttccaagataagaagcggccctcagggatccctgaccgtaatttcgnggactccaaactcgtgggaaacacagccactctgaccatcagcgggcccagccaacggataggagganactactagttgcaggcgtaggganaagtactagttgtagtgtttggcggaggacaggctggaccgtcgtaggtcacggccctaaggcctacgccccgtggtccacgttccgtcgttcccccg

SEQ ID NO: 166705 - DNA, 513 bp, Homo sapiens
  misc_feature: GYAE6OF02GO02R.26.71.G05.1.454.CMB.1.raw
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggtcatcttccaagataagaagcggccctcaggggatccctgaccgaattctggctccaactctgggaacacagccactctgaccatcagcggggcccagccaacggatgagggagactactattgtcgaggcgtgggagaatacgtattgtagtgtttgcggaggaccaggctgaccgtcgtaggtcaggcccaaggctcgccccgtcggtccacgtcctgttcccc

SEQ ID NO: 166706 - DNA, 497 bp, Homo sapiens
  misc_feature: GYAE6OF02FIGJ8.26.71.G05.1.454.CMB.1.raw
tcagagactatactcacgaccggtgctcgatttagtgtcgtcgcaagagagaggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggtcatcttccaagataagaagcggccctcagggatccctgaccgaatttctggctccaactctgggaacacagccactctgaccatcagcgggcccagccaacggatgagggagactactattgtcagcgtgggagaatactattgtagtgtttggcgaggcaggctgacgtctaggtcagccaagctcgcccctcggtcactctgtccccg

SEQ ID NO: 166707 - DNA, 545 bp, Homo sapiens
  misc_feature: GYAE6OF02IXOUZ.26.71.G05.1.454.CMB.1.raw
  modified_base (307)..(307): a, c, t, g, unknown or other
  misc_feature (307)..(307): n is a, c, g, or t
  modified_base (315)..(315): a, c, t, g, unknown or other
  misc_feature (315)..(315): n is a, c, g, or t
  modified_base (326)..(326): a, c, t, g, unknown or other
  misc_feature (326)..(326): n is a, c, g, or t
  modified_base (356)..(356): a, c, t, g, unknown or other
  misc_feature (356)..(356): n is a, c, g, or t
tcagagactatactcacgaccggtgctcgatttagtgtcgtcgcaagagagaggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgactgcctggtattaccagaggccaggccagtcccctatttggcatcttccaagataagagcgcctnaggatccngacgtaattcncggctccaactctggaacacacgccactcncgaccatcagcgggacccagccaacggataggaggagactactagttgtacaggcgtagggagtaatactagttagtagtgtttggcggtagggtaccgaggacgtaggtaccgtacgtaggtaccgaggacccgaaggtccgtaccgccccgtacggtcctacctccgtccgttaccccaccttcccg

SEQ ID NO: 166708 - DNA, 525 bp, Homo sapiens
  misc_feature: GYAE6OF02GGUSC.26.71.G05.1.454.CMB.1.raw
tcagagactatactcacgaccggtgctcgatttagtgtcgtcgcaagagagaggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctatttggcatcttccaagataagaagcggccctcgagggactccctgaccgtaattctggctccaactctaggaacacagccactctgaccatcagcgggcccagccaacggatgagggagactactattgacaggcgtagggagagtactagttgtagttggtttggcggagggacaggctagaccgtccgtaggtccacgcccgaaggccgtcgcccccgttggtccacgtccgtcgttaccccc

SEQ ID NO: 166709 - DNA, 520 bp, Homo sapiens
  misc_feature: GYAE6OF02F7NR9.26.71.G05.1.454.CMB.1.raw
tcagagactatactcacgaccggtgctcgatttagtgtcgtcgcaagagagaggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctatttggtcatcttccaagataagaagcggccctcagggatcccctgaccgaatttctggctccaactctggaacacagccactctgaccatcagcgggccagccaacggatgagggagactactattgcaggcgtgggagaagtactagttgtagtgtttggcggtagggaccaggctgaccgtcgtacggtcgacgcccaaggcctcgcccctcggtccaccgtcctcgttccccaccctccc

SEQ ID NO: 166710 - DNA, 536 bp, Homo sapiens
  misc_feature: GYAE6OF02IVC6K.26.71.G05.1.454.CMB.1.raw
tcagagactatactcacgaccggtgctcgatttagtgtcgtcgcaagagagaggggggactcctgtgccccaccatggacacgctttgctccacgctcctgctgctgaccatcccttcatgggtcttgtcccagatcaccttgaaggagtctggtcctgcgctggtggagcccacgcagaccctcacgctgacctgctccgtctctggattctcactcaccacgactgaggtgaatgtggcctgggtccgtcaggcccccggaaaggcccctggagtggcttgcactcatttactggagtgatctcaagcggtacaatccgtctctgaggaatcgactcaccatcacaggacacctccaaagaccgggtgtccttaacatcgaccacatgaactcctgtggacacgaggcacatattactgtgcacacagtcctagcgctacgcgaagaaaagatatagactaggtggggacctaagggtaacttttcggtaccaccggttcctaccccgacgacccttacccgaccgtaaccggg

SEQ ID NO: 166711 - DNA, 503 bp, Homo sapiens
  misc_feature: GYAE6OF02IKQYP.26.71.G05.1.454.CMB.1.raw
  modified_base (231)..(231): a, c, t, g, unknown or other
  misc_feature (231)..(231): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctatttggtcatcttccaagataagaagcggccctcagggatccctgaccgaatttctggctccaactctgggaacacagccactctgaccatcagcgggcccagccaacggatgagggagactactattgtcaggcgtgggagaatactattgtagtgttggcggagggaccaggctgaccgtcaggtcagcccaaggcctgcccctggccactctcgtcccgcctccg

SEQ ID NO: 166712 - DNA, 522 bp, Homo sapiens
  misc_feature: GYAE6OF02GZL1D.26.71.G05.1.454.CMB.1.raw
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggtcatcttccaagataagaagcggccctcagggatccctgaccgatttctggctccaactctgggaacacagccactctgaccatcagcgggcccagccaacggatgagggagactactattgtcagggcgtgggagaatactattgtagtgtttggcggtagggaccgaggctgaccgtcctaggtcaggcccaaggcctcgccccctcggtccaccgtcctcgttccccgcccttcccg

SEQ ID NO: 166713 - DNA, 512 bp, Homo sapiens
  misc_feature: GYAE6OF02IF8RZ.26.71.G05.1.454.CMB.1.raw
  modified_base (388)..(388): a, c, t, g, unknown or other
  misc_feature (388)..(388): n is a, c, g, or t
  modified_base (506)..(506): a, c, t, g, unknown or other
  misc_feature (506)..(506): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctatttggtcatcttccaagataagagcggccctcagggatcccctgaccgaatttctggctccaactctgggaacacagccactctgaccatcagcgggcccagccaacggntgagggagactactattgtcaggcgtgggagaatactagttgtagtgtttggcggtagggaccgaggctgaccgtctaggtcagccaaggctcgcccctcggtcacgtctcgttcccncctccc

SEQ ID NO: 166714 - DNA, 540 bp, Homo sapiens
  misc_feature: GYAE6OF02G1IUA.26.71.G05.1.454.CMB.1.raw
  modified_base (235)..(235): a, c, t, g, unknown or other
  misc_feature (235)..(235): n is a, c, g, or t
  modified_base (313)..(313): a, c, t, g, unknown or other
  misc_feature (313)..(313): n is a, c, g, or t
  modified_base (336)..(336): a, c, t, g, unknown or other
  misc_feature (336)..(336): n is a, c, g, or t
  modified_base (392)..(392): a, c, t, g, unknown or other
  misc_feature (392)..(392): n is a, c, g, or t
  modified_base (422)..(422): a, c, t, g, unknown or other
  misc_feature (422)..(422): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaatggganatagaaatgctgcctggtattaccagaggccaggccagtcccctatttggtcatcttccaagataagaagcggccctnagggactccctgaccgaatttcnggcctccaactctgggaacacagccactctgaccatcagcgggcccagccaacggntgaggagactactattgtcaggcgtggganaatactattgtagttggtttggcgggtagggaccagggctacgaccggtaccgtaggtccacggcccgtaagggcctccggcccccgttcggtaccaccgttccgtccgttcccccgg

SEQ ID NO: 166715 - DNA, 515 bp, Homo sapiens
  misc_feature: GYAE6OF02HWE32.26.71.G05.1.454.CMB.1.raw
  modified_base (234)..(234): a, c, t, g, unknown or other
  misc_feature (234)..(234): n is a, c, g, or t
  modified_base (510)..(510): a, c, t, g, unknown or other
  misc_feature (510)..(510): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctattttggtcatctccaagataagaagcggccctcagggatcccgtgaccgaatttctggctccaactctagggaacacagccactctgaccatcagccgggcccagcccaacggatgagggagactactattgtcaggcgtgggagaatactattgtagtgtttggcggagggccaggcgtgaccgtctaggtcaggcccaaggcctcgcccctcggtccactctcgtcccncctcc

SEQ ID NO: 166716 - DNA, 748 bp, Homo sapiens
  misc_feature: GYAE6OF02JQ3YA.26.71.G05.1.454.CMB.1.raw
  modified_base (238)..(238): a, c, t, g, unknown or other
  misc_feature (238)..(238): n is a, c, g, or t
tcagagactatactcacgaccggtgctcgatttagtgtcgtcgcaagagagagggggcgtgggccgtcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccgagtaggccgaggccagtccccctattttcggtctatcttccaagataagaagcgccctcagggactcctgaacccgaatttccgtggtcctacctaactccgtagggaaaccacgaacgcccgaactccgtacgaacccataccgaacggtccgggggaccccaacggacccgaaacgggaccttagggaacggggacaaccgttaccttaagttcgtaccgaagggtaccggtaggggtaacgtaaacgttaccgttaagtttacgggttaaaggtttcgggttttacggggtaaccggggtaaacggggtaaccgtaacgggggtacccgttacggtaacccgggtttacccgtaacggggtttaccgtaaccgggtaaccccccgtaaaggggtcccccggttaacccgggtcccccccccggttacgggggtttaaccccctaaccggtttccccggttacccggttttaacccccccccg

SEQ ID NO: 166717 - DNA, 504 bp, Homo sapiens
  misc_feature: GYAE6OF02ILUH2.26.71.G05.1.454.CMB.1.raw
  modified_base (231)..(231): a, c, t, g, unknown or other
  misc_feature (231)..(231): n is a, c, g, or t
  modified_base (332)..(332): a, c, t, g, unknown or other
  misc_feature (332)..(332): n is a, c, g, or t
  modified_base (396)..(396): a, c, t, g, unknown or other
  misc_feature (396)..(396): n is a, c, g, or t
  modified_base (486)..(486): a, c, t, g, unknown or other
  misc_feature (486)..(486): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctatttggtcatcttccaagataagaagcggccctcagggactccctgaccgaatttcnggctccaactctggaacacagccaactctgaccatcagccgggcccagccaacggatgaggganactactattgtcaggcgtgggagaatactagttgtagtgtttggcggagggcaggctgaccgtctaggcagccaggctcgcccgtcggcncgtctcgtcccgcctccg

SEQ ID NO: 166718 - DNA, 511 bp, Homo sapiens
  misc_feature: GYAE6OF02JG5EX.26.71.G05.1.454.CMB.1.raw
  modified_base (314)..(314): a, c, t, g, unknown or other
  misc_feature (314)..(314): n is a, c, g, or t
  modified_base (367)..(367): a, c, t, g, unknown or other
  misc_feature (367)..(367): n is a, c, g, or t
  modified_base (393)..(393): a, c, t, g, unknown or other
  misc_feature (393)..(393): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggagatagaaatgctgcctggtattaccagaggccaggccagtcccctattttggtcatcttccaagataagaagcggccctnagggatccctgaccgtaattctggcctccaaactctgggaacacagccactcngaccatcagcgggcccagcccaaggntggagggagactactattgtcaggcgtgggagaatactattgtagtgtttggcggaggaccaggctgaccgtcgtaggtcagcccaggctcgcccctggtccacgtcctcgttacccc

SEQ ID NO: 166719 - DNA, 506 bp, Homo sapiens
  misc_feature: GYAE6OF02HNNO6.26.71.G05.1.454.CMB.1.raw
  modified_base (312)..(312): a, c, t, g, unknown or other
  misc_feature (312)..(312): n is a, c, g, or t
  modified_base (428)..(428): a, c, t, g, unknown or other
  misc_feature (428)..(428): n is a, c, g, or t
tcagagactatactcacgaccggtgctcgatttagtgtcgtcgcaagagagaggggcgtggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggtcatcttccaagataagaagcgcctnaggatccctgaccgaattctggctccaactctagggaacacgagccactctcgaccatccgagccggggcccagcccgaacggatggagggacgactactattgcaggcgtggganaatactatgtagtgttggcggaggacagctgaccgtcgtaggtcagccaagctcgccccgtgtccactctcgtccccg

SEQ ID NO: 166720 - DNA, 666 bp, Homo sapiens
  misc_feature: GYAE6OF02HPEQ7.26.71.G05.1.454.CMB.1.raw
  modified_base (234)..(234): a, c, t, g, unknown or other
  misc_feature (234)..(234): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaagtgganatagaatgctgctggtataccagagccaggccacgtccctagtttgtctatctacaagataagacgccgcctcgaggtactccgtagtaccgtattcgcggtcctaccgaacgtcgtacgggaaccacgacgcctactctacgaccagtccggacgggcccgggacccacggacccgaaacggacgtacgggaacgggtaactaaccgttaacgttacgtcggtaccggaagggtcggtaagggtaaataacgtttacgttaggtttacgggttaggtttacgggtttacggggacgggtaacgggtaccggtacgggtcgttaccgggtaccggttaccggtacggtaccgtaccggacccggtaacggtcccgtacccggtcccccggttacgttaccccgtacccgttcccgttcccggttaccccccg

SEQ ID NO: 166721 - DNA, 552 bp, Homo sapiens
  misc_feature: GYAE6OF02IYJUK.26.71.G05.1.454.CMB.1.raw
  modified_base (234)..(234): a, c, t, g, unknown or other
  misc_feature (234)..(234): n is a, c, g, or t
  modified_base (355)..(355): a, c, t, g, unknown or other
  misc_feature (355)..(355): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctattttggtcagtcttccaagactaagaagcggccctcagggatccctgaccgaatttctggctccaactctggaacncagccactctgaccatcacgcgggcccagcccaacggatggagggagactactattgcaggcgtgggagaatacgtattcgtagttgttttgggacggtagggaccgtaggccgttggacccgtccgtagggtccgaggtaccccgaaggccgtcgacccccgtcggtccacctcgtcgttccccaccccgttaccc

SEQ ID NO: 166722 - DNA, 506 bp, Homo sapiens
  misc_feature: GYAE6OF02HVPFV.26.71.G05.1.454.CMB.1.raw
  modified_base (336)..(336): a, c, t, g, unknown or other
  misc_feature (336)..(336): n is a, c, g, or t
  modified_base (390)..(390): a, c, t, g, unknown or other
  misc_feature (390)..(390): n is a, c, g, or t
  modified_base (395)..(395): a, c, t, g, unknown or other
  misc_feature (395)..(395): n is a, c, g, or t
tcagagactatactcacgaccggtgctcgatttagtgtcgtcgcaagagagaggggcgtggccgtcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctatttggtcatcttccaagataagaagtcggccctcagggatcctgaccgaatttcnggctccaactctgggaacacagccactctgaccatcagcgggccagccaacgangaggnactactattgtcaggcgtgggagaatactagtgtagttgtttggcggtaggaccaggctgaccgtcgtaaggtcagcccaaggcgtacgcccctggtccactctgtacccc

SEQ ID NO: 166723 - DNA, 521 bp, Homo sapiens
  misc_feature: GYAE6OF02GM4LC.26.71.G05.1.454.CMB.1.raw
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggtcatcttccaagataagaagcggccctcagggatccctgaccgaattctggctccaactctgggaacacagccactctgaccatcagcgggcccagccaacggatggagggagactaactattgtcgaggcgtgggagaagtactagttgtagtgtttgggcggagggaccaggctggaccgtccgtaggtcaggccaaggctacgcccccgtcggtccactcgtgttcccccg

SEQ ID NO: 166724 - DNA, 545 bp, Homo sapiens
  misc_feature: GYAE6OF02GB7FB.26.71.G05.1.454.CMB.1.raw
  modified_base (410)..(410): a, c, t, g, unknown or other
  misc_feature (410)..(410): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggtcatctccaagataagaagcggccctcgagggactcccgtagaccgtaattcgtggcctccaactcgtaggaacacagccactctgaccatcagccggggcccaggccaacggatggaggganactactattcgtcgaggcgtgggagaatacgtattgtagttggtttggacggtagggaccgaggcgtgaccgtcgtaggtccgacgcccgaaggcctccggcccccgtcggtccaccgttccgtccgttaccccc

SEQ ID NO: 166725 - DNA, 618 bp, Homo sapiens
  misc_feature: GYAE6OF02IUI59.26.71.G05.1.454.CMB.1.raw
  modified_base (241)..(241): a, c, t, g, unknown or other
  misc_feature (241)..(241): n is a, c, g, or t
  modified_base (466)..(466): a, c, t, g, unknown or other
  misc_feature (466)..(466): n is a, c, g, or t
tcagagactatactcacgaccggtgctcgatttagtgtcgtcgcaagagagaggggcgtgggccgtcgaggaagcgagcatcggaggtgcctcagccatggcatggatccctctcttcctcggcgtccttgcttactgcacaggatccgtggccttcgatgagctgattcagccaccctcagtgtccgtgtcccccaggacagacacgccaccatccacctgctcggcagacaagttgganataagaatgactgcctggtattaccgagaggccaggccacgtccccttagtttggtcactcttaccaagataaaggaacgccggccctagaagggtactaccccgttaggaacccgtaattttcgacggtaccttacccgtaaactcggttagggaaacctacgaacgccctaaacttccgagaccctacgtaccgacgaccggggaccccacgccgaaaccggngtacggaacgggacgaaccgttacgtaattgaccgaggcggtagggagtaacgtaacttagttgtagtggtttacggcggtaggccgagcgtagaccgtcgaggtcacggaccgaaggcctacgcccgtcgtacacgtacgtccttaccccg

SEQ ID NO: 166726 - DNA, 537 bp, Homo sapiens
  misc_feature: GYAE6OF02GKGD8.26.71.G05.1.454.CMB.1.raw
  modified_base (520)..(520): a, c, t, g, unknown or other
  misc_feature (520)..(520): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggtcatcttccaagataagaagcggccctcagggactccctgaccgtaatttcctggctccaactctagggaacacagccactcctagaccatcagccgggcccagccaacggatcggagggacgactactattgtcgaggtcgtagggagaatacgtagttgtagttggtttggcggagggaccgaggctgaccgtcgtaggtcacggcccaaggccgtcgccccgtcggtccncgtccgtcgttcccccg

SEQ ID NO: 166727 - DNA, 552 bp, Homo sapiens
  misc_feature: GYAE6OF02F4NHI.26.71.G05.1.454.CMB.1.raw
  modified_base (233)..(233): a, c, t, g, unknown or other
  misc_feature (233)..(233): n is a, c, g, or t
  modified_base (366)..(366): a, c, t, g, unknown or other
  misc_feature (366)..(366): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctattttggtcatcttccaagataagaagccggccctcagggatccctgaccgtaatttctggctccaactctgggaacacacgccactcncgaccatccagcgggcccacgcccgaacggagtaggagggacgacgtactagttgtcgaggcgtagggagaatacgtattgtagtgtttggcggtagggaccgaggcgtgaccgtcgtacggtacgacgacccgaacggcctacgcccccgtcggtccaccgtccgtccgttccctacccctcccg

SEQ ID NO: 166728 - DNA, 507 bp, Homo sapiens
  misc_feature: GYAE6OF02HNI89.26.71.G05.1.454.CMB.1.raw
  modified_base (399)..(399): a, c, t, g, unknown or other
  misc_feature (399)..(399): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaaatgctgcctggtattaccagaggccaggccagtcccctattttggtcatcttccaagataagaagcggccctcagggatcctgaccgaattctggctcaactctgggaacacagccactctgaccatcagcgggcccagccaacggatggaggganactactattgtcaggcggtagggagaagtactagtgtagtgtttggcggaggacgagcgtgaccgtccgaggtcacgccaggctcgcccctgtccactctcgtccccg

SEQ ID NO: 166729 - DNA, 509 bp, Homo sapiens
  misc_feature: GYAE6OF02F3WT9.26.71.G05.1.454.CMB.1.raw
  modified_base (236)..(236): a, c, t, g, unknown or other
  misc_feature (236)..(236): n is a, c, g, or t
  modified_base (447)..(447): a, c, t, g, unknown or other
  misc_feature (447)..(447): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctatttggtcatcttccaagataagaagcggccctcgaggactcccgtgaccgaatttctggctccaactctgggaacacagccactctcgaccatcagccgggcccagccaacggatggagggagactaactattgcaggcgtgggagaatactattgtagtgttggnggacggcaggctgaccgtcgtaggcacgcccaaggctcgcccctcggccacgtctcgtcccc

SEQ ID NO: 166730 - DNA, 672 bp, Homo sapiens
  misc_feature: GYAE6OF02HYQSW.26.71.G05.1.454.CMB.1.raw
  modified_base (304)..(304): a, c, t, g, unknown or other
  misc_feature (304)..(304): n is a, c, g, or t
tcagagactatactcacgaccggtgctcgatttagtgtcgtcgcaagagagaggggggccgtcgaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgactgcctggtattaccagaggccaggccagtcccctatttggtcatctcaagactaagaancggcctcgagggtatcccctagaccgtaaatttcgaggcctaccaaactcgtagggaacaaccagtacccactctacgaaccaattccgaaggccggggccccaacggccccgaaaaccgggagtacggaaggggaaacggacgttaaaccgttaagttacggttaccgaagggtccggtaggggtaacgaaagttactaaagtttagtacgttaggtttgggacggttaaggggacccgtaagggaccgttaggcccggtacccgttagggttaccaacggttacccgaacgggtccgtacccggcccccggttcgggtacccgtaccgttacccgttccggttaccccccggtccccttaccccgg

SEQ ID NO: 166731 - DNA, 526 bp, Homo sapiens
  misc_feature: GYAE6OF02GW0NQ.26.71.G05.1.454.CMB.1.raw
  modified_base (422)..(422): a, c, t, g, unknown or other
  misc_feature (422)..(422): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggtcatcttccaagataagaagcggccctcagggatccctgaccgaattctggctccaactctgggaacacagccactctgaccatcagcgggcccagccaacggatggagggagactactattgcaggcgtggganaagtactattagtagtgttggcggaggaccgaggctgaccggtccgtaggtccgacgacccgaaggccgtccgccccgtcggtccacgttccgtcgttaccccc

SEQ ID NO: 166732 - DNA, 511 bp, Homo sapiens
  misc_feature: GYAE6OF02G9AV7.26.71.G05.1.454.CMB.1.raw
  modified_base (381)..(381): a, c, t, g, unknown or other
  misc_feature (381)..(381): n is a, c, g, or t
tcagagactatactcacgaccggtgctcgatttagtgtcgtcgcaagagagaggggggactcctgtgccccaccatggacacgctttgctccacgctcctgctgctgaccatcccttcatgggtcttgtcccagatcaccttgaaggagtctggtcctgcgctggtggagcccacgcagaccctcacgctgacctgctccgtctctggattctcactcaccacgactgaggtgaatgtggcctgggtccgtcaggcccccggaaaggccctggagtggcttgcactcatttactggagtgatctcaagcggtacatccgtctctgaggatcgactcaccatcacaggacacctcaaagccgggtgtccttacatgaccganatgaatcctgtgacacaggcacatatactgtgcacacagtcctagccggctacgcgacgaaaagatatagatagtcggggaccagggtaattttcggctaccgtctccccgagccctaccaccgaaccgg

SEQ ID NO: 166733 - DNA, 531 bp, Homo sapiens
  misc_feature: GYAE6OF02G7AB2.26.71.G05.1.454.CMB.1.raw
tcagagactatactcacgaccggtgctcgatttagtgtcgtcgcaagagagaggggggactcctgtgccccaccatggacacgctttgctccacgctcctgctgctgaccatcccttcatgggtcttgtcccagatcaccttgaaggagtctggtcctgcgctggtggagcccacgcagaccctcacgctgacctgctccgtctctggattctcactcaccacgactgaggtgaatgtggcctgggtccgtcaggcccccggaaaggccctggagtggcttgcactcatttactggagtgatctcaagcggtacaatccgtctctgagatcgactcaccatcaccgaggacacctaccaaagaccgggtgtcctacaatcgaccgacatgaactcctgtcgacacgaggcacatattactgtcgcacacacgtcctagcggactacgacgaagaaaagatatagactagttggggaccagggtattttcggactaccgtcctaccccgagtccctaccgaccgtaaccggg

SEQ ID NO: 166734 - DNA, 512 bp, Homo sapiens
  misc_feature: GYAE6OF02HFQ5D.26.71.G05.1.454.CMB.1.raw
  modified_base (234)..(234): a, c, t, g, unknown or other
  misc_feature (234)..(234): n is a, c, g, or t
  modified_base (499)..(499): a, c, t, g, unknown or other
  misc_feature (499)..(499): n is a, c, g, or t
tcagagactatactcacgaccggtgctcgatttagtgtcgtcgcaagagagaggtgggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctattttggcatcatccaagataagaagcggccctcgagggactcctgaccgaatttctggctccaactctaggaacacgagccactctgaccatcaggccgggacccagccaacggatggagggagactactagttgtcgaggcgtggagaatactagttgtagttgtttggcggaggaccgaggctgaccgtcgtaggtccagcccaggctcgccctggcnctcgtcgtccccg

SEQ ID NO: 166735 - DNA, 683 bp, Homo sapiens
  misc_feature: GYAE6OF02HRRKC.26.71.G05.1.454.CMB.1.raw
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggtcatcttaccaagataagaagcggccctacagggactccctgaccgaatttctggctccaactcctagggaacacagccactctgaccatcacgccggggcccaggaccgaacgggactagggaacgggagaaccttacgtaatttcggtacgacgggtccggtaggggaacggtaaattaaccgttaagtttacggttaggttgggtttttacggggaccggggtaacggggtaacccggtacgggacccgttacgggtaaccccggttccgttaacggggttacccgaaccgggtacccccgaaaggggtcccgttacccgggtacccccccgttaccgggttaccctaacccgttcccgtttccggtttacccccccggtcccccgttaccccgg

SEQ ID NO: 166736 - DNA, 526 bp, Homo sapiens
  misc_feature: GYAE6OF02GG1AR.26.71.G05.1.454.CMB.1.raw
  modified_base (236)..(236): a, c, t, g, unknown or other
  misc_feature (236)..(236): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctattttggtcatcttccaagataagaagcggccctcagggatccctgaccgaattctggctccaactctgggaacacagccactctgaccatcagcgggcccagccaacggatgagggagactactattgtcaggcgtagggagaatactagttgtagttgtttggcggaggaccaggcgtgaccgtcgtaggtcacggcccgaaggcctcggcccccgttcggtccaccgttccgtcgttcccccg

SEQ ID NO: 166737 - DNA, 508 bp, Homo sapiens
  misc_feature: GYAE6OF02IMF8F.26.71.G05.1.454.CMB.1.raw
  modified_base (369)..(369): a, c, t, g, unknown or other
  misc_feature (369)..(369): n is a, c, g, or t
  modified_base (452)..(452): a, c, t, g, unknown or other
  misc_feature (452)..(452): n is a, c, g, or t
  modified_base (478)..(478): a, c, t, g, unknown or other
  misc_feature (478)..(478): n is a, c, g, or t
  modified_base (503)..(503): a, c, t, g, unknown or other
  misc_feature (503)..(503): n is a, c, g, or t
tcagagactatactcacgaccggtgctcgatttagtgtcgtcgcaagagagaggggtccatgccatggcatggatccctctcttcctcggcgtccttgcttactgcacaggatccgtggccttcgatgagctgattcagccaccctcagtgtccgtgtcccccaggacagacagccaccatcacctgctcggcagacaaaattgggagatagaaatgctgcctggtattaccagaggccaggccagtcccctattttggcatcttccaagataagaagcggccctcagggatcctgaccgaatttctggctccaactctgggaacacagccactctgaccatcagcgggccagccaacggatgaggganactactatgtcaagggcgtagggagaatactagttgtagttgtttggcggagggacaggcgtgaccgtctaggcagccaagcngccctgtcactctcgtcccacctccnctacgtatacgtctctgacgtcggntacgg

SEQ ID NO: 166738 - DNA, 546 bp, Homo sapiens
  misc_feature: GYAE6OF02FLLJK.26.71.G05.1.454.CMB.1.raw
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaatgctgcctggtattaccagaggccaggccagtcccctattttggtcatcttccaagataagaagcggccctcagggatccctagaccgtaatttctggctccaactcgtggaacacagccactctgaccatcgacggccgggcccagcccgaacggatggacgggagactactattcgcaggcgtgggagaatactattgtagtgtttggcggagggaccgaggcgtcggaccgttccgtaggtcacggtcccgaagggcctccggccccctcgggtccaccgttcgtcccggttcccgccccttcccg

SEQ ID NO: 166739 - DNA, 672 bp, Homo sapiens
  misc_feature: GYAE6OF02I3CBX.26.71.G05.1.454.CMB.1.raw
  modified_base (231)..(231): a, c, t, g, unknown or other
  misc_feature (231)..(231): n is a, c, g, or t
  modified_base (301)..(301): a, c, t, g, unknown or other
  misc_feature (301)..(301): n is a, c, g, or t
  modified_base (310)..(310): a, c, t, g, unknown or other
  misc_feature (310)..(310): n is a, c, g, or t
  modified_base (322)..(322): a, c, t, g, unknown or other
  misc_feature (322)..(322): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcactgctcggcagacaatggganatagaatgctgcctggtattaccagaggccaggccagtcccctatttggctatctcagatagagcgcctnaggatccgngaccgaatttcnggctaccaactcgtacggaacacgacgaccctacgtcctagaaccctataccgacggacccgggggacccaacggacccgaaacgggacgtacgggaagggaacggtaaccttaacgttaacgtttcgggtacgacggggtaccggtaggggaactaaagttaaaccgttagtttaggttaaggttacgggttttacgggacggggtaacgggtaacccgtaagggtcgttaacggtaacccgtaccggttagggtcccgaaacggacccccgaaaggtcccgttacccggtccccccgttacgggtccctaccgttccgttcccgggttacccccgtccccgttacccg

SEQ ID NO: 166740 - DNA, 677 bp, Homo sapiens
  misc_feature: GYAE6OF02FR2C3.26.71.G05.1.454.CMB.1.raw
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaatgctgcctggtattaccagaggccaggccacgtccccttattttcggctatcttaccaagataagagccgcctgagggactcccgtagaccgtaatttcgtggctaccaactcgtagggaacacgacgccactctacgaccatccgacggtccggggaccccacggacccgaaacgggagtagggaacggggaacgtaacctaacgttaagttacggtaccgtagggccggtaggggaagtaaacgttaacgttaagtttagggttaaggtttggttttacggggacgggtaacggggtaaccgacgggtcgttaccggtacccggttaccgtacgggtccgaaccggtaccccgaacgggtcccgtcccggtccccccggttacggttaccctaacccgtttcccggtaccggtttccccccggccccttaccccg

SEQ ID NO: 166741 - DNA, 518 bp, Homo sapiens
  misc_feature: GYAE6OF02H3GNR.26.71.G05.1.454.CMB.1.raw
  modified_base (231)..(231): a, c, t, g, unknown or other
  misc_feature (231)..(231): n is a, c, g, or t
  modified_base (332)..(332): a, c, t, g, unknown or other
  misc_feature (332)..(332): n is a, c, g, or t
  modified_base (451)..(451): a, c, t, g, unknown or other
  misc_feature (451)..(451): n is a, c, g, or t
  modified_base (459)..(459): a, c, t, g, unknown or other
  misc_feature (459)..(459): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcgtcagacaaattggganatagaaatgctgcctggtattaccagaggccaggccagtcccctatttggtcatcttccaagataagaagcggccctcagggatcccctgaccgaatttcnggctccaactctgggaacacagccactctgaccatcagccgggcccagccaacggatgagggagactactattgtcaggcgtgggagaatactagtgtagtgttggcggaggacaggcngaccgtcnggtcagcccgaaggcctcgcccccgtcggtccaccttccgtcgttccccgccctacccg

SEQ ID NO: 166742 - DNA, 637 bp, Homo sapiens
  misc_feature: GYAE6OF02J3KW8.26.71.G05.1.454.CMB.1.raw
  modified_base (242)..(242): a, c, t, g, unknown or other
  misc_feature (242)..(242): n is a, c, g, or t
  modified_base (336)..(336): a, c, t, g, unknown or other
  misc_feature (336)..(336): n is a, c, g, or t
  modified_base (357)..(357): a, c, t, g, unknown or other
  misc_feature (357)..(357): n is a, c, g, or t
  modified_base (366)..(366): a, c, t, g, unknown or other
  misc_feature (366)..(366): n is a, c, g, or t
tcagagactatactcacgaccggtgctcgatttagtgtcgtcgcaagagagaggggctgggcctcaggaagcagcatcggaggtgcctcagccatggcatggatccctctcttcctcggcgtccttgcttactgcacaggatccgtggccttcgatgagctgattcagcccaccctcagttgtcccgtgtccccaggacagacacgccaccatccacctgcctcggcagacaaagttggganatagaatgctgctaggtactaccgagacggccaggccacgtccctatttgcatctacaagataagagcgcctgaggctccgtgaccgtattcgngtctaccactcgtaggacacncgccactcncgaccagtaacggccgggtacccacgaccgaacggagtacggaacgggtacgtacgttaacgttagttcgtaccgtagggtacggtagggaacgtaacgttaccgttagtttggttaacggttggtttacgggaacggggtacgggtaacccgaggggtccgtaccggtacccgtacccggttacgggcccgtaccggacccgaaacgggtccgtacccgtcccccgtccgggtaacctccgttacccgttaccgtcccccttaaccccgg

SEQ ID NO: 166743 - DNA, 557 bp, Homo sapiens
  misc_feature: GYAE6OF02HV85N.26.71.G05.1.454.CMB.1.raw
  modified_base (236)..(236): a, c, t, g, unknown or other
  misc_feature (236)..(236): n is a, c, g, or t
  modified_base (369)..(369): a, c, t, g, unknown or other
  misc_feature (369)..(369): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggaccagacagccaccatcacctgctcggcagacaaatggganatagaaatgctgcctggattaccagaggccaggccagtcccctatttggtcatcttccaagactaagaagccggccctcagggactccctgaccgaatttctggcctccaactcgtgggaacacagccactcncgaccatcgacgccgggcccagcccaacggactcggaagggacgacttactagttcgtacgagggccgttgggaagtaagtacttagttgttagtgtttgggacgggtaggaccgaggctggtaccgtccgtaggtccacggacccaaggtcctcggcccccgtggtccacgttccgtcgttcccccg

SEQ ID NO: 166744 - DNA, 532 bp, Homo sapiens
  misc_feature: GYAE6OF02ILL8H.26.71.G05.1.454.CMB.1.raw
  modified_base (397)..(397): a, c, t, g, unknown or other
  misc_feature (397)..(397): n is a, c, g, or t
  modified_base (421)..(421): a, c, t, g, unknown or other
  misc_feature (421)..(421): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggtcatcttccaagataagagcggccctcagggactccctgaccgaatttctggctccaactctggaacacagccactctgaccatcagcgggcccagccaacggatgaggganactactagttgtcaggcgtggganaagtactagttagtagtgtttggcggagggaccgaggctgaccgtcgtaggtcgagacccgaaggtcctcggcccccgtcggtcctaccgtctccgttccccaccctcccg

SEQ ID NO: 166745 - DNA, 535 bp, Homo sapiens
  misc_feature: GYAE6OF02HCLKB.26.71.G05.1.454.CMB.1.raw
  modified_base (393)..(393): a, c, t, g, unknown or other
  misc_feature (393)..(393): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggtcatcttccaagataagaagcggccctcagggatcccctgaccgaatttctggctccaactctagggaacacagccactctgaccatcacggccgggcccagcccaacggntgagggagactactattgtcgaggcgtagggagaatacgtagttgtagtgtttggcggtagggacaggcgtgaccgtcgtaggtcgacggcccaaggcctcgcccccgtcggtccaccttccgtccgttccccgccctcccg

SEQ ID NO: 166746 - DNA, 655 bp, Homo sapiens
  misc_feature: GYAE6OF02JA397.26.71.G05.1.454.CMB.1.raw
  modified_base (339)..(339): a, c, t, g, unknown or other
  misc_feature (339)..(339): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtaattaccagacggccaggccagtcccctatttggcatcttccaagataagaagcggcctcgagggactcccgtagaccgtaatttcgnggcctcaactctacgggaacacgacgccaactctacgaccatcgacggccgggtacccacgacccgaaacgggactcggaacgggacgaaccgttactaacgttcgtacggaacggtaccggtaggggaactaaagttaacgttagttacgggttacgttaggttttacgggacgggtaacgggtacccgtagggtaccgtacggtaacccggtaccgttacgggtaccaccggtaacccgaacggtaccgtcccggtacccccggtcggtacctaacccgttccgtttaacccgttccccgtaaccccgttcccg

SEQ ID NO: 166747 - DNA, 657 bp, Homo sapiens
  misc_feature: GYAE6OF02FP03X.26.71.G05.1.454.CMB.1.raw
tcagagactatactcacgaccggtgctcgatttagtgtcgtcgcaagagagagggggctgggcctcaggaagcagcatcggaggtgcctcagccatggcatggatccctctcttcctcggcgtccttgccttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctatttggcatcttacaagataagagcggccctcagggactcccgtgaccgtaatttccgtggcctaccaactcgtagggaacacacgcccactctacgaccatcgaggccgggccccaggaccaacggactaggagggacgacttaacgtagtttcgtcgagggccgtagggaagtaacgttaacgttagtttaggtaaggtttggtttaggggaccggggtaacgggacccgtaggggtaccgtacgggtacccggtttacccggtaacggggtccgaaccgggtaccccggtaaacgggtcccgttacccgggtaccccccccggttaccgggttaccccgtaacccgttcccgttaccggtttacccccccccg

SEQ ID NO: 166748 - DNA, 571 bp, Homo sapiens
  misc_feature: GYAE6OF02I1ADX.26.71.G05.1.454.CMB.1.raw
  modified_base (185)..(185): a, c, t, g, unknown or other
  misc_feature (185)..(185): n is a, c, g, or t
  modified_base (297)..(297): a, c, t, g, unknown or other
  misc_feature (297)..(297): n is a, c, g, or t
  modified_base (327)..(327): a, c, t, g, unknown or other
  misc_feature (327)..(327): n is a, c, g, or t
  modified_base (432)..(432): a, c, t, g, unknown or other
  misc_feature (432)..(432): n is a, c, g, or t
  modified_base (443)..(443): a, c, t, g, unknown or other
  misc_feature (443)..(443): n is a, c, g, or t
tcagagactatactcacgaccggtgctcgatttagtgtcgtcgcaagagagagggggacgtcctgtgccccaccatggacacgctttgctccacgctcctgctgctgaccatcccttcatgggtcttgtcccagatcaccttgaaggagtctggtcctgcgctggtggagcccacgcagaccctnacgctgacctgctccgtctctggattctcactcaccacgactgaggtgaatgtggcctgggtccgtcgacggcccccggaaaggccctggacgtggcttgcactcatttacnggagtgatctcaagcggtacatccgtctcngaggaatcgactcaccatcacaggacacctacaaaggaccgggtggtcccttaacgaactcgaaccgacattagaaacttcctagtacggacacgaggtaccaanacttattaccngtcactacactacgtcctagcgactacgacgaaagaaagatatagaacttagtcgggacctagggtaacttttacgggtacctaaccggtcctaccccgtaggtaccccttacccgaaccgaaccggg

SEQ ID NO: 166749 - DNA, 686 bp, Homo sapiens
  misc_feature: GYAE6OF02GGEVF.26.71.G05.1.454.CMB.1.raw
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagacggccacggccagtcccctagttttcggtcacttcttccaagtataagaacgcggccctcgagggactcccgtagaccgtaatttcgtggcctaccaactcgtacgggaacacacgaccactctacgaccataccgacggccggggaccccacggacccgaaacgggacgtagggaacggggacgtaaccgttacgtaagtttcgacgtacgggcggttaggggaacgtaaacgttacgttagtttaggttaaggtttggtttacggggacgggtaacggggtacccgtaaggggtcccgttacggtacccggttaccggtaacgggttaccaaccgggtaccccggaaacgggtcccgttacccggtcccccccgttaccgggttaccctacccggtttacccgtcccgtttacccccccgg

SEQ ID NO: 166750 - DNA, 507 bp, Homo sapiens
  misc_feature: GYAE6OF02JCG1B.26.71.G05.1.454.CMB.1.raw
  modified_base (493)..(493): a, c, t, g, unknown or other
  misc_feature (493)..(493): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtcgtccgtgtccccaggacagacagccaccatcacctgctcggcagacaaattgggagatagaaatgctgcctggtattaccagaggccaggccaggtcccctattttggcatcttccaagataagaagcgggccctacagggatccctgaccgaatttctggctccaactctgggaacacagcccactctgaccatcagcgggcccagccaacggatgagggagactactagttgtcaggcgtgggagatacattgtagtgttggcgagggacaggctgacgtcaggtcagccaaggcctgcccctcgtcacctcncgttcccgcctccg

SEQ ID NO: 166751 - DNA, 539 bp, Homo sapiens
  misc_feature: GYAE6OF02I6JBB.26.71.G05.1.454.CMB.1.raw
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggtcatcttccaagataagaagcggcccctcagggatccccgtgaccgaatttctggctccaactctgggaacacagccactctgaccatcacgcgggcccagccaacggatggagggagactactattgcgaggcgtgggagatacgtattgtagtgtttgggcggtacgggacgaggtcgtcgaccgtctaggtcgacggcccgaaggcctcggcccccgttcggtcctaccgtctcgttaccgtcctaccccg

SEQ ID NO: 166752 - DNA, 536 bp, Homo sapiens
  misc_feature: GYAE6OF02IXFQE.26.71.G05.1.454.CMB.1.raw
  modified_base (234)..(234): a, c, t, g, unknown or other
  misc_feature (234)..(234): n is a, c, g, or t
  modified_base (402)..(402): a, c, t, g, unknown or other
  misc_feature (402)..(402): n is a, c, g, or t
  modified_base (425)..(425): a, c, t, g, unknown or other
  misc_feature (425)..(425): n is a, c, g, or t
  modified_base (456)..(456): a, c, t, g, unknown or other
  misc_feature (456)..(456): n is a, c, g, or t
  modified_base (526)..(526): a, c, t, g, unknown or other
  misc_feature (526)..(526): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctattttggtcatcttccaagataagaagcggccctcagggatcccgtgaccgtaatttctggctccaactctgggaacacagccactctgaccatcagcgggcccagcccgaaggatggaggganactactattgtcaggcgtggganaatactatagtagtgttggcggtagggaccnggctgaccgtccgtaggtcgagcccgaaggccgtccgccccgtcggtccaccgttccgtccggttccccncccgttcccg

SEQ ID NO: 166753 - DNA, 520 bp, Homo sapiens
  misc_feature: GYAE6OF02GPR67.26.71.G05.1.454.CMB.1.raw
  modified_base (316)..(316): a, c, t, g, unknown or other
  misc_feature (316)..(316): n is a, c, g, or t
  modified_base (338)..(338): a, c, t, g, unknown or other
  misc_feature (338)..(338): n is a, c, g, or t
  modified_base (350)..(350): a, c, t, g, unknown or other
  misc_feature (350)..(350): n is a, c, g, or t
  modified_base (425)..(425): a, c, t, g, unknown or other
  misc_feature (425)..(425): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggtcatccttccaagataagaagcggccctnagggatccctgaccgaatttcnggctccaactcnggaacacagccactctgaccatcagcgggcccagccaacggatggagggacgactactattgtcaggcgtggganaagtactattgtagtgttggcggagggaccaggctgaccgtacgtaggtccaggcccaaggctcggcccctcggtccacgttcctcgttcccccg

SEQ ID NO: 166754 - DNA, 505 bp, Homo sapiens
  misc_feature: GYAE6OF02ITVEI.26.71.G05.1.454.CMB.1.raw
  modified_base (234)..(234): a, c, t, g, unknown or other
  misc_feature (234)..(234): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaagttggganatagaaatgctgcctggtattaccagaggccaggccagtcccctattttggcatcttccaagataaagaagcggccctcgagggatccctgaccgaatttctggctccaactctgggaacacagccactctagaccatcagcgggccagccaacggatgagggagactactattgtacaggcgtgggagaatactattgtagtgttggcggaggcaggctgaccgtctaggtcacgccaggctcgcccctgcactctcgttcccacctccg

SEQ ID NO: 166755 - DNA, 623 bp, Homo sapiens
  misc_feature: GYAE6OF02HGSSB.26.71.G05.1.454.CMB.1.raw
  modified_base (175)..(175): a, c, t, g, unknown or other
  misc_feature (175)..(175): n is a, c, g, or t
  modified_base (234)..(234): a, c, t, g, unknown or other
  misc_feature (234)..(234): n is a, c, g, or t
  modified_base (413)..(413): a, c, t, g, unknown or other
  misc_feature (413)..(413): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctnagtgtccgtgtccccaggacagacagccaccatcacctgctcggcagacaaattggganatagaaatgctgcctggtattaccagaggccaggccagtcccctattttcggcactcttccaagtataacgaacgcggccctcgagggactcccgtagaccgtaatttctggctaccgaactcgtggaacacgacgacctacgtctagaccagtcgacgccgggacccagccgaacggntacgacgggtacaccgtactacgttgtccgaggtcgtagggagtaacttacgtagttacgtagtcgttcggacggtagggtaccagggtaccgtacggtaccgtccgtacggtccgaacggtaccccgtaaagggtccgttaaccggtcccccggttacggttcccgtaaccggttcccgtttccggttaccccgtacccgtttacccgg

SEQ ID NO: 166756 - DNA, 513 bp, Homo sapiens
  misc_feature: GYAE6OF02G2HRM.26.71.G05.1.454.CMB.1.raw
  modified_base (395)..(395): a, c, t, g, unknown or other
  misc_feature (395)..(395): n is a, c, g, or t
  modified_base (501)..(501): a, c, t, g, unknown or other
  misc_feature (501)..(501): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggtcatcttccaagataagaagcggccctcgagggactccctgaccgaattctggctccaactctgggaacacagccactctgaccatcacgccgggcccagccaacggntggagggagactactattgtcaggtcgtgggagaatactagttgtagttgtttggcggaggaccgaggctgaccgtcgtaggtcagcccgagctcgcccctggccnctcgtcgtcccc

SEQ ID NO: 166757 - DNA, 547 bp, Homo sapiens
  misc_feature: GYAE6OF02GRJNZ.26.71.G05.1.454.CMB.1.raw
tcagagactatactcacgaccggtgctcgatttagtgtcgtcgcaagagagaggggggactcctgtgccccaccatggacacgctttgctccacgctcctgctgctgaccatcccttcatgggtcttgtcccagatcaccttgaaggagtctggtcctgcgctggtggagcccacgcagaccctcacgctgacctgctccgtctctggattctcactcaccacgactgaggtgaatgtggcctgggtccgtcaggccccccggaaaggcccctggagtggcttgcactcatttactggagtgatctcaagcggtacaatccgtctctgaggaatcgactcaccatcaccagggacacctccaaacgaccgggtgtccttacaatcgaccgacatgaactcctgtggacacgaggcacatattactgtgcacacacgtacctaggccggactacgacgaaagaaaagaatatagactagttcggggactaaggggtaattttcggactacccggtcctacccccagtccctaccgaccgtaacccggg

SEQ ID NO: 166758 - DNA, 609 bp, Homo sapiens
  misc_feature: GYAE6OF02IIPSH.26.71.G05.1.454.CMB.1.raw
  modified_base (415)..(415): a, c, t, g, unknown or other
  misc_feature (415)..(415): n is a, c, g, or t
tcagagactatactcacgaccggtgctcgatttagtgtcgtcgcaagagagaggggctgggcctcaggaagcagcatcggaggtgcctcagccatggcatggatccctctcttcctcggcgtccttgcttactgcacaggatccgtggccttcgatgagctgattcagcccaccctcagtgtccgtgtccccaggacagacagccaccatcacctgctcggcagacaaattgggagatagaaatgctgcctggtattaccagaggccaggccagtcccctattttggtctatcttccaagataagaagccggccctagagggactccctgaccgtaatttctggcctaccaactcgtaggaacacacgccactctcgaccatcacggccgggccacgccgaaacggatggagganacttaacttagttcgtacgaggcggtagggaagaagtacttagttagttaggttacggtttgggaccgggacgggtaccgagggtccgttacgggacccgttaccgttaacgggtaccaacggaccccgtaacggtccgttcccggcccccggttacggtacccctaaccgtttccgttacccgttaccccccg

SEQ ID NO: 166759 - DNA, 589 bp, Homo sapiens
  misc_feature: GYAE6OF02IOJ7G.26.71.G05.1.454.CMB.1.raw
tcagagactatactcacgaccggtgctcgatttagtgtcgtcgcaagagagaggggctgggcctcaggaagcagcatcggaggtgcctcagccatggcatggatccctctcttcctcggcgtccttgcttactgcacaggatccgtggccttcgatgagctgattcagccacctcagtgtccgtgtccccaggacagacagccacatcacctgctcggcagacaaattgggagatagaaatgctgcctggtattaccagaggccaggccagtcccctatttggcatcttccaagataagaagcggccctcggggatccctgaccgaatttctaggcctccaactctgggaacacagccaactctagaccatcagtccgggcccagccaacggatggacgggagaactaccgtattcggtcaagggccgtagggagtaaatacgtagtttcggtaagttggtttagggacgggtagggacctagggcctaggacccggtacctagggtcctaacggtccccgtaaagggccgttccggaccccccgttcgggtacctaaccgtccgttaccggttcccccgtacccccgg

SEQ ID NO: 166760 - DNA, 838 bp, Homo sapiens
  misc_feature: GYAE6OF02IZZ62.26.71.G05.1.454.CMB.1.raw
  modified_base (233)..(233): a, c, t, g, unknown or other
  misc_feature (233)..(233): n is a, c, g, or t
tcagagactatactcacgaccggtgctcgatttagtgtcgtcgcaagagagagggggggcctcaggaagcagcatcggaggtgcctcagccatggcatggatcccgctcttcctcggcgtccttgcttactgcacaggatccgtggccttcgatgagctgattcagccaccctcagtgtccgtgtccccaggacagacagccaccatcacctgctcggcagacaaattggganatagaaatgactgcctggtattaccagaggccaggccaacgtcccctagttttcggtctatacttccaaggaacttaaaggaacggaccgggtcccctacgtacggggacttaccccgtaggaacccgtaaattttccgtcgggaccttaccccgaaacgttcccgttaacgggggaaaccaacccgacggtaccccaaccgttacccgttacggtaaacccctaacttacccgaacgggtacccggggggacccccaaacggtacccccgaaaaccggggtaacgttaggggaaacgggggtaacgtaaacccgttaaaccgtttaacggtttaccgggttacgtaacgggggtacccgggttagggggtaaacggaaaaccgtttaaccggttaacgttttaggggttaacggttttaggggttttacgggtaccgggggtaagggggttaccccgaaagggtccgtacgggtaacccggttcccggtaacgggtacccgaacgggtaccccggtaaacggggtcccgtacccggtcccccccgttaccgggttccctaacccgttcccggtttcccggttacccccgccccgtttaccccgg

SEQ ID NO: 166761 - DNA, 533 bp, Homo sapiens
  misc_feature: GYAE6OF02HHBMX.26.71.G05.1.454.CMB.1.raw
  modified_base (231)..(231): a, c, t, g, unknown or other
  misc_feature (231)..(231): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctatttggcatctccaagataagaagcggccctcagggactccctgaccgtaatttctggcctccaactcgtacgggaacacagccactctcgaccatcaggccgggcccagccaacggatggagggagactactattgtcaggcgtgggagaatactagttggtagtgtttggcggtagggacgaggctgaccgtcgtaggtccaggcccaaggcctccgccccgtcggtccaccttccgtcgttccccgaccttcccg

SEQ ID NO: 166762 - DNA, 669 bp, Homo sapiens
  misc_feature: GYAE6OF02IOM9T.26.71.G05.1.454.CMB.1.raw
  modified_base (236)..(236): a, c, t, g, unknown or other
  misc_feature (236)..(236): n is a, c, g, or t
  modified_base (310)..(310): a, c, t, g, unknown or other
  misc_feature (310)..(310): n is a, c, g, or t
tcagagactatactcacgaccggtgctcgatttagtgtcgtcgcaagagagaggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagaccaaattggganatagaaatgctgccgggtattaccagagccagccagtcccattttggcatcttccaagataagaagcggccctnacgggatccctagaccgaattctggactccaactctagggaacacgtagccgactctgaccatcaggccgggccctagccctaacggactggaacgggacgtactaccgtaattcggtctaacgggccgttagggaacggaaacgttaccgttaagtttggtaaggttcgggttttacgggccggggttaaacggggaccctaaggggtaccggttaccggtacccgggttaccggttaacggggttacccggaaccggtaccccggtaaaacgggtcccggttacccgggtacccccccgttaccggggtacccttaacccggtttccgttacccggtttacccccctaaccccccgg

SEQ ID NO: 166763 - DNA, 578 bp, Homo sapiens
  misc_feature: GYAE6OF02G9HQZ.26.71.G05.1.454.CMB.1.raw
  modified_base (236)..(236): a, c, t, g, unknown or other
  misc_feature (236)..(236): n is a, c, g, or t
  modified_base (311)..(311): a, c, t, g, unknown or other
  misc_feature (311)..(311): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagagccaggccagtcccctatttggtcatctccaagataagaagcgccctnagggatccctgaccgaattcctggctccaactctgggaacacagccactctgaccatcacggcgggacccagaccaacggatcggaagggagacttaacgtattacgtacgagggtaccggtgggaagaagttaaccgtaagtttagttaagttggtttaggcgggagggaaccgaggtccgtacgaaccgtccgtaagggtaccacggacccgtaacgggcctccggcccccgttacgggtaccaccttccgtccgttaccccccg

SEQ ID NO: 166764 - DNA, 506 bp, Homo sapiens
  misc_feature: GYAE6OF02ILUZV.26.71.G05.1.454.CMB.1.raw
  modified_base (370)..(370): a, c, t, g, unknown or other
  misc_feature (370)..(370): n is a, c, g, or t
  modified_base (474)..(474): a, c, t, g, unknown or other
  misc_feature (474)..(474): n is a, c, g, or t
  modified_base (502)..(502): a, c, t, g, unknown or other
  misc_feature (502)..(502): n is a, c, g, or t
tcagagactatactcacgaccggtgctcgatttagtgtcgtcgcaagagagaggggtccatgccatggcatggatccctctcttcctcggcgtccttgcttactgcacaggatccgtggccttcgatgagctgattcagccaccctcagtgtccgtgtccccaggacagacagccaccatcacctgctcggcagacaaaattgggagatagaaatgctgcctggtattaccagaggccaggccagtcccctatttggtcatcttccaagataagaagcggccctcagggatccctgaccgaatttctggctccaactctgggaacacagccactctgaccatcagcggggccagccaacggatcgagggngactactattgtcaggcgtggagaatactattgtagttgtttggcggagggacaggctggaccgtctaggtcagccaagctcgcccctggtcactctcgtcccnccctcctcagtatcgtctctgacgcggntcgg

SEQ ID NO: 166765 - DNA, 641 bp, Homo sapiens
  misc_feature: GYAE6OF02HQAZD.26.71.G05.1.454.CMB.1.raw
  modified_base (237)..(237): a, c, t, g, unknown or other
  misc_feature (237)..(237): n is a, c, g, or t
  modified_base (315)..(315): a, c, t, g, unknown or other
  misc_feature (315)..(315): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccaccctcagtgtccgtgtccccaggacagacagccaccatcacctgctcggcagacaaattggganatagaaatgctgcctggtattaccagaggccaggccagtcccctattttggtcatcttccaagataagagcggccctnagggactcctagaccgtaattctggctccaactctagggaacacagccactctcgaccatcgaggccgggcccagccgaaacggagtggagggacgactaacgttattcgtcgagggcgtgggaagtaaactacgttagttgttaaggttggttttaggggaccgggtaagggacccgtaaggggccgttacgggtaacccggttacccgtaaggggttacccgaacgggacccccggtaaacggggtccccgttacccgggtacccccccggttaccgggttaccccgtaacccgtttcccggttccccggtttaaccccccccg

SEQ ID NO: 166766 - DNA, 517 bp, Homo sapiens
  misc_feature: GYAE6OF02FTCD1.26.71.G05.1.454.CMB.1.raw
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggtcatcttccaagataagaagcggccctcagggatccctgaccgaatttctggctccaactctggaacacagccactctgaccatcagcgggcccagccaacggatgaggagactactattgtcaggcgtgggagaatactattgtagtgtttggcggtagggaccaggctgaccgtctaggtcgagcccaaggctcgcccccgtcggtccacctcctcgttcccgccctcccg

SEQ ID NO: 166767 - DNA, 593 bp, Homo sapiens
  misc_feature: GYAE6OF02GDZ01.26.71.G05.1.454.CMB.1.raw
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaagttgggagatagaaatgctgcctggtattaccagaggccaggccacgtcccctatttggtcatcttcaagataagagcgcctcagggactccctgaccgaatttctggcctccaactctgggaacacagcccactctacgaccatcgacggcggggccccaggcccaaacgggactaggacgggacgacttaacgtacgttggtccagggcggtagggaagtaagttaacgttagtttaggttagttagggttttcgggacgggtaagggaccgagggtcgtacggacccggttccgtacggtaccgacggtcccgtaaggccgtccggtcccccgtcggtaccaccttccgtcgttcccccgg

SEQ ID NO: 166768 - DNA, 538 bp, Homo sapiens
  misc_feature: GYAE6OF02GYU7S.26.71.G05.1.454.CMB.1.raw
  modified_base (236)..(236): a, c, t, g, unknown or other
  misc_feature (236)..(236): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctatttggtcatcttccaagataagaagcggccctcagggatccctgaccgaattctggctccaactcgtagggaacacagccactctgaccatcaggccggggccccagcccaacggactggacgggagactacgtattgtcgaggcgtagggagaatacgtattgtagtgtttaggcgggtacggacgaggcgtgacccgtcgtacggtcacggcccgaaggcctcggccccgtcggtaccaccgttcctcgttcccc

SEQ ID NO: 166769 - DNA, 515 bp, Homo sapiens
  misc_feature: GYAE6OF02FZQJ1.26.71.G05.1.454.CMB.1.raw
  modified_base (234)..(234): a, c, t, g, unknown or other
  misc_feature (234)..(234): n is a, c, g, or t
  modified_base (335)..(335): a, c, t, g, unknown or other
  misc_feature (335)..(335): n is a, c, g, or t
  modified_base (398)..(398): a, c, t, g, unknown or other
  misc_feature (398)..(398): n is a, c, g, or t
tcagagactatactcacgaccggtgctcgatttagtgtcgtcgcaagagagaggggggtgcctcaggaagcagcatcggaggtgtctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctattttggtcatcttccaagataagaagcggccctcagggatccctgaccgaatttcnggctccaactctgggaacacagccactctgacatcagcgggcccagccaacggatggaggganactactatgtcaggcgtgggagaatactattgtagttgtttggcggaggacaggctgaccgtcgtaggtcagcccgaaggcctcggcccctcggtccactcctcgttccccgtcccc

SEQ ID NO: 166770 - DNA, 557 bp, Homo sapiens
  misc_feature: GYAE6OF02GACL3.26.71.G05.1.454.CMB.1.raw
  modified_base (229)..(229): a, c, t, g, unknown or other
  misc_feature (229)..(229): n is a, c, g, or t
  modified_base (328)..(328): a, c, t, g, unknown or other
  misc_feature (328)..(328): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaattgganatagaatgctgcctggtattaccagaggccaggccagtcccctattttggtcatcttccaagataagaagcgcctcagggatccctgaccgtaatttcnggctccaactctggaacacacgccactctgaccatcacggccgggcccagcccaacggatcggaagggacgaacgtactattgcgaggccgtagggagtaatacgttattaggtagttgttgggcgggaggaccgaggtctggtaccgtccgtacggtcacggacccgaaggcctccggacccccgttggtaccctaccgttccgtccgttaccccgtccccttacccg

SEQ ID NO: 166771 - DNA, 531 bp, Homo sapiens
  misc_feature: GYAE6OF02F963M.26.71.G05.1.454.CMB.1.raw
  modified_base (381)..(381): a, c, t, g, unknown or other
  misc_feature (381)..(381): n is a, c, g, or t
tcagagactatactcacgaccggtgctcgatttagtgtcgtcgcaagagagagggggactcctgtgccccaccatggacacgctttgctccacgctcctgctgctgaccatcccttcatgggtcttgtcccagatcaccttgaaggagtctggtcctgcgctggtggagcccacgcagaccctcacgctgacctgctccgtctctggattctcactcaccacgactgaggtgaatgtggcctgggtccgtcaggcccccggaaaggccctggagtggcttgcactcatttactggagtgatctcaagcggtacaatccgtctctgagaatcgactcaccatcaccaggacacctccaaagccggtgtcctacatgaccganatgaatcctgtcggacacgaggcacatattactgtcgcacacagtcctagcggctacgcgaagaaaagatatgactagttcggggacctaggggtaattttcggtaccacccgttccttaccccgacgtccctacccgaccgtaaccggg

SEQ ID NO: 166772 - DNA, 564 bp, Homo sapiens
  misc_feature: GYAE6OF02GHMZP.26.71.G05.1.454.CMB.1.raw
  modified_base (234)..(234): a, c, t, g, unknown or other
  misc_feature (234)..(234): n is a, c, g, or t
  modified_base (334)..(334): a, c, t, g, unknown or other
  misc_feature (334)..(334): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaatgctgcctggtattaccagaggccaggccagtcccctattttggcatcttccaagataagaagcggccctcgagggatccctgaccgaatttcnggcctcactctagggaacacagccactctgaccatcagcgggcccagcccaacggatggagggacgaactactagttcgtacgagggcgtgggacgaagttacgtagttgtagttggtttaggacggacgggaccaggcgtagacccgtcgtacggtcgacggacccaacggcctccggacccccgttcgggtacctaccgtccgttacccgttccccgaccccttcccg

SEQ ID NO: 166773 - DNA, 684 bp, Homo sapiens
  misc_feature: GYAE6OF02ILLH7.26.71.G05.1.454.CMB.1.raw
  modified_base (234)..(234): a, c, t, g, unknown or other
  misc_feature (234)..(234): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagcccaccctcagtgtccgtgtccccaggacagacagccacatcacctgctcggcagacaaattggganatagaaatgactgcctggtattaccagaggccaggccagtccccttatttggtcatcttaccaagataagaagcgccctcgaggactccctgaccgaatttctcggctaccaactcgtaggaaccacgacgacccactcctacgaccagtccacgggtccggggaccccaacggaccccgaaacgggagtacggaacggggacaaccgttaacgttaagttcggtaccgagggtaccggtaggggaaagtaaacttaacgttaagtttaggttaagggttggttttcggggacgggtaacgggaacccggtaggaccgttacggtaccccggttacccgttaaggggtcccaacgggtaccccggaacgggtcccgttaccccggaccccccgttcgggttaccctaacccggttcccgtttcccggttaccccccacccctttaccccg

SEQ ID NO: 166774 - DNA, 532 bp, Homo sapiens
  misc_feature: GYAE6OF02GDOAU.26.71.G05.1.454.CMB.1.raw
  modified_base (237)..(237): a, c, t, g, unknown or other
  misc_feature (237)..(237): n is a, c, g, or t
  modified_base (397)..(397): a, c, t, g, unknown or other
  misc_feature (397)..(397): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtcccccaggacagacagccaccatcacctgctcggcagacaaattggganatagaaatgctgcctggtattaccagaggccaggccagtcccctattttggtcatcttccaagataagaagcggccctcagggactccctgacccgtaatttctggctccaactctgggaacacagccactctgaccatcacgcgggcccagccaacggntgagggagactactattgtcaggcgtgggagtaatactagttagtagtgtttggcggacgggacaggcgtcgaccgtccgtacggtcacgcccgaaggcctacggcccccgtcggtccaccgtctcgttcccccg

SEQ ID NO: 166775 - DNA, 616 bp, Homo sapiens
  misc_feature: GYAE6OF02GHXCJ.26.71.G05.1.454.CMB.1.raw
  modified_base (233)..(233): a, c, t, g, unknown or other
  misc_feature (233)..(233): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaatgctgcctggtattaccagaggccaggccagtcccctattttggcatcttccaagataagaagcggccctcgagggatccctgaccgaatttcgtggctccaactcgtaggaacacagccactctgaccatcacgcgggcccagccaaggatgagggagactactattgtcgaggcgtagggagtaaactacgtaagttagttagttacggtttgggacgggtaacggggaaccgtagggtaccgtacggtaacccggttaccgttaacgggtccgtaacggaccccgtaaacgggtcccgtacccggtaccccccgttacgggttaccctaacccggttcccgttacccggtttccccccgcccctttacccccgg

SEQ ID NO: 166776 - DNA, 654 bp, Homo sapiens
  misc_feature: GYAE6OF02FV5CV.26.71.G05.1.454.CMB.1.raw
  modified_base (235)..(235): a, c, t, g, unknown or other
  misc_feature (235)..(235): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccacatcacctgctcggcagacaaattggganatagaaatgctgcctggtattaccagagccaggccacgtcccctatttggtcatcttccaagataagaagccggccctcgagggactcccgtagaccgtaatttcgtggtcctacctaactcgtagggaacacgacgacccactcctcgaccagtacgacggccggggacccaggacccgaacgggagtacggaacgggacgtaacgttaacgtagttcgtacgacgggtccggtaggggaagtaacgttaacgttagtttaggttaaggtttgggtttacgggaccgggtaacggggtaaccgtagggtccggttacggtacccggttaccggttaaggtaccgtaacgggaccccgtaagggcccgttaccggcccccgttacggtaccctacccgtttcccgtccgttaccccccg

SEQ ID NO: 166777 - DNA, 785 bp, Homo sapiens
  misc_feature: GYAE6OF02IQ3YW.26.71.G05.1.454.CMB.1.raw
  modified_base (234)..(234): a, c, t, g, unknown or other
  misc_feature (234)..(234): n is a, c, g, or t
tcagagactatactcacgaccggtgctcgatttagtgtcgtcgcaagagagagggggggccgtcgaggaagcagcatcggaggtgcctcagccatggcatggatccctctcttcctcggcgtccttgcttactgcacaggatccgtggccttcgatgagctgattcagccaccctcagtgtccgtgtccccaggacagacagccacatcacctgctcggcagacaaattggganataagaaatgctgcctggtacttaccgagacggccaggccagtccccttagttttggtcattcctaccaagtataaagaacgccggccctgaacgggactcccgtagaccgtaatttcgtggactacccaactccgtaggaacacgacgtcccaattcctagacctagtccgaacggcccggggacccctaacggacccgaaaccgggtagtacgggaaacggggtaacgaaccgttaaccgttaagttcggtaccgtacgggtaccgggtaggggtaacgtaaacgtttaaccgttaaagtttacgggtttaaggtttacggggttttacgggtaccgggggtaaacgggggtaaccccggttagggaaccgggtttaaccggtaacccccgggtttacccggttaacggggttaacccggtaacccggtacccccggttaaaggggtaccccgtccccggggttaaccccccccgttcccggggtaaccccttaaccggttaccccggtttcccggttttaaccccccccaacccccggttttcccccg

SEQ ID NO: 166778 - DNA, 720 bp, Homo sapiens
  misc_feature: GYAE6OF02HGEI7.26.71.G05.1.454.CMB.1.raw
  modified_base (205)..(205): a, c, t, g, unknown or other
  misc_feature (205)..(205): n is a, c, g, or t
  modified_base (305)..(305): a, c, t, g, unknown or other
  misc_feature (305)..(305): n is a, c, g, or t
tcagagactatactcacgaccggtgctcgatttagtgtcgtcgcaagagagaggggtccatgccatggcatggatccctctcttcctcggcgtccttgcttactgcacaggatccgtggccttcgatgagctgattcagccaccctcagtgtccgtgtccccaggacagacagccaccatcacctgctcggcagacaaattgganatagaatgctgcctggtattaccagaggccaggccagtccctagttttggcatctcaagataagagcggaccctgagggactccctgaccgtaatttcgnggctccaatcgtacggaacacagccactctagaccatcgacggccggggaccacgacccgaaacggagtacgggacggggtaacgtaaccgtaaccgttagtttacggtaccgtagggaccgggttaggggaaacgtaaacgttaacgttagtttacggttaaggttacggttttacggggacggggtaacggggaccgtaacgggtccggtacggtacccggttacccggttacgggtaccgaacgggtacccgaaacgggtcccggtacccggaccccccggtttacgggtacccgtacccgttcccgttccccggtttaccccctaccccggtttaccccttacccggtaccgtttaaccgttaccggttcccttaccggttaccgggtacggtccggggtacgtaccgggg

SEQ ID NO: 166779 - DNA, 645 bp, Homo sapiens
  misc_feature: GYAE6OF02HWKHI.26.71.G05.1.454.CMB.1.raw
  modified_base (338)..(338): a, c, t, g, unknown or other
  misc_feature (338)..(338): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctatttcggtcatcttccaagataagaagcggccctcgagggactccctgaccgtaatttcncggtctccaactcgtagggaacacgagccactctacgaccatccaggccgggacccacgaccgaaacggataggaacgggacgacgtactattcggtacgaggccggtagggaacgaacgttacgttaagtttaggttagttaggttttcggggacgggtaacgggtacccggtagggccgttacgggaacccggttaccgttacgggtaccgaaccggtaccccgtaaacgggcccgttccggtaccccccgttacggtcccgtaacccgttcccgttacccggtttccccccaccccttaccccg

SEQ ID NO: 166780 - DNA, 522 bp, Homo sapiens
  misc_feature: GYAE6OF02HY8J0.26.71.G05.1.454.CMB.1.raw
  modified_base (390)..(390): a, c, t, g, unknown or other
  misc_feature (390)..(390): n is a, c, g, or t
  modified_base (399)..(399): a, c, t, g, unknown or other
  misc_feature (399)..(399): n is a, c, g, or t
tcagagactatactcacgaccggtgctcgatttagtgtcgtcgcaagagagaggggggctgggcctcaggaagcagcatcggaggtgcctcagccatggcatggatccctctcttcctcggcgtccttgcttactgcacaggatccgtggccttcgatgagctgattcagcccaccctcagtgtccgtgtccccaggacagacagccaccatcacctgctcggcagacaaatgggagatagaaatgactgcctggtattaccagaggccaggcccagtcccctattttggtcatcttccaagataagaagcggccctcgagggactccctgaccgaatttcctggctccaactctagggaacacagccactctgaccatcagcgggcccngccaacgangaggagactacgtattgtcgaggcgtgggagaatactattagtagttgttggcggaggaccaggctggaccgtacgtacggtcagcccaaggctcggcccctcggtccacgtcctcgtccccg

SEQ ID NO: 166781 - DNA, 530 bp, Homo sapiens
  misc_feature: GYAE6OF02GZL8I.26.71.G05.1.454.CMB.1.raw
tcagagactatactcacgaccggtgctcgatttagtgtcgtcgcaagagagagggggctgggcctcaggaagcagcatcggaggtgcctcagccatgacatggatccctctcttcctcggcgtccttgcttactgcacaggatccgtggccttcgatgagctgattcagccaccctcagtgtccgtgtcccccaggacagacagccaccatcacctgctcggcagacaaattgggagatagaaatgctgcctggtattaccagaggccaggccagtcccctattttggtcatcttccaagataagaagcggccctcagggatccctgaccgaatttctggctccaactctgggaacacagccactctgaccatcagcgggcccagcccaacggatggagggagactactattgcaggcgtgggagaatactattgtagttgtttggcggagggaccagggctggacccgtcgtaggtccacggcccgaaggccgtacggcccccgtcggtccacttccgtcgttcccccg

SEQ ID NO: 166782 - DNA, 534 bp, Homo sapiens
  misc_feature: GYAE6OF02G8P5X.26.71.G05.1.454.CMB.1.raw
  modified_base (234)..(234): a, c, t, g, unknown or other
  misc_feature (234)..(234): n is a, c, g, or t
  modified_base (358)..(358): a, c, t, g, unknown or other
  misc_feature (358)..(358): n is a, c, g, or t
  modified_base (370)..(370): a, c, t, g, unknown or other
  misc_feature (370)..(370): n is a, c, g, or t
  modified_base (406)..(406): a, c, t, g, unknown or other
  misc_feature (406)..(406): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctatttggtcatcttccaagataagaagcggccctcagggatccccgtagaccgtaatttcgtggctccaactctgggaacncagccactctanaccatcagccgggcccagccaacggatggacggganactactattcgtacagggcgtggagaatacgtattgtagtgtttggagagggaccaggctgaccgtcgtaggtcacggcccgaggcctcgcccccgtacggtccacgttccgtcgttcccacccttcc

SEQ ID NO: 166783 - DNA, 518 bp, Homo sapiens
  misc_feature: GYAE6OF02HAL6H.26.71.G05.1.454.CMB.1.raw
  modified_base (234)..(234): a, c, t, g, unknown or other
  misc_feature (234)..(234): n is a, c, g, or t
  modified_base (309)..(309): a, c, t, g, unknown or other
  misc_feature (309)..(309): n is a, c, g, or t
  modified_base (314)..(314): a, c, t, g, unknown or other
  misc_feature (314)..(314): n is a, c, g, or t
  modified_base (331)..(331): a, c, t, g, unknown or other
  misc_feature (331)..(331): n is a, c, g, or t
  modified_base (419)..(419): a, c, t, g, unknown or other
  misc_feature (419)..(419): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctatttggcatcttccaagataagaagcgcctnagggntccctgaccgaatttcnggctccaactctgggaacacagccactctgaccatcaggcgggcccagccaacggatgagggagactactattgtcgaggcgtggganaatactagttgtagtgtttggcggagggccaggctgaccgtctaggtcacgcccaaggcctccgcccctcggtccaccttcgtcgttcccacccttccg

SEQ ID NO: 166784 - DNA, 733 bp, Homo sapiens
  misc_feature: GYAE6OF02H7Z1P.26.71.G05.1.454.CMB.1.raw
  modified_base (235)..(235): a, c, t, g, unknown or other
  misc_feature (235)..(235): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaattggganatagaaatgctgcctggtattaccagacggccaggcccagtcccccttattttcggtctactctttaccaagtaataaggaaacgccggcccttcgacgggactcccctaggacccgtaacttttcgtcggtcctaccctaaacgttcgtacggggaacctaacgacggaccctaccttccgttacgaacccaagtccgaacggccccgggggtaccccacgggacccaaacgggacgtacgggaacggggaacgtaaccgttaccgttaagtttacggtaccgtaacgggaccggttaggggaacgtaaacgttaaccgttaagtttaggttaggtttacgggtttaggggaccggggtaaggggacccgtaggggtcccgttacgggtaaccccggttccggtaacgggttcccgaacgggtaccccgaaacgggttcccgtcccggacccccgttccgggtaccctaccgttcccgttccggtttacccccccgg

SEQ ID NO: 166785 - DNA, 505 bp, Homo sapiens
  misc_feature: GYAE6OF02G1VN7.26.71.G05.1.454.CMB.1.raw
  modified_base (499)..(499): a, c, t, g, unknown or other
  misc_feature (499)..(499): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggtcatcttccaagataagaaagcggccctcaggggatccctgaccgaatttctggctccaactctagggaacacagccactctgaccatcagcgggcccagccaacggatgagggagactactattgcaggcgtgggagaatactatgtagtgtttgcggaggacaggctgaccgtcgtaggtcagccaaggctcgcccctcggccactcgtntccccg

SEQ ID NO: 166786 - DNA, 632 bp, Homo sapiens
  misc_feature: GYAE6OF02H4SSP.26.71.G05.1.454.CMB.1.raw
  modified_base (176)..(176): a, c, t, g, unknown or other
  misc_feature (176)..(176): n is a, c, g, or t
  modified_base (235)..(235): a, c, t, g, unknown or other
  misc_feature (235)..(235): n is a, c, g, or t
  modified_base (337)..(337): a, c, t, g, unknown or other
  misc_feature (337)..(337): n is a, c, g, or t
tcagagactatactcacgaccggtgctcgatttagtgtcgtcgcaagagagagggggggccgtcaggaagcagcatcggaggtgcctcagccatggcatggatccctctcttcctcggcgtccttgcttactgcacaggatccgtggccttcgatgagctgattcagcccaccctnagtgtccgtgtccccaggacagacagccaccatcacctgctcggcagacaagttggganatagaaatgctgcctgtattaccagagccaggccagtccctagtttcggtcatcttcaagactaagaacgcggacctgagggactcctggaacctaatttcnggtcctaccaaactctacgggaaacaacgacgaccctactcctagaacctacgtcgaacggccgggacccacggacccaacggagtaggaagggaacaacgttacgtaagttacggtcacgggtcggtaacgggagtaactacgttaagttagttaggttgttagggtcgggacgggaaccggaggacgtacggacccgttccggtaaggttccgaaccggacccgaaggtcccgtaccggtcccccgttcggtaccctacgttacccgttccggttacccctacccgttacccg

SEQ ID NO: 166787 - DNA, 516 bp, Homo sapiens
  misc_feature: GYAE6OF02IF82H.26.71.G05.1.454.CMB.1.raw
  modified_base (231)..(231): a, c, t, g, unknown or other
  misc_feature (231)..(231): n is a, c, g, or t
  modified_base (390)..(390): a, c, t, g, unknown or other
  misc_feature (390)..(390): n is a, c, g, or t
  modified_base (420)..(420): a, c, t, g, unknown or other
  misc_feature (420)..(420): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctattttggtcatcttccaagataagagcggccctcagggactccctgaccgaatttctcggctcccaactctgggaacacacgccactctgaccatcagcgggcccagccaacggntggaggagactactattgcaggcgtggganaatatattgtagtgtttgggcggagggaccaggctgaccgtcgtaggtcgagcccaaggcctcgccccgtggtccactcctcgttccccaccctcc

SEQ ID NO: 166788 - DNA, 645 bp, Homo sapiens
  misc_feature: GYAE6OF02G0A8U.26.71.G05.1.454.CMB.1.raw
  modified_base (236)..(236): a, c, t, g, unknown or other
  misc_feature (236)..(236): n is a, c, g, or t
  modified_base (333)..(333): a, c, t, g, unknown or other
  misc_feature (333)..(333): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgctggtattaccagagccaggccagtcccctatttggtcatcttccaagataagagcgcctcgacggactcctgaccgtaatttcnggctccaactcgtagggaacacagccactcctgaccatcgacggccggggcccaacggacccgaaacgggagtacgggaacgggacgtaaccgttaacgttagtttacggtccgaacggggtaccggttaggggaagtaaagttaaccgtttaagttttgttaagggttttggtttaggggacggggtaacgggaaccgtacgggtccgtacggtacccgtaccggttaacgggtaccaaccggaccccggaacgggtccctacccggtcccccggttccggtacctacccgttccgtaccgttaccccccg

SEQ ID NO: 166789 - DNA, 620 bp, Homo sapiens
  misc_feature: GYAE6OF02H8AAL.26.71.G05.1.454.CMB.1.raw
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccaccctcagtgtccgtgtcccccaggacagacagccaccatcacctgctcggcagacaaattgggagatagaaatgctgcctggtattaccagaggccaggcccagtccccctattttggtcatcttccaagataagaagcggccctcagggactccctgacccgtaatttctggcctaccaactcgtagggaacacacgccactctacgaccatcgacgccgggcccagccaacggatggagggacgtaactacttaagttgttacgagggtcggtagggaagtaagttaccgttaatttacggttaggttggtttcgggacgggtacggggtaccgacgggtcgttacggacccggttaccggtaacgggttaccacggtccccgaaggtcctacccggtccccccggttccgggtccctaaccgttcccttaccgtttaccccccg

SEQ ID NO: 166790 - DNA, 558 bp, Homo sapiens
  misc_feature: GYAE6OF02G5YLZ.26.71.G05.1.454.CMB.1.raw
  modified_base (405)..(405): a, c, t, g, unknown or other
  misc_feature (405)..(405): n is a, c, g, or t
  modified_base (549)..(549): a, c, t, g, unknown or other
  misc_feature (549)..(549): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtccccttattttcggtcatcttacaagataagagcggcctcgagggactccctagaccgtaatttcgtggcctaccaactcgtagggaacacgacgccactctcgaccatcgacgccgggacccagcccaaacggntggaagggacgactacgtagttcgcgaggcgtagggataatactagttagtagttgttggcggaggtaccgaggcgtacgaccgtcgtaggtcgaacggcccgaaggtcctccgcccgtcggtcctaccttccgtccgttcccncccttaccg

SEQ ID NO: 166791 - DNA, 626 bp, Homo sapiens
  misc_feature: GYAE6OF02F1UNG.26.71.G05.1.454.CMB.1.raw
  modified_base (334)..(334): a, c, t, g, unknown or other
  misc_feature (334)..(334): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggtcatcttccaagataagaagcggccctcgagggactccctgaccgaatttcnggctaccaactcgtagggaacacacgccactctgaccactcacggccggggacccagaccgaacggagtcggaagggagtaaccgtaacgttagttcggtcgacgggtcggtaggggaacgtaagttaacgttagttaggttacggttaggttttcgggacgggtaacgggtaccgagggtccgtacggtacccggttaccgtacggtccgaacggcccgaagggtcccgtaccggtccccccgttcgggtaccttacccgttttcgttcccccgtacccttcccgttaccg

SEQ ID NO: 166792 - DNA, 510 bp, Homo sapiens
  misc_feature: GYAE6OF02GTRXE.26.71.G05.1.454.CMB.1.raw
  modified_base (394)..(394): a, c, t, g, unknown or other
  misc_feature (394)..(394): n is a, c, g, or t
  modified_base (492)..(492): a, c, t, g, unknown or other
  misc_feature (492)..(492): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggtcatcttccaagataagaagcggccctcgagggatccctgaccgaatttctggctcaactctgggaacacagccactctgaccatcagcgggccagccaacggatgaggganactatattgtcgaggcgtgggagtaatactagttgtagtgtttaggcgggaggaccgaggctgaccgtcgtagtcgagcccaaggctcgcccgtcgcnctctcgttcccgcctccg

SEQ ID NO: 166793 - DNA, 526 bp, Homo sapiens
  misc_feature: GYAE6OF02G2ZA3.26.71.G05.1.454.CMB.1.raw
  modified_base (185)..(185): a, c, t, g, unknown or other
  misc_feature (185)..(185): n is a, c, g, or t
tcagagactatactcacgaccggtgctcgatttagtgtcgtcgcaagagagaggggggactcctgtgccccaccatggacacgctttgctccacgctcctgctgctgaccatcccttcatgggtcttgtcccagatcaccttgaaggagtctggtcctgcgctggtggagcccacgcagaccctnacgctgacctgctccgtctctggattctcactcaccacgactgaggtgaatgtggcctgggtccgtcaggcccccggaaaggcccctggagtggcttgcactcatttactggagtgatctcaagcggtacaatccgtctctgaggaatcgactcaccatcaccaggacacctaccaaagaccgggtgtaccttacaatcgaccgacatgaatctgtgacacagcacatattactgtgcacacagtcctagcgctacgcgagaaaagatatagactagtcggggactaaggggtatttcggtacgtaccgtcctacccgacgccctaccgaccgtaaccggg

SEQ ID NO: 166794 - DNA, 545 bp, Homo sapiens
  misc_feature: GYAE6OF02I2J48.26.71.G05.1.454.CMB.1.raw
  modified_base (442)..(442): a, c, t, g, unknown or other
  misc_feature (442)..(442): n is a, c, g, or t
tcagagactatactcacgaccggtgctcgatttagtgtcgtcgcaagagagaggggggactcctgtgccccaccatggacacgctttgctccacgctcctgctgctgaccatcccttcatgggtcttgtcccagatcaccttgaaggagtctggtcctgcgctggtggagcccacgcagaccctcacgctgacctgctccgtctctggattctcactcaccacgactgaggtgaatgtggcctgggtccgtcgacggcccccggaaggccctggagtggcttgcactcatttactggagtgatctcaagcggtacatccgtctctgaggaatcgactcaccactcaccagggacacctaccaaacggaccgggtaggtacccttaacgaacttacgaacccgacatgaactcctggtcggacacacggcaactattattacngtcgcacacacgtccaggcggcaccgcgaagaaagaatatagactaggtgggactagggtattttggactaccgtcgtcccacgtccctaccaccgtaaccgg

SEQ ID NO: 166795 - DNA, 511 bp, Homo sapiens
  misc_feature: GYAE6OF02HMY1Y.26.71.G05.1.454.CMB.1.raw
  modified_base (231)..(231): a, c, t, g, unknown or other
  misc_feature (231)..(231): n is a, c, g, or t
  modified_base (309)..(309): a, c, t, g, unknown or other
  misc_feature (309)..(309): n is a, c, g, or t
  modified_base (350)..(350): a, c, t, g, unknown or other
  misc_feature (350)..(350): n is a, c, g, or t
  modified_base (416)..(416): a, c, t, g, unknown or other
  misc_feature (416)..(416): n is a, c, g, or t
  modified_base (438)..(438): a, c, t, g, unknown or other
  misc_feature (438)..(438): n is a, c, g, or t
  modified_base (490)..(490): a, c, t, g, unknown or other
  misc_feature (490)..(490): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctattttggtcatcttccaagatagaagcggccctnagggatccctgaccgaatttctggctccaactctgggaacncagccactctgaccatcagcgggcccagccacgatgaggagactactagttgtcgaggcgtggganaagtactagttgtagtgttggnggagggacaggctgaccgtcgtaggtcagcccaggctacgcccctcggtccnctcctcgttcccaccctcccg

SEQ ID NO: 166796 - DNA, 559 bp, Homo sapiens
  misc_feature: GYAE6OF02H7K70.26.71.G05.1.454.CMB.1.raw
  modified_base (231)..(231): a, c, t, g, unknown or other
  misc_feature (231)..(231): n is a, c, g, or t
  modified_base (411)..(411): a, c, t, g, unknown or other
  misc_feature (411)..(411): n is a, c, g, or t
  modified_base (551)..(551): a, c, t, g, unknown or other
  misc_feature (551)..(551): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccacgtcccctatttggtcattcttaccaagataagaagcggaccctcgagggctccctgaccgaatttctcggctccaactcgtagggaacacgacgccactcacgaccatcaggccggggccacgaccaacggatggaaggganactacttagttgtacgaggcggtgggaagtaatacttagttagtagtggtttggcggtagggacgaggtctaggaccgtcgtaggtacgacgtaccgaggccgtccggccccgtcggtcgtacctccgtccgttaccccnccctcccg

SEQ ID NO: 166797 - DNA, 505 bp, Homo sapiens
  misc_feature: GYAE6OF02ISKIL.26.71.G05.1.454.CMB.1.raw
  modified_base (466)..(466): a, c, t, g, unknown or other
  misc_feature (466)..(466): n is a, c, g, or t
  modified_base (488)..(488): a, c, t, g, unknown or other
  misc_feature (488)..(488): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctatttggtcatctccaagataagaagcggccctcagggatccctgaccgaatttctggctccaactctgggaacacagccactctgaccatcagcggggcccagccaacggatgagggagactactattgtcaggcgtgggagaatactagttgtagtgtttggcggagggacaggctgaccgtctaggtcngcccaggctcgcccctcggtcnctctcgttcccacctcc

SEQ ID NO: 166798 - DNA, 529 bp, Homo sapiens
  misc_feature: GYAE6OF02GROOB.26.71.G05.1.454.CMB.1.raw
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctatttggtcatcttccaagataagaagcggccctcgagggatcccctgacccgaatttctggctccaactctgggaaacacagccactctgaccatcgagcgggacccagcccaacggatggagggagacttactattgcaggcgtagggagaagtactattgtagtggtttgcgggtaggacgagcgtgaccgtccgtaggtcacggcccaaggctccggcccctcggtccactccgtacgttcccccg

SEQ ID NO: 166799 - DNA, 618 bp, Homo sapiens
  misc_feature: GYAE6OF02JBVST.26.71.G05.1.454.CMB.1.raw
  modified_base (236)..(236): a, c, t, g, unknown or other
  misc_feature (236)..(236): n is a, c, g, or t
  modified_base (312)..(312): a, c, t, g, unknown or other
  misc_feature (312)..(312): n is a, c, g, or t
  modified_base (336)..(336): a, c, t, g, unknown or other
  misc_feature (336)..(336): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctatttggtcatcttccaagataagaagcgcctnaggactccctagaccgtaatttcnggcctccaactcgtaggaacacacgccactctacgaccatcacggccgggacccagacccaaacggataggaacgggacgaacgtaactagttgtacacgggtcggtagggaacgtaagtaaccgtagtttaggttaagttgggttttacgggacgggtaacgggtaccgaagggtccgtacggtacccggttaccgtacgggttaccgacggtacccggaaacggtccgtacggtccccccttacgggtaccctacccgttaccgttaccgttaccccccg

SEQ ID NO: 166800 - DNA, 536 bp, Homo sapiens
  misc_feature: GYAE6OF02JCEQ8.26.71.G05.1.454.CMB.1.raw
  modified_base (233)..(233): a, c, t, g, unknown or other
  misc_feature (233)..(233): n is a, c, g, or t
  modified_base (390)..(390): a, c, t, g, unknown or other
  misc_feature (390)..(390): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctattttggtcatctccaagataagaagcggccctcagggatccctgaccgaatttctggctccaactctgggaacacagccactctagaccatcagcgggcccagcccaacggntggagggagactactagttgtacgaggcgtgggagaatacgtagttgtagtgtttgggcggtagggaccaggtctggaccgtcgtaggcctacggcccaaggcctcgcccccgtcggtcctacctccgtcgttccctaccctcccg

SEQ ID NO: 166801 - DNA, 532 bp, Homo sapiens
  misc_feature: GYAE6OF02FXTQR.26.71.G05.1.454.CMB.1.raw
tcagagactatactcacgaccggtgctcgatttagtgtcgtcgcaagagagaggggggactcctgtgccccaccatggacacgctttgctccacgctcctgctgctgaccatcccttcatgggtcttgtcccagatcaccttgaaggagtctggtcctgcgctggtggagcccacgcagaccctcacgctgacctgctccgtctctggattctcactcaccacgactgaggtgaatgtggcctgggtccgtcaggcccccggaaaggccctggagtggcttgcactcatttactggagtgatctcaagcggtacaatccgtctctgaggaatcgactcaccatcaccagggacacctaccaaagaccgggtgtccttacaatgaccgacatgaatcctgtcggacacaggcacattattactgtgcacacagtcctagcgctacgcgaagaaagatatagactagttcggggacctaagggtaattttcggtctaccgttcctaccccgagcccctaccacccgtaaccggg

SEQ ID NO: 166802 - DNA, 603 bp, Homo sapiens
  misc_feature: GYAE6OF02H48P9.26.71.G05.1.454.CMB.1.raw
  modified_base (237)..(237): a, c, t, g, unknown or other
  misc_feature (237)..(237): n is a, c, g, or t
  modified_base (344)..(344): a, c, t, g, unknown or other
  misc_feature (344)..(344): n is a, c, g, or t
tcagagactatactcacgaccggtgctcgatttagtgtcgtcgcaagagagaggggctgggcctcaggaagcagcatcggaggtgcctcagccatggcatggatccctctcttcctcggcgtccttgcttactgcacaggatccgtggccttcgatgagctgattcacgccaccctcagtgtccgtgtccccaggacagacacgccacatcacctgctcggcagacaaagttggganatagaaatgctgcctggtataccgagacggccaggccacgtccccttagtttcggcatcttcaagataagagccgcctacgagggactcccgtagaaccgtatttcncggcctaccaacttcgtagggaaccacgtagcccactctcgaccatacgaggcccgggacccacgcccgaaacggagtacggagggagtaacctacgttattcgtacgagggtcggagggaagtaatacgttagtagtaggttcgggtttggacggggtaggaccgaggtcgtacggtaccgttccgtaggtaccgacggacccgaacggtcctccgacccccggtacgttcccgtacttcccggtaccgttcccccgg

SEQ ID NO: 166803 - DNA, 590 bp, Homo sapiens
  misc_feature: GYAE6OF02HTXME.26.71.G05.1.454.CMB.1.raw
  modified_base (230)..(230): a, c, t, g, unknown or other
  misc_feature (230)..(230): n is a, c, g, or t
  modified_base (310)..(310): a, c, t, g, unknown or other
  misc_feature (310)..(310): n is a, c, g, or t
  modified_base (333)..(333): a, c, t, g, unknown or other
  misc_feature (333)..(333): n is a, c, g, or t
tcagagactatactcacgaccggtgctcgatttagtgtcgtcgcaagagagaggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgactgcctggtattaccagaggcaggccagtcccctattttcggtctatcttccaagataagaagcgccctnagggactccctgaccgaatttcnggctccaactctggaacacagccactcgtcgaaccatcgacggcggggcccaaggcccgaaacgggactagggaacggggaacgaacgttaacctaagtttacgtcgaagggtccggtaggggaacaagttaacgtattaggttaagttggtttaggcgggagggaccgaggccgtgacccgttcgtacggtcgaacggtcccaaggtcctaccggcccctcgggtccaccgttccgtacgttccccacccgtaccc

SEQ ID NO: 166804 - DNA, 527 bp, Homo sapiens
  misc_feature: GYAE6OF02IT31H.26.71.G05.1.454.CMB.1.raw
  modified_base (396)..(396): a, c, t, g, unknown or other
  misc_feature (396)..(396): n is a, c, g, or t
  modified_base (420)..(420): a, c, t, g, unknown or other
  misc_feature (420)..(420): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctatttggtcatcttccaagataagaagcgcctcagggactcctgaccgaatttctggctccaactctagggaacacacgccactctgaccatcagcgggcccagccaacggatgaggganactactattgacaggcgtaggganaagtactagttagtagtgttaggcggtagggacaggctagacgtccgtaggtccagcccaaggcctacggcccctcggtcaccgttccgtcgttaccccacctcccg

SEQ ID NO: 166805 - DNA, 530 bp, Homo sapiens
  misc_feature: GYAE6OF02G3DBZ.26.71.G05.1.454.CMB.1.raw
  modified_base (426)..(426): a, c, t, g, unknown or other
  misc_feature (426)..(426): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggcatcttccaagataagaagcggccctgagggatccctgaccgaatttctggctccaactctaggaacacagcccactctcgaccatcaggcgggcccagcccaacggactggagggagactacttattcgtcaggcgtaggganaatacgtattagtagttggtttggacggagggaccaggctagaccgtctaggtcacggcccaaggcctcgcccctcggtcaccgtcgtcgttcccgccctaccg

SEQ ID NO: 166806 - DNA, 660 bp, Homo sapiens
  misc_feature: GYAE6OF02JHTZU.26.71.G05.1.454.CMB.1.raw
  modified_base (233)..(233): a, c, t, g, unknown or other
  misc_feature (233)..(233): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaatgctgcctggtattaccagaggcccaggccagtcccctattttggtcattcttccaagataagaagcggccctcagggactccctgaccgaatttctggctaccaactctagggaacacacgcccactctcgaccatccgaggcccggggccccaaggacccgaaacgggatagggaacgggagtaacctaacgttagttcggtaccgtacgggcggttaggggaacgtaattaacgttagttagggtaagtttcgggtttagggacggggtaacgggtaaccgtagggtaccgtacgggtacccggttacgtaacgggtccgaacgggtaccccgaaagggtcccttaacccggtccccccgttaccggttcccgtacccgttccgttacccggtttaccccccgacccccgttaccccg

SEQ ID NO: 166807 - DNA, 742 bp, Homo sapiens
  misc_feature: GYAE6OF02G758G.26.71.G05.1.454.CMB.1.raw
  modified_base (232)..(232): a, c, t, g, unknown or other
  misc_feature (232)..(232): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaatggganatagaatgctgcctggtataccagaggccaggccacgtcccctagttttcggctattccttaccaagtataaggaacgccggtaccctacgagggactccccgtaggaccgtaatttcgcggacctaccaacgtccgtagggaaccacgacgcccactctcgaccctatccgacggcccggggacccacggtacccgaaacgggacgtgggaacgggtaacgtaaccgttaacgttagttacggtaccgtaacgggtcgggtagggtaaacgtaacgttaacgttaggtttacggttaaggtttcgggttttacggggaccggggttaacggggtacccggtaacggggtaccgttaccgggtaccccgggttaccggttaaccggggtacccgtaaccgggtaaccccggtaaacgggtcccgttaccccgggtaccccccgttaccggggttacccctaaccggtttccccgtttacccggtttccccccgtaacccccgtttccccg

SEQ ID NO: 166808 - DNA, 519 bp, Homo sapiens
  misc_feature: GYAE6OF02IEUYV.26.71.G05.1.454.CMB.1.raw
  modified_base (388)..(388): a, c, t, g, unknown or other
  misc_feature (388)..(388): n is a, c, g, or t
  modified_base (419)..(419): a, c, t, g, unknown or other
  misc_feature (419)..(419): n is a, c, g, or t
tcagagactatactcacgaccggtgctcgatttagtgtcgtcgcaagagagaggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggtcatcttccaagataagaagcggccctcagggatccctgaccgaatttctggctccaactctgggaacacagccactctgaccatcagcgggcccagccaacggntgagggagactactattgtcaggcgtggganaagtactagttagtagtgtttggcggagggaccaggctgaccgtccgtaggtcagcccaaggcctagcccctcggtcacgtcctcgttccccgcctcccg

SEQ ID NO: 166809 - DNA, 522 bp, Homo sapiens
  misc_feature: GYAE6OF02G24DL.26.71.G05.1.454.CMB.1.raw
  modified_base (235)..(235): a, c, t, g, unknown or other
  misc_feature (235)..(235): n is a, c, g, or t
  modified_base (399)..(399): a, c, t, g, unknown or other
  misc_feature (399)..(399): n is a, c, g, or t
tcagagactatactcacgaccggtgctcgatttagtgtcgtcgcaagagagaggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctatttggtcatcttcaagataagaagcggcctcagggactccctgaccaatttctggctccaactcgtggaacacacgccactctgaccatcacgcgggcccagccaacggatggaggganacgtactagttgtcaggcgtgggagaatactattgagttgtttgggcggaggacgagggctaggtaccgtcgtacggtccacgcccgaaggctcgccccgtcggtccacgttctcgtcccccg

SEQ ID NO: 166810 - DNA, 518 bp, Homo sapiens
  misc_feature: GYAE6OF02I29S9.26.71.G05.1.454.CMB.1.raw
  modified_base (234)..(234): a, c, t, g, unknown or other
  misc_feature (234)..(234): n is a, c, g, or t
  modified_base (422)..(422): a, c, t, g, unknown or other
  misc_feature (422)..(422): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctattttggtcatcttccaagataagaagcggccctcagggatccctgaccgaatttctggctaccaactctgggaacacagccactctgaccatcagcgggcccagccaacggatgagggagactactattgtcaggcgtggganaagtactattgtagtgttggcggaggaccgaggctgaccgtcgtaggtcgagccaaggcctcgccccgtcgtccacgtctcgttcccgccctcccg

SEQ ID NO: 166811 - DNA, 628 bp, Homo sapiens
  misc_feature: GYAE6OF02IT3W1.26.71.G05.1.454.CMB.1.raw
  modified_base (235)..(235): a, c, t, g, unknown or other
  misc_feature (235)..(235): n is a, c, g, or t
  modified_base (407)..(407): a, c, t, g, unknown or other
  misc_feature (407)..(407): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaattggganatagaaatgctgcctggtattaccagaggccaggccacgtcccctattttggcatcttccaagataagagcggccctcgaggatccctgaccgtattctggctccaactcgtacgggaacacacgccactcctgaccatcgagccgggcccagccgaacggatggacggganactaactagttcgaccgaggtccgtaggggaagtaacgttaacgttagtttacggttaaggtttggttttacgggaccgggtaggggaacccgtaggggtaccgtacgggtaaccccggttccggttaacgggtcccaacgggtacccccgtaagggtcccgttacccggaccccccggttacggttacccgtacccgtttccgttacccgtttacccccg

SEQ ID NO: 166812 - DNA, 538 bp, Homo sapiens
  misc_feature: GYAE6OF02FR24P.26.71.G05.1.454.CMB.1.raw
  modified_base (238)..(238): a, c, t, g, unknown or other
  misc_feature (238)..(238): n is a, c, g, or t
  modified_base (315)..(315): a, c, t, g, unknown or other
  misc_feature (315)..(315): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccaccctcagtgtcccgtgtccccaggacagacagccaccatcacctgctcggcagacaaattggganatagaaatgctgcctggtattaccagaggccaggccagtcccctattttggtcatcttccaagataagagcgccctnacgggatccctgaccgaatttctggctccaactctaggaacacagccactctgaccatcaggccggggcccagccaacggatggagggagactactattgtcaggcgtagggagtaatacgtattgtagtggtttgcggagggaccaggctgaccgtcgtaggtccacggacccgaaggcctaccggcccccttaccggtcaccgttccgtccggttaccccc

SEQ ID NO: 166813 - DNA, 490 bp, Homo sapiens
  misc_feature: GYAE6OF02HD4Q7.26.71.G05.1.454.CMB.1.raw
  modified_base (238)..(238): a, c, t, g, unknown or other
  misc_feature (238)..(238): n is a, c, g, or t
  modified_base (298)..(298): a, c, t, g, unknown or other
  misc_feature (298)..(298): n is a, c, g, or t
  modified_base (304)..(304): a, c, t, g, unknown or other
  misc_feature (304)..(304): n is a, c, g, or t
  modified_base (311)..(311): a, c, t, g, unknown or other
  misc_feature (311)..(311): n is a, c, g, or t
  modified_base (323)..(323): a, c, t, g, unknown or other
  misc_feature (323)..(323): n is a, c, g, or t
  modified_base (334)..(334): a, c, t, g, unknown or other
  misc_feature (334)..(334): n is a, c, g, or t
  modified_base (353)..(353): a, c, t, g, unknown or other
  misc_feature (353)..(353): n is a, c, g, or t
  modified_base (359)..(359): a, c, t, g, unknown or other
  misc_feature (359)..(359): n is a, c, g, or t
  modified_base (361)..(361): a, c, t, g, unknown or other
  misc_feature (361)..(361): n is a, c, g, or t
  modified_base (382)..(382): a, c, t, g, unknown or other
  misc_feature (382)..(382): n is a, c, g, or t
  modified_base (402)..(402): a, c, t, g, unknown or other
  misc_feature (402)..(402): n is a, c, g, or t
  modified_base (433)..(433): a, c, t, g, unknown or other
  misc_feature (433)..(433): n is a, c, g, or t
tcagagactatactcacgaccggtgctcgatttagtgtcgtcgcaagagagaggggcgtggcgtcaggagcagcatcggaggtgcctcagcccatggcatggatccctctcttcctcggctccttgcttactgcacaggatccgtggccttcgatgagctgattcagcccaccctcagtcgtcccgtgtcccccaggacagacagccaccatccacctgcctcggcagacaaatgganatagaatgctgcctgtacttaccagagcagccagtccctatttgcatctcaagataagancgcctnaggctcngaccgtaattcngactccaatcncggaacacacgccactcanacccancncgcggccgacgaccgacgagngaggagactactagtgtggngagagagagtatatgtgtgttgcggagacgngcgtcgtcgtacgtcgtacacgaccgacgcgccgccgtccgtcgtctccgtcctccc

SEQ ID NO: 166814 - DNA, 705 bp, Homo sapiens
  misc_feature: GYAE6OF02ID1NY.26.71.G05.1.454.CMB.1.raw
  modified_base (237)..(237): a, c, t, g, unknown or other
  misc_feature (237)..(237): n is a, c, g, or t
tcagagactatactcacgaccggtgctcgatttagtgtcgtcgcaagagagaggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatccacctgctcggcagacaaagttggganatagaaatgactgcctggtattaccgagagccaggccacgtccccttattttggtctatcttaccaagataagaacgccggccctcgaggggactccccgtagtaaccgtaatttccgtcggacctccaacgttcgtacgggaaccaacacgcccactacgtcgacctagtccgacggtccggggacccacgaccgaaacgggactcgggaacgggacgtaaccttaacgttagttacggtaccgagggtacggtaagggtaacgtaaacgttacgttaagtttaggttaaggtttcgggttttacgggacggggaaacggggtacccgaagggttccgtaccgggtaacccggttccggtaacgggtacccgtaccggggtaacccgtaaccgggtcccggttacccggtaccccccggtaccggtttaccccgaccgttttccccggtacccgggtttcccccccg

SEQ ID NO: 166815 - DNA, 552 bp, Homo sapiens
  misc_feature: GYAE6OF02IKEL3.26.71.G05.1.454.CMB.1.raw
  modified_base (234)..(234): a, c, t, g, unknown or other
  misc_feature (234)..(234): n is a, c, g, or t
  modified_base (402)..(402): a, c, t, g, unknown or other
  misc_feature (402)..(402): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccagtacagacagccaccatcacctgctcggcagacaaattggganatagaaatgctgcctggtattaccagaggccaggccagtcccctattttggtcatcttccaagataagaagcggcctcgagggactccctgaccgaatttctggctccaactctggaacacacgccactcagaccatcagccgggcccagacccaaggatggaggganactactattcgtcgaggcgtagggagaatacgtagttagtagtgtttggcgggtaggaccgaggtctacggaccgtcgtaggtccgacggcccgaaggtcctaccgcccccgtcggtcctaccgtccgtacgttcccccgcccttacccg

SEQ ID NO: 166816 - DNA, 643 bp, Homo sapiens
  misc_feature: GYAE6OF02H0NUQ.26.71.G05.1.454.CMB.1.raw
  modified_base (235)..(235): a, c, t, g, unknown or other
  misc_feature (235)..(235): n is a, c, g, or t
tcagagactatactcacgaccggtgctcgatttagtgtcgtcgcaagagagaggggcgtggctcaggagcagcatcggaggtgcctcagccatggcatggatccctctcttcctcggcgtccttgcttactgcacaggatccgtggccttcgatgagctgattcagccaccctcagtgtccgtgtaccccaggacagacacgccaccatccacctgctcggcagacaattggganatagaaatgctgcctaggtattaccagaggccaggccacgtcccctattttcggtcatcttccaagataagaacgtcggccctacgagggctcccgtcggaacctaatttctacggctaccaactcgtgggaacaactacgccactctacgaccatccgacggccggggacccacggtaccaacgggactggacgggtacgtaacctacttagtgtccgaagggtcggtcggaagaattaccgtagtttcgttaagtcggttttgggacggagggtaccgaggtcgttacggaccggtttacccggtaagggttacccgaacgggtacccccggtaaaggtcccgttacccgggccccccgttccgggttaccccgtacccgtttacccgttcgtttaaccccccccg

SEQ ID NO: 166817 - DNA, 514 bp, Homo sapiens
  misc_feature: GYAE6OF02FL9U9.26.71.G05.1.454.CMB.1.raw
  modified_base (502)..(502): a, c, t, g, unknown or other
  misc_feature (502)..(502): n is a, c, g, or t
tcagagactatactcacgaccggtgctcgatttagtgtcgtcgcaagagagaggggtccattccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggtcatctttccaagataagaagcggccctcagggatccctgaccgaatttctggctccaactctgggaacacagccactctgaccatcagcgggcccagccaacggatgagggagactactattgcaggcgtgggagaatactattgtagtgttggcggagggccaggctgacgtccgtaggtcagcccaaggcctgcccctcggtccactctcgtcccgccctcctcacgtactacgtctctcgngcgggctggacg

SEQ ID NO: 166818 - DNA, 521 bp, Homo sapiens
  misc_feature: GYAE6OF02F5RM8.26.71.G05.1.454.CMB.1.raw
  modified_base (513)..(513): a, c, t, g, unknown or other
  misc_feature (513)..(513): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggcatcttccaagataagaagcggcctcaggatccctgaccgaatttctgctccaactctagggaacacagccactctgaccatcagcgggcccagccaacggatgaagggagactactattgtcaggcgtgggagaagtactagttgtagtgtttggcggtagggaccaggctgaccgtccgtaggtcgagcccaaggcctcgcccctggtcctactcgtcgttccccnccctcccg

SEQ ID NO: 166819 - DNA, 565 bp, Homo sapiens
  misc_feature: GYAE6OF02GVB4L.26.71.G05.1.454.CMB.1.raw
  modified_base (236)..(236): a, c, t, g, unknown or other
  misc_feature (236)..(236): n is a, c, g, or t
  modified_base (326)..(326): a, c, t, g, unknown or other
  misc_feature (326)..(326): n is a, c, g, or t
  modified_base (339)..(339): a, c, t, g, unknown or other
  misc_feature (339)..(339): n is a, c, g, or t
  modified_base (415)..(415): a, c, t, g, unknown or other
  misc_feature (415)..(415): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctattttggtcatcttccaagataagaagccggccctcaggactcccngacccgtaattcnggctaccaactcgtagggaacacacgccactctgaccatcgacgcgggcccacgccgaacggacgtaggacggganacgtactattgtacgaggcggtgggagtaagtactagttagtaggttgtttagggcgggaggaaccgagggcgtacgaccgtaccgtaggtaccacggtcccaacggccgtaccggcccccgtcggtcctaccgtccgtccgttcccccg

SEQ ID NO: 166820 - DNA, 521 bp, Homo sapiens
  misc_feature: GYAE6OF02GKN4D.26.71.G05.1.454.CMB.1.raw
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggtcatcttccaagataagaagcggccctcagggatccctgaccgaatttctggctccaactctgggaacacacgccactctgaccatcagccgggccagccaacggatgagggagactactattgtcaggcgtggagatactatgtagtgttggcggagggacaggctgaccgtcgtaggtcgacgacccaaggtcctcgcccccgtcggtcctacctccgtcgttccccgcccttcccg

SEQ ID NO: 166821 - DNA, 539 bp, Homo sapiens
  misc_feature: GYAE6OF02IESCB.26.71.G05.1.454.CMB.1.raw
  modified_base (231)..(231): a, c, t, g, unknown or other
  misc_feature (231)..(231): n is a, c, g, or t
  modified_base (471)..(471): a, c, t, g, unknown or other
  misc_feature (471)..(471): n is a, c, g, or t
  modified_base (478)..(478): a, c, t, g, unknown or other
  misc_feature (478)..(478): n is a, c, g, or t
  modified_base (519)..(519): a, c, t, g, unknown or other
  misc_feature (519)..(519): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctatttggtcatcttccaagataagaagcggccctcgagggatcccgtgaccgaatttctcggctccaactctagggaacacgagccactctcaccactccacggcggggccccagacccgaaacgggatcggaagggaacgacttaactatttcgacagggcgtgggagaagtactagttgtagttgttgggacggnggtaccnggctgaccgtcgtaggtcagccaaggcctcgcccctcggcnccgtcgtcttccccacctcc

SEQ ID NO: 166822 - DNA, 555 bp, Homo sapiens
  misc_feature: GYAE6OF02I4GM0.26.71.G05.1.454.CMB.1.raw
  modified_base (231)..(231): a, c, t, g, unknown or other
  misc_feature (231)..(231): n is a, c, g, or t
  modified_base (395)..(395): a, c, t, g, unknown or other
  misc_feature (395)..(395): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctattttggtcatcttccaagataagaagcggccctcgagggactccctgaccgtaatttctggctccaactcgtaggaacacagccactctagaccatccgagccgggcccagccaacggntggagggacactactagttgacgaggcgtgggaagattacgtagttgtagttggtttagggcgggtagggacgaggtcgtacgtaccgtcgtacggtcacggaccacggtcctccgccccgtcggtcctaccgttctacccgttccccacccgttacccg

SEQ ID NO: 166823 - DNA, 696 bp, Homo sapiens
  misc_feature: GYAE6OF02IM7KS.26.71.G05.1.454.CMB.1.raw
tcagagactatactcacgaccggtgctcgatttagtgtcgtcgcaagagagaggggggactcctgtgccccaccatggacacgctttgctccacgctcctgctgctgaccatcccttcatgggtcttgtcccagatcaccttgaaggagtctggtcctgcgctggtggagcccacgcagaccctcacgctgacctgctccgtctctggattctcactcaccacgactgaggtgaatggtggccgtgggtccgtcgacggccccccggaaaggccctggagtggcttgcactctatttacgtgggagtgacttctcaaggcggtacaactccgtctcgtagaggaactcgactcaccataccaccgaggaccacctaccgaaaacggacccggggttacggtaccctttaacgaacgtcggaaccccgaactaagtacgaaacttcccgttaggtacgggaaccaaccggagggacctaacgtaatttaactttaccgttcgtacgaccaaccgtaacgtaaccggttacccgtaacggccgggtacgtaacccggaacgaaaaggtaaaaaaacgtaattaacgtacgtaacgttaacgggttacgggggaaccgtaagggggtttaaacttttcgggtaaccctaccggttccctaccccgaccggtccccttaccccgaaccgtaaccccgggg

SEQ ID NO: 166824 - DNA, 518 bp, Homo sapiens
  misc_feature: GYAE6OF02FWYKJ.26.71.G05.1.454.CMB.1.raw
  modified_base (236)..(236): a, c, t, g, unknown or other
  misc_feature (236)..(236): n is a, c, g, or t
  modified_base (426)..(426): a, c, t, g, unknown or other
  misc_feature (426)..(426): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctattttggcatcttccaagataagaagcggccctcagggatccctgaccgaattctggctccaactctagggaacacagccactctgaccatcagccgggcccagccaacggatgagggagactactattgtacgaggcgtaggganaagtactagttgtagttgtttggcggaggaccaggctgaccgtccgtaggcacgcccaggcctcgccccgtcggtccacgtcctcgttcccc

SEQ ID NO: 166825 - DNA, 795 bp, Homo sapiens
  misc_feature: GYAE6OF02HS4VZ.26.71.G05.1.454.CMB.1.raw
  modified_base (236)..(236): a, c, t, g, unknown or other
  misc_feature (236)..(236): n is a, c, g, or t
tcagagactatactcacgaccggtgctcgatttagtgtcgtcgcaagagagagggggggccgtcgaggaagcagcatcggaggtgcctcgagccatggcatggatccctctcttcctcggcgtccttgcttactgcacaggatccgtggccttcgatgagctgattcagccaccctcagtgtccgtgtccccaggacagacagccaccatcacctgctcggcagacaaattggganataagaatgctgcctggtattaccgagacggccaaggccacggttccccctagttttcggtacaacttccgttaccaaaggtactaaagaacggccggtccccttacgaggggtacctccccttaggaacccggttaaatttcccgtggggtacccttacccgaaacgttccgtttacggggaaaacccaactacgggtaccctaaaccttccgttacggaccctacgttaccgaacggtcccgggggaccccaacgggaaccccgaaacccggggttaagtacggggaaccggggaaacgggtaccttaaacgttaacggttacggtaccggttaacggggaccgggttagggggaaagtaaaccgttaacgttaacggtttaggttacggtttaacgggttttggggaccgggtaagggtaccggagggaccttacgggtaacccgtcgttaacgggtccgtaacggacccggttaacgggcccgttaccgggtcccccggttaaccggtccgttaacccgtcccgtttccggtttacccccggaccctttacccgg

SEQ ID NO: 166826 - DNA, 584 bp, Homo sapiens
  misc_feature: GYAE6OF02GGL3R.26.71.G05.1.454.CMB.1.raw
  modified_base (236)..(236): a, c, t, g, unknown or other
  misc_feature (236)..(236): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctattttggtcatcttccaagataagaagcggccctcagggactcctgaccgtaatttctggcctaccaactcttaggaacacagccactctacgaccatcgacggccggggcccaggacccaaacgggatcggaagggagactaacgtattcgtcagggcggtagggaagaatactagtttagtagttggtttaggcgggaacgggtaccgagggtctacggaccgttccggtaggtaccacggacccgaagggtcctaccggcccccgtccgggtacctaccgttaccgttcggttaccccccg

SEQ ID NO: 166827 - DNA, 663 bp, Homo sapiens
  misc_feature: GYAE6OF02G5MQA.26.71.G05.1.454.CMB.1.raw
  modified_base (235)..(235): a, c, t, g, unknown or other
  misc_feature (235)..(235): n is a, c, g, or t
  modified_base (327)..(327): a, c, t, g, unknown or other
  misc_feature (327)..(327): n is a, c, g, or t
tcagagactatactcacgaccggtgctcgatttagtgtcgtcgcaagagagaggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgactgcctggtattaccagaggccaggccagtcccctatttggcatctcaagataagagcgcctgaggatcctgaccgtattcngctaccaactcgtagggaacacacgaccactcctacgacccagtaccgacggccggggaccccaggacccgaaacgggtacgtagggaacggggaacgtaaccttaacgttagtttacggacgaggggtaccggttaggggaagtaaacgttaccgttaagtttagggttaaggtttcgggttttacgggacggggtaacggtaaccgtagggtccgttacggtaaccccggttacggttaacgggtacctaaccgggtaccccgaacgggtcccgttcccggtaccccccgttccgggtaccctaccccgtttaccgttcccgttaacccccccg

SEQ ID NO: 166828 - DNA, 639 bp, Homo sapiens
  misc_feature: GYAE6OF02IRG9T.26.71.G05.1.454.CMB.1.raw
  modified_base (237)..(237): a, c, t, g, unknown or other
  misc_feature (237)..(237): n is a, c, g, or t
tcagagactatactcacgaccggtgctcgatttagtgtcgtcgcaagagagagggggcgtgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctattttggtcatcttaccaagataagagcggcctcagggatcctgaccgtaattctggctccaactcgtagggaacacacgccactcctcgaccctatacgaacggccggggacccacggaccgaaacgggatagggaggggacaaccgttaacttagttcggtacgacgggtacggtagggaacgtaacgttaacgttagtttacggttaggtttacggttttcggggacggggtaagggtaccgtagggtaccgtcgggtaacccggttccggtaacgggtccgaacggtccccgtaacggccgtcccggtacccccgtccgggttaccctaccgttccgttcccggttccccccgg

SEQ ID NO: 166829 - DNA, 604 bp, Homo sapiens
  misc_feature: GYAE6OF02GBQDQ.26.71.G05.1.454.CMB.1.raw
  modified_base (310)..(310): a, c, t, g, unknown or other
  misc_feature (310)..(310): n is a, c, g, or t
  modified_base (319)..(319): a, c, t, g, unknown or other
  misc_feature (319)..(319): n is a, c, g, or t
  modified_base (330)..(330): a, c, t, g, unknown or other
  misc_feature (330)..(330): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggcatcttccaagataagaagcgcctnagggatccngaccgatttcnggctcaactctaggaacacacgccactctgaccatcgacggccggggcccacggacccaaacgggatcgggaacggggaacgtaacgtaaccttaagttcggtaccgaaggggtcggtaggggaactaaacgttaacgttaagtttggttaaggtttggttttcgggacgggtaggggtaccgagggtctacggacccgtccgtacggtccgacggcccgaagggtcctaccgcccccgtggtcctaccgttcctcgttccccacccgttcccg

SEQ ID NO: 166830 - DNA, 687 bp, Homo sapiens
  misc_feature: GYAE6OF02HV2V6.26.71.G05.1.454.CMB.1.raw
  modified_base (235)..(235): a, c, t, g, unknown or other
  misc_feature (235)..(235): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcactgctcggcagacaaattggganatagaaatgctgcctggtacttaccagaggccaggcccacgttccccttagttttcggctattccttaccaaagaataaaggaacgccggccctcgaacgggactccctagaacccgtaatttcgtggcctccaaactcgtacgggaacacacgccactctacgacctatccgacggcccgggacccaggacccgaaacgggagtacgggaacggggactaaccgttaacgttagtttcggtacgaggggtccggttaggggaacgtaaacgttacgttacgtttaggttacggtttgggtttacggggacgggaacggtaccgtagggtaccgttacggacccggttaccggtaacgggttacccgaccggaacccgtaacggggtcccttacccgggtaccccccgttacgggtacccctacgtttaccccgttcccgtttacccccccg

SEQ ID NO: 166831 - DNA, 641 bp, Homo sapiens
  misc_feature: GYAE6OF02GF938.26.71.G05.1.454.CMB.1.raw
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgactgcctggtattaccagaggccaggccagtcccctattttggtcatcttccaagataagaagcggccctcagggactccctagacctaatttctggctaccaactcgtagggaacacgagccactctcgaccatccgaggccgggcccagacccgaacggactaggaacggggacgaccgtacttaagttcgtacgtacgggcggttacggggaagtaattaacgttaagtttagggttagtttgggttttaggggaccgggtaacgggggaacccgtacgggtcgtacggtacccggtaccgttacgggtaccgtacggaccccgtaacgggtccttcccggcccccgttcggtacccaccgttcccgttccggtttacccccgccccttaccccg

SEQ ID NO: 166832 - DNA, 580 bp, Homo sapiens
  misc_feature: GYAE6OF02JOZWW.26.71.G05.1.454.CMB.1.raw
  modified_base (233)..(233): a, c, t, g, unknown or other
  misc_feature (233)..(233): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaatgctgcctggtattacagaggccaggccagtccctatttggcatctccaagataagagcgcctcaggactccctgaccgaattctaggctccaactctgggaacacagaccactcgtacgaccatcacggcggggcccacgccgaacggacgtagacgggagactaactattggtacaggcggtagggagtaaattacgtattaggtacgttgtttgggacgggtagggtaccgagggtcgtacggtacccggtcgtacgggtacgacggaccgtaacgggccgtaccggtcccccgtacggtaccaccgttaccgtccggtttaccccgcccttccccgg

SEQ ID NO: 166833 - DNA, 687 bp, Homo sapiens
  misc_feature: GYAE6OF02FT4TI.26.71.G05.1.454.CMB.1.raw
tcagagactatactcacgaccggtgctcgatttagtgtcgtcgcaagagagaggggcgtggcctcaggaagcagcatcggaggtgcctcagccatggcatggatccctctcttcctcggcgtccttgcttactgcacaggatccgtggccttcgatgagctgattcagccaccctcagtcgtccgtgtccccaggacagacagcccaccatccacctgccgtcggccagaactaaagttggggaagataagaaagtgctgcctaggttacttaccgagacggccacggcccacggttccccttagttttcggactacttccttacccaaaggtaataaaggaaacggccggtacccctaggaacggggtaactccccgtacggtaacccgtaattttcgcggtacctacctaaactcgtacgggaaacacgacgacctacgtcctacgacctataccgacggccgggaccgacgaccgaaacggtagtacgggacgggaactacgttaacttagttcgtacggacgggtcggtagggagtaagtacgttagtttaggtaggtttgggtttcgggacgggtacggaccgtacgttcgtaccggtaccgtccggtacgtccggacggtaccccgaacggtccgtccgtcccccggttggtacccgtacttcccggtccgttccccccgg

SEQ ID NO: 166834 - DNA, 689 bp, Homo sapiens
  misc_feature: GYAE6OF02G2GC3.26.71.G05.1.454.CMB.1.raw
  modified_base (231)..(231): a, c, t, g, unknown or other
  misc_feature (231)..(231): n is a, c, g, or t
tcagagactatactcacgaccggtgctcgatttagtgtcgtcgcaagagagaggggcctcacggaagcagcactcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaattggganatagaaatgctgcctggtacttaccagtagccaggcctacgtccccttatttcggctatcttccaagtataacgaagccggaccctcgagggacctcccgtagacccgtaatttcctaggcctaccgaacgttcgtacgggaacctacgacgccctactctcgacctacgtaccgaggcccgggtaccccaggaccccgaaacgggagtacgggaacgggtaacgtaacccgtacgtacgtttacggtaccgagggtaccggttacgggtaagtaaccgttacgttaagttacggttaggtttcgggttagggccgggtaagggtaccgaggtaccgttacgtaccgttaccggtacggtaccgacggtaccccgaacgggtcccttacccgggaccccccgttccggtacccgttacccgttcccgttacccgttaccccgaacccccgtttcccgg

SEQ ID NO: 166835 - DNA, 690 bp, Homo sapiens
  misc_feature: GYAE6OF02GEQO7.26.71.G05.1.454.CMB.1.raw
  modified_base (236)..(236): a, c, t, g, unknown or other
  misc_feature (236)..(236): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctattttcggtcactcttccaagataagaagcggccctcagggatcctgaccgtaatttcgtggtcctacctaactcgtagggaaccacgacgcccactcctcgaccactcgacggaccggggccccacggacccgaaacgggacgtgggaacgggacgtaacgtacgtacgttcggtacgtacgggacggtaggggaacgtaagttaacgttaacgttttagggttaaggtttacgggttttagggtaccgggtaacggggaacccgtaagggtcccgttacgggtaccccggttacccggttaacgggttacccgtaaccgggacccccgtaaagggtacccggttacccggtccccccggttaccggggttcccctaacccgtttcccggtaccggtttaccccccccg

SEQ ID NO: 166836 - DNA, 658 bp, Homo sapiens
  misc_feature: GYAE6OF02I6YRG.26.71.G05.1.454.CMB.1.raw
  modified_base (289)..(289): a, c, t, g, unknown or other
  misc_feature (289)..(289): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagagccaggcagtcccctattttggtcattnttccaagataagaagcggaccctcagggatcccgtgaccgaatttcgtagctaccaactctagggaaacacagccactctcgaccatcacggccgggcccagccgaaacggagtcgaacgggagacctaacgtaatttggactaaggccggtaggggaagtaaacgtaacgttaatttacggttaaggttcggttttaagggacgggtaacgggggtaacccacggggtaccgttacggtaacccggttacctttaaccggggtaccaaccgggtccccgaaaacggggtcccgttacccggtaccccccgttccgggtaaccctacccgtttacccgtccggttttaccccccgccccctttaccccg

SEQ ID NO: 166837 - DNA, 528 bp, Homo sapiens
  misc_feature: GYAE6OF02GAE79.26.71.G05.1.454.CMB.1.raw
  modified_base (237)..(237): a, c, t, g, unknown or other
  misc_feature (237)..(237): n is a, c, g, or t
  modified_base (340)..(340): a, c, t, g, unknown or other
  misc_feature (340)..(340): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggaccagacagccaccatcacctgctcggcagacaaattggganatagaaatgctgcctggtattaccagaggccaggccagtcccctattttggtcatccttccaagataagaagcggccctcacgggatccctgaccgaatttcnggcctccaactctagggaacacagcccactctcgaccatcagcggggcccagccaaacgggatggaggagactactattcgtcaggcgtgggagtaatactattgtaagtgtttggcggtagggaccagggctggaccgtcgtaggcaggtcccgaagcctcgccccgtggtccactcgtgtcccccg

SEQ ID NO: 166838 - DNA, 575 bp, Homo sapiens
  misc_feature: GYAE6OF02F12I5.26.71.G05.1.454.CMB.1.raw
tcagagactatactcacgaccggtgctcgatttagtgtcgtcgcaagagagaggggtccatgccatggcatggatccctctcttcctcggcgtccttgcttactgcacaggatccgtggccttcgatgagctgattcagccaccctcagtgtcccgtgtcccccaggacagacagccaccatcacctgctcggcagacaaattgggagatagaaatgctgcctggtattaccagagccaggccagtcccctatttggtcatcttccaagataagaagcggccctcaggatccctgaccgaatttctgctccaactctgggaacacacgccactctgaccatcagcgggcccagcccaacggatggagggacgactaactattcgtcaggcgtgggagaatactattgtaggttgtttggcggagggaccgaggccgtggaacccgtcgttacggtccgagcccgaaggcctacgcccccgttccgggtctacccgttcgtcggttccccgtccccgttcctacccgtacgttacgttaccgttccttaccgttcggtacggcgggtaccgtcggg

SEQ ID NO: 166839 - DNA, 578 bp, Homo sapiens
  misc_feature: GYAE6OF02GXETC.26.71.G05.1.454.CMB.1.raw
tcagagactatactcacgaccggtgctcgatttagtgtcgtcgcaagagagaggggtccatgccatggcatggatccctctcttcctcggcgtccttgcttactgcacaggatccgtggccttcgatgagctgattcagccaccctcagtgtccgtgtcccccaggacagacagccaccatcacctgctcggcagacaaattgggagatagaaatgctgcctggtattaccagaggccaggccagtcccctatttggtcatcttccaagataagagcggccctcgagggactcccgtgaccgtaatttctggtctccaactctagggaacacagccactctcgaccatcgagccgggcccagccaacggatggagggagactactatgtcgaggcgtgggagaatactagttgtaggttggtttggcgggagggtaccgaggtccgtcgaccgtaccgtaggtcacggcccgaaggcctccggtcccccgtcggtccaccgttccgtaccggtttcccccgcccttccgtccgtaacgttacgtacgttcgtaccgtggacggtcgggtaccgtcggg

SEQ ID NO: 166840 - DNA, 530 bp, Homo sapiens
  misc_feature: GYAE6OF02G3P9K.26.71.G05.1.454.CMB.1.raw
  modified_base (308)..(308): a, c, t, g, unknown or other
  misc_feature (308)..(308): n is a, c, g, or t
  modified_base (480)..(480): a, c, t, g, unknown or other
  misc_feature (480)..(480): n is a, c, g, or t
tcagagactatactcacgaccggtgctcgatttagtgtcgtcgcaagagagaggggtccatgccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtccccctattttggtcatcttccaagataagaagcggccctcagggatccctgaccgaatttcnggctccaactctgggaacacagccactctgaccatcagcggggcccagccaacggatggagggagactactattgtcgaggcggtggagaatactattgtagttgtttgggcggtagggaccaggctcggaccgtccgtaggtcaacgcccaaggcctcgccccctggtccnctctcgttccccaccctccctacactatactcctcgtgacgtcggctcgg

SEQ ID NO: 166841 - DNA, 524 bp, Homo sapiens
  misc_feature: GYAE6OF02GYG6V.26.71.G05.1.454.CMB.1.raw
  modified_base (234)..(234): a, c, t, g, unknown or other
  misc_feature (234)..(234): n is a, c, g, or t
  modified_base (333)..(333): a, c, t, g, unknown or other
  misc_feature (333)..(333): n is a, c, g, or t
  modified_base (391)..(391): a, c, t, g, unknown or other
  misc_feature (391)..(391): n is a, c, g, or t
  modified_base (399)..(399): a, c, t, g, unknown or other
  misc_feature (399)..(399): n is a, c, g, or t
  modified_base (423)..(423): a, c, t, g, unknown or other
  misc_feature (423)..(423): n is a, c, g, or t
  modified_base (452)..(452): a, c, t, g, unknown or other
  misc_feature (452)..(452): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctattttggcatctccaagataagagcggccctcagggatccctgaccgtaatttcnggcctccaactctagggaacacagccactctgaccatcagccgggcccagccaacggntggagganactactattgtcgaggcgtggganatactattgtagtgttggcggagggaccnggctgaccgtcgtaggtcacggcccaaggcctcgccccgtcggtccaccgtcctcgttccccgcccttcccg

SEQ ID NO: 166842 - DNA, 687 bp, Homo sapiens
  misc_feature: GYAE6OF02GRK1S.26.71.G05.1.454.CMB.1.raw
  modified_base (236)..(236): a, c, t, g, unknown or other
  misc_feature (236)..(236): n is a, c, g, or t
  modified_base (324)..(324): a, c, t, g, unknown or other
  misc_feature (324)..(324): n is a, c, g, or t
  modified_base (336)..(336): a, c, t, g, unknown or other
  misc_feature (336)..(336): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccacgtcccctattttggtcatcttccaagataagaagcggccctgaggatccngaccgtaattcnggctaccaactcgtagggaacacgacgacccactctcgaccagtccacggccggggacccacggaccgaaacgggatacgggaacggggacgtaaccgttaaccgttattcggttacgacggggtacggtaggggaacgttaaacgtaaccgttaagtttacgggttaacggtttggtttttacgggggaccggggtaacggggaacccgaggggtaccgttacggtaacccggttacccggttaacgggttacccggaacggtacccccgtaaagggtcccgttcccgggtaccccccgtttcgggttaccccctaacccggtttcccgttaccccggtttacccccccc

SEQ ID NO: 166843 - DNA, 538 bp, Homo sapiens
  misc_feature: GYAE6OF02FRIAP.26.71.G05.1.454.CMB.1.raw
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctatttggtcatcttccaagataagaagcggccctcgagggactccctgaccgtaatttctggctaccactctggaacacagccactctgaccatcgagcgggcccagccaacggatgagggagactactattgtcaggcgtgggagaagtactattagtagtggtttgggcggtagggaccaggctcgtaccgtccgtacggtcgagcccaaggtccgtcgcccccgtcggtccaccgttcgtccgttccccgccctcccg

SEQ ID NO: 166844 - DNA, 692 bp, Homo sapiens
  misc_feature: GYAE6OF02GAJXP.26.71.G05.1.454.CMB.1.raw
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaagttgggagatagaatgctgcctggtattaccagaggccaggccacgtcccctatttcggtcatcttcaagataagaagcggccctgaggactcccgtgaccgtaatttcgtggcctaccaactcgtagggaaccaacgacgccctactcctacgacccataccgacgggccggggaccccaaggacccgaaacgggagtacgggaacggggaacgtaaccttaacgttagtttcggtaccgaagggtccggtaggggaagtaaacgttaccgttaagtttggttaacggtttgggttttacggggacgggtaacgggtaaccggacgggtaccgttacgggtaacccggttaccggttaacgggttacccgaaccgggtaccccgtaaacgggtcccgttacccggtaccccccggttccgggtaccctacccggtttacccgttccccggtttacccccccg

SEQ ID NO: 166845 - DNA, 586 bp, Homo sapiens
  misc_feature: GYAE6OF02ILPRZ.26.71.G05.1.454.CMB.1.raw
  modified_base (234)..(234): a, c, t, g, unknown or other
  misc_feature (234)..(234): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccagccagtccccttatttggtcatcttaccaagataagaagcggcctcgaggactcccagaccgatttctggctccaactctacgggaacacacgccactctgaccatcgaggccgggcccagaccgaacggataggagggagaacctacgtagttagcgaggcggttagggaagtaactacgtattaggtagttggtttagggcgggtacgggaaccgaggtcgtacggacccgttcgtagggtaccacggacccgtaagggtccctaccggtacccccgttcggccttaccgtccgttccgttaccccaccccttacccg

SEQ ID NO: 166846 - DNA, 670 bp, Homo sapiens
  misc_feature: GYAE6OF02IB1B4.26.71.G05.1.454.CMB.1.raw
  modified_base (238)..(238): a, c, t, g, unknown or other
  misc_feature (238)..(238): n is a, c, g, or t
tcagagactatactcacgaccggtgctcgatttagtgtcgtcgcaagagagaggggctgggcctcaggaagcagcatcggaggtgactcagccatggcatggatccctctcttcctcggcgtccttgcttactgcacaggatccgtggccttcgatgagctgattcagccaccctcagtgtccgtgtccccaggaccagacagccaccatccacctgctcggcagacaaagttggganatagaaatgctgcctaggtacttaccgagaggccaggcccagtccccttattttcggtctatctaccaagataagacgcgcctacgaggactccctgaccgattctcggctccaactcacggacacacgccactctacaccagtcgacggccggggacccacggacccgaaacggacgtacgggacgggaaacgtaaccttacgttaattcggtaccgtaaggggccgtaagggaacgttaaacttaaaccggttatttacgggttaaggtttgggtttacgggacggggaaacgggtacccgagggtccgtacggtaacccggttacccggtaagggttacccgaacggtacccccgtaaacgggtccctaccccgggtacccccgtaccgggttacctacccgtttacccggttccgtttacccccccgg

SEQ ID NO: 166847 - DNA, 669 bp, Homo sapiens
  misc_feature: GYAE6OF02JGX88.26.71.G05.1.454.CMB.1.raw
  modified_base (234)..(234): a, c, t, g, unknown or other
  misc_feature (234)..(234): n is a, c, g, or t
tcagagactatactcacgaccggtgctcgatttagtgtcgtcgcaagagagaggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgganatagaaatgctgcctggtattaccagaggccaggccagtcccctatttcggtcatcttccaagataagaagcggccctcagggactcccgtgaccgtaatttctacggctccaactctacgggaacacgagcccaatcctagaccatacgacggtccgggacccacggacccgaaacgggactacggaagggacgtactaacgttacttttacgaacggtcggttacgggaagtaacgttaacgttactttaggtaacggttgggttttagggaccgggttaagggggtaacccgaggggtaccgttacgggtacccgttacggtacgggttacccgtaacggtaccccggtaaacgggtcccggttaccggtcccccccggttcgggtacccgttacccgttcccgtttacccggttacccccgttaacccccg

SEQ ID NO: 166848 - DNA, 666 bp, Homo sapiens
  misc_feature: GYAE6OF02IURHB.26.71.G05.1.454.CMB.1.raw
  modified_base (236)..(236): a, c, t, g, unknown or other
  misc_feature (236)..(236): n is a, c, g, or t
  modified_base (325)..(325): a, c, t, g, unknown or other
  misc_feature (325)..(325): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaatgctgcctggtattaccagaggccaggccacgtcccctattttggtcatcttccaagataagaagccggcctcgaggactccngaccgtaattctcggctccaactcgtggaacacgacgccactctagaccatccaggccgggcccaggcccgaaggactggaacggggacgtaaccgtaactaagtttcggtacgaaggggtccggtaggggaacgtaaacgttaacgttaagtttggtaagggtttgggttttacggggacggggtaacgggtaacccgtaggggtaccgttacgggtaacccggttacccggtaagggttacccgaaccgggtaccccgaaacggggtcccgttacccgggacccccccggttacgggttccccgtaaccgtttcccggttaccccggtttcccccccgg

SEQ ID NO: 166849 - DNA, 702 bp, Homo sapiens
  misc_feature: GYAE6OF02JGCUI.26.71.G05.1.454.CMB.1.raw
  modified_base (228)..(228): a, c, t, g, unknown or other
  misc_feature (228)..(228): n is a, c, g, or t
tcagagactatactcacgaccggtgctcgatttagtgtcgtcgcaagagagaggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccacatcacctgctcggcagacaattggganatagaatgctgcctggtattaccagaggccaggccagtcccctatttggcagtcttccaagataagaagcggaccctgagggactccccgtaggaccgtaatttctacggtaccttaccgaaccttcgttagggaaaccacgtacgaccctactcctacggaacccacgttaccgacggcccggggtaccccaacggccccgaaacgggattagggaacggggtaactaaccgtacgttagttcgtacgaacgggtcgtacgggtaacgtaacgttaccgtaagtttcggttaagtttcgggttttacgggaccggggttaacgggtaacccggtaagggtccgttacggtacccggttaccgttacgggttaccgaacggtaccccgtaaagggtccccgttaccggtaccccccgttacgggttaccctacccgtttccgtacccggtttaccccgccccgtttaaccccgg

SEQ ID NO: 166850 - DNA, 702 bp, Homo sapiens
  misc_feature: GYAE6OF02HM3HM.26.71.G05.1.454.CMB.1.raw
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaattggagatagaaatgactgcctggtactacaggagccaggccagtcccctattttggtcacttcttaccaagtataagagccggccctcgacgggtactccccgtgaccgtaatttctcggtactcctaactcgtaggaacacgacgccactctacgaccatccgacggccgggacccacgacccgaacgggactagggaacgggtacgtaaccgttaacgttaacgttacggttaccggagggtaccgtaggggtaacgtaaacgtttaccgttaagtttacggttaacgggtttaggggtttttacggggacgggttaacgggggtaaccggtaacgggtaccggttaccgggtaccccggttaccggttaacgggttacccgaaccggtaccccgaacgggtcccgttccggaccccccggttcgggttacccaccggtttccccttccggtttccccccgaccccgtttaccccg

SEQ ID NO: 166851 - DNA, 608 bp, Homo sapiens
  misc_feature: GYAE6OF02H181T.26.71.G05.1.454.CMB.1.raw
  modified_base (238)..(238): a, c, t, g, unknown or other
  misc_feature (238)..(238): n is a, c, g, or t
  modified_base (316)..(316): a, c, t, g, unknown or other
  misc_feature (316)..(316): n is a, c, g, or t
  modified_base (339)..(339): a, c, t, g, unknown or other
  misc_feature (339)..(339): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtcgtccccaggacagacacgccaccatccacctgctcggcagacaaagttggganataagaatgctgcctggtattaccagaggccaggccagtcccctattttggtcatctccaagataagaagcggccctnacgggatccctgaccgatttccnggcctccaactctaggaacacacgccactctcgaccatcacggccggggaccccacggaccgaacggactagggacggggaacgtaacgtactagtttacgtacgacgggccggtagggagtaacgtaacgttagtttaggtaggttacgttttggggcggtagggaccgagggtacgtcggtaccgtccgtaggtccgacggcccgaaggtccgtccgtacccccgtcggtcctaacccgttccgtccggttcccccgcccttacccg

SEQ ID NO: 166852 - DNA, 543 bp, Homo sapiens
  misc_feature: GYAE6OF02F9BZZ.26.71.G05.1.454.CMB.1.raw
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccacctcagtgtccgtgtccccaggacagacagccaccatcacctgctcggcagacaaattgggagatagaaatgctgcctggtattaccagaggccaggccagtcccctattttggtctatcttccaagataagaagcggccctcagggactccctgaccgtaattctggctccaactctagggaacacgacgccactctgaccatacgaggccgggcccagaccaacggataggaacgggagacgttactagttgtacgaggcgtgggagaatacgtatttgtagttggtttggcggaggaccgagggtctaggaccgtcgtaggtccgacgccgaaggcctcgccccgtcggtcaccgttctcgtaccccg

SEQ ID NO: 166853 - DNA, 731 bp, Homo sapiens
  misc_feature: GYAE6OF02HWP1D.26.71.G05.1.454.CMB.1.raw
  modified_base (232)..(232): a, c, t, g, unknown or other
  misc_feature (232)..(232): n is a, c, g, or t
tcagagactatactcacgaccggtgctcgatttagtgtcgtcgcaagagagagggggcgtgggcctcaggaagcagcatcggaggtgcctcagccatggcatggatccctctcttcctcggcgtccttgcttactgcacaggatccgtggccttcgatgagctgattcagcccaccctcagtgtccgtgtccccaggacagacagcacatcactgctcgcagacaatggganatagaaatgactgcctggtacttaccgagagccaggccagtcccctatttcggtcaatccttacaacgtataagtaagccggacccttacgacggggatcccgtagaaccgtaacgttttctcgggtacctaccctaaactccgtaacggggtaacaaccaggtccctaacctcgtcgaaccaactcgacgggaccccgggacccacgaccgaaacgggtacgtaacggtacggggaacgtaacgttaacttacttacgggttccgaaggggtcgtacgggggtaaacgtaacggttaaaccttagtttacgggttaagggttcggttttaagggggccggggtaaacgggtaacccggtacgggaccgtttacgggaacccggtttaccgtaacggggttacccacgggttaacccccggaaaggtccccggttaccggtaccccccggttaccggttaccccgtaacgttaccccgttaccgggtttccccccccgg

SEQ ID NO: 166854 - DNA, 540 bp, Homo sapiens
  misc_feature: GYAE6OF02H31G3.26.71.G05.1.454.CMB.1.raw
  modified_base (235)..(235): a, c, t, g, unknown or other
  misc_feature (235)..(235): n is a, c, g, or t
  modified_base (394)..(394): a, c, t, g, unknown or other
  misc_feature (394)..(394): n is a, c, g, or t
  modified_base (403)..(403): a, c, t, g, unknown or other
  misc_feature (403)..(403): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccacatcacctgctcggcagacaaattggganatagaaatgctgcctggtattaccagaggccaggccagtccccctattttggtcatcttccaagactaagaagcggaccctcagggatccctgaccgaatttctggctccaaactctacggaacacagtcactctgacatcagcgggccagccaacggntcgaggganactactaatgttcaggtcgtagggagtaatacgttaattgtaagttgtttggcggaggtaccgagggcctggaccgttcgtaggtcacggcccgaaggcgttacgcccccgtggtccacttccgtaccgttcccccg

SEQ ID NO: 166855 - DNA, 526 bp, Homo sapiens
  misc_feature: GYAE6OF02GIYRY.26.71.G05.1.454.CMB.1.raw
  modified_base (312)..(312): a, c, t, g, unknown or other
  misc_feature (312)..(312): n is a, c, g, or t
  modified_base (324)..(324): a, c, t, g, unknown or other
  misc_feature (324)..(324): n is a, c, g, or t
  modified_base (517)..(517): a, c, t, g, unknown or other
  misc_feature (517)..(517): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaagtggagatagaaatgctgcctggtattaccagaggccaggcagtcccctatttggcatctcaagataagagcggcctcgaggactccngacgtaatttcngctaccactcgtaggaacacgagccactctgaccatccaggccgggcccagccgaacggatggacggagtactagttattgtcgaggcgtagggataatactatagttagtgtttgggcgtagggcaggctgaccgttcgaggtcacgaccgaaggcccgtacgccccgtggtcctaccgtctcgttcccccnccttacccg

SEQ ID NO: 166856 - DNA, 588 bp, Homo sapiens
  misc_feature: GYAE6OF02IOPEV.26.71.G05.1.454.CMB.1.raw
  modified_base (231)..(231): a, c, t, g, unknown or other
  misc_feature (231)..(231): n is a, c, g, or t
  modified_base (307)..(307): a, c, t, g, unknown or other
  misc_feature (307)..(307): n is a, c, g, or t
  modified_base (311)..(311): a, c, t, g, unknown or other
  misc_feature (311)..(311): n is a, c, g, or t
  modified_base (330)..(330): a, c, t, g, unknown or other
  misc_feature (330)..(330): n is a, c, g, or t
tcagagactatactcacgaccggtgctcgatttagtgtcgtcgcaagagagagggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatccacctgctcggcagacaaatggganatagaaatgctgcctggtattaccagagcaggccagtcccctattttcggcatctaccaagataagaagcgccctnaggntccctagaccgtaatttcngctccaactctagggaacacgacgccactctcgacctagtccaaggcccggggaccccagcccgaaacgggatacggagggacacgtacttacgttggtacaacgggcgtaggggaataacgttactagttagttaggttggtttagggacgggtaggggtaccagggccgtagacccgttcgtacggtccacggtacccgaaggccctacggcccccgttcggacctaccgttccgtccgttcccccgccctacccg

SEQ ID NO: 166857 - DNA, 608 bp, Homo sapiens
  misc_feature: GYAE6OF02JC12Z.26.71.G05.1.454.CMB.1.raw
  modified_base (280)..(280): a, c, t, g, unknown or other
  misc_feature (280)..(280): n is a, c, g, or t
  modified_base (318)..(318): a, c, t, g, unknown or other
  misc_feature (318)..(318): n is a, c, g, or t
tcagagactatactcacgaccggtgctcgatttagtgtcgtcgcaagagagagggggactcctgtgccccaccatggacacgctttgctccacgctcctgctgctgaccatcccttcatgggtcttgtcccagatcaccttgaaggagtctggtcctgcgctggtggagcccagcagaccctcacgctgacctgctccgtctctggattctcactcaccacgactgagtgaatgtggcctgggtccgtcaggccccggaaaggccctggagtggcttgcnctcatttactggagtgatctcaagcggtacaatccgtntctgagatcgactcacgactcaccgaagggaccacctaccgaaaacggtcccgggtggttacccttaacaacgtcggaacccgaactaattgaaacttccctggtacggacctagaacggctaacgattaacgttaactgtagtaccaacgacgacgttaccgtacggacgtaccgtaacgacggaaagtaaaaacgtagtaatcgtaactaggtttcggggacctaagggttaattttcggacctaccgtaccctccccgtaaggccccgttaccacccggtaaccggg

SEQ ID NO: 166858 - DNA, 657 bp, Homo sapiens
  misc_feature: GYAE6OF02HBFAQ.26.71.G05.1.454.CMB.1.raw
  modified_base (239)..(239): a, c, t, g, unknown or other
  misc_feature (239)..(239): n is a, c, g, or t
  modified_base (358)..(358): a, c, t, g, unknown or other
  misc_feature (358)..(358): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagcccaccctcagtgtccgtcgtccccaggacagacagccaccatcacctgctcggcagacaaagttggganatagaaatgctgcctaggtacttaccgagaggccaggccacgtccccttagttttcggtctactcttccaagtataaggaagccggccctcgacggactcccgtagaccgtaatttcgnggtcctcctaactcgtacggaacacacgccacctctacgaccagtaccgacgggccgggaccccacggacccgaacgggactacgggaacgggacgaacgttaacgttagttcgttaccggaggaccggtagggaacgtaattaaccgttagttggttaaggttcggtttgggacgggtacggaaccgtagggtccgtaggtacccgttaccggttaggtaccgtaccggacccgtaacggcccgttccgggtacccccgtagggttacccctccggttaccgttcccgttaccccccg

SEQ ID NO: 166859 - DNA, 542 bp, Homo sapiens
  misc_feature: GYAE6OF02GD6I5.26.71.G05.1.454.CMB.1.raw
tcagagactatactcacgaccggtgctcgatttagtgtcgtcgcaagagagaggggggactcctgtgccccaccatggacacgctttgctccacgctcctgctgctgaccatcccttcatgggtcttgtcccagatcaccttgaaggagtctggtcctgcgctggtggagcccacgcagaccctcacgctgacctgctccgtctctggattctcactcaccacgactgaggtgaatgtggcctgggtccgtcaggcccccggaaaggcccctggagtggcttgcactcatttactggagtgatctcaagcggtacaatccgtctctgaggaatcgactcaccatcaccagggacacctaccaaagaccgggtggtcccttacaatcgaccgacatgaatcctgtcggacacgaggcacatattactgtgcacacagtcctagcggactacgcgaagaaagaatatgaactagtggggacctaaggggtaattttcggtactacccgttcctaccccgagtcccctaccgacccgtaaccggg

SEQ ID NO: 166860 - DNA, 551 bp, Homo sapiens
  misc_feature: GYAE6OF02HU1A7.26.71.G05.1.454.CMB.1.raw
  modified_base (234)..(234): a, c, t, g, unknown or other
  misc_feature (234)..(234): n is a, c, g, or t
  modified_base (331)..(331): a, c, t, g, unknown or other
  misc_feature (331)..(331): n is a, c, g, or t
  modified_base (351)..(351): a, c, t, g, unknown or other
  misc_feature (351)..(351): n is a, c, g, or t
  modified_base (430)..(430): a, c, t, g, unknown or other
  misc_feature (430)..(430): n is a, c, g, or t
tcagagactatactcacgaccggtgctcgatttagtgtcgtcgcaagagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagaggccaggccagtcccctatttggcatctcaagataagaagcggccctcagggctccctgaccgaatttcnggctccaactctagggaacncgacgccactcacgaccatcgagccggggcccagacccgaacggatggacgggagactactattgtcgaggcgtggganaactagttattgtagtgttggacggtagggtaccgaggcgtagaccgtactagggtccacggcccgaaggtcctaccgccccgttcggtcctaccgtccgtccgttccccgtcccttcccg

SEQ ID NO: 166861 - DNA, 535 bp, Homo sapiens
  misc_feature: GYAE6OF02HGOPZ.26.71.G05.1.454.CMB.1.raw
  modified_base (387)..(387): a, c, t, g, unknown or other
  misc_feature (387)..(387): n is a, c, g, or t
  modified_base (417)..(417): a, c, t, g, unknown or other
  misc_feature (417)..(417): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctatttggtcatcttccaagataagaacgcggccctcagggatccctgaccgaattctggctccaactctaggaacacagccactctgaccatcagcgggccagccaacgangaggagactactattgtacaggcgtggganaagttactagtttgtagttgtttaggcgggtagggaccgaggcgtagaccgtccgtaggtccgagacccaagggcctacgccccgtcggtccacctccgtcgttccccgcccgttccc

SEQ ID NO: 166862 - DNA, 516 bp, Homo sapiens
  misc_feature: GYAE6OF02FJNLQ.26.71.G05.1.454.CMB.1.raw
  modified_base (338)..(338): a, c, t, g, unknown or other
  misc_feature (338)..(338): n is a, c, g, or t
tcagagactatactcacgaccggtgctcgatttagtgtcgtcgcaagagagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggcatcttccaagataagaagcggccctcaggggatccctgaccgaatttccnggctccaactctgggaacacagccactctgaccatcagcgggcccagcccaacggatgaagggagactacgtattgtcgaggcgtgggagaatacttattgtagtgtttagggcgagggcaggctgaccgtccgtaggtcaggcccaaggctcgcccctcggtcacgtctcgtccccg

SEQ ID NO: 166863 - DNA, 630 bp, Homo sapiens
  misc_feature: GYAE6OF02IJJ0U.26.71.G05.1.454.CMB.1.raw
  modified_base (307)..(307): a, c, t, g, unknown or other
  misc_feature (307)..(307): n is a, c, g, or t
  modified_base (318)..(318): a, c, t, g, unknown or other
  misc_feature (318)..(318): n is a, c, g, or t
tcagagactatactcacgaccggtgctcgatttagtgtcgtcgcaagagagagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggagatagaatgctgcctggtatacagagcaggccagtccctatttgcatctacaagataagagcgccagaggactccngacgtaattcncgactaccaactctacggaacacacgacctactctagacctactcgacgccgggccaacggcctaaagggctaggagggtaacaaccttaacgtacttacggacgacgggtccggtaggggtaactaacgttaacgttacggtttaggtaacggttcggttttagggaccgggtagggaacccgtagggaccgttacgggtaacccggttacgtaacggtccggaaaccggttcccgaaacgggtccctaccggtacccccgtccgggttacaccccgttacgttcccggttacccccctacccgttacccg
